(12) United States Patent
Davis et al.

(10) Patent No.: US 7,557,198 B2
(45) Date of Patent: Jul. 7, 2009

(54) ACUTE MYELOGENOUS LEUKEMIA BIOMARKERS

(75) Inventors: Lisa Davis, Albuquerque, NM (US); Cole Harris, Houston, TX (US)

(73) Assignee: Exagen Diagnostics, Inc., Albuquerque, NM (US)

( * ) Notice: Subject to any disclaimer, the term of this patent is extended or adjusted under 35 U.S.C. 154(b) by 0 days.

(21) Appl. No.: 11/417,450

(22) Filed: May 3, 2006

(65) Prior Publication Data

US 2006/0281107 A1 Dec. 14, 2006

Related U.S. Application Data

(60) Provisional application No. 60/677,765, filed on May 4, 2005.

(51) Int. Cl.
*C07H 21/02* (2006.01)
(52) U.S. Cl. .................................... 536/23.1
(58) Field of Classification Search ................. 536/23.1
See application file for complete search history.

(56) References Cited

U.S. PATENT DOCUMENTS

| | | | |
|---|---|---|---|
| 5,750,340 A | 5/1998 | Kim et al. | |
| 6,022,689 A | 2/2000 | Sarto et al. | |
| 6,664,057 B2 | 12/2003 | Albertson et al. | |
| 7,171,311 B2 * | 1/2007 | Dai et al. | 702/19 |
| 2002/0156263 A1 * | 10/2002 | Chen | 536/23.2 |
| 2003/0187584 A1 | 10/2003 | Harris et al. | |
| 2004/0005644 A1 * | 1/2004 | Su et al. | 435/7.23 |

FOREIGN PATENT DOCUMENTS

| | | |
|---|---|---|
| WO | WO 96/17958 | 6/1996 |
| WO | WO 03/073911 A2 * | 9/2003 |
| WO | 03083760 | 10/2003 |
| WO | WO 03/102235 | 12/2003 |

OTHER PUBLICATIONS

Valk et al., New England J of Medicine, 350(16):1617-1628.
Bullinger et al., New England J. of Medicine, 350(16):1605-1616 (2004).
Genbank Accession NM_021961.
Genbank Accession BX537894.
Genbank Accession NM_000090.
Genbank Accession X00588.
Genbank Accession X63556.
Genbank Accession AK074614.
Genbank Accession NM_175767.
Genbank Accession X07173.
Genbank Accession BC042897.
Genbank Accession BC009831.
Genbank Accession BC009361.
Genbank Accession BC036503.
Genbank Accession X78565.
Strauss-Soukup (1997) Biochemistry 36:8692-8698.
Milligan (1993) J. Med. Chem. 36:1923-1937; Antisense Research and Applications (1993, CRC Press).
Pearson (1983) J. Chrom. 255:137-149.
Tijssen (1993) Laboratory Techniques in Biochemistry and Molecular Biology-Hybridization with Nucleic Acid Probes part I, chapter 2, "Overview of principles of hybridization and the strategy of nucleic acid probe assays," Elsevier, N.Y.
Pastinen (1997) Genome Res. 7:606-614.
Wan (1996) Nature Biotechnology 14:1685.
Chee (1996) Science 274:610.
Alvarez, et al. (2001) Genes Chromosomes and Cancer 32(3): 285-293.
Schoch, et al. (2004) Blood 104(11): 556A.
Walter, et al. (2004) Blood 104(11): 44A.
Walter, et al. (2005) Blood 106(11): 661A.
Schoch, et al. (2002) Proceedings of the National Academy of Sciences of USA 99(15):10008-10013.
Kohlmann, et al. (2003) Genes, Chromosomes, and Cancer 37(4): 396-405.
Schoch, et al. "Specific abnormalities on the genomic level result in a distinct gene expression pattern detected by oligonucleotide microarrays: An analysis of 25 patients with AML M2/t(8)" Biosis, Nov. 2001.
Haferlach, et al. "Gene expression profiling is able to reproduce difference phenotypes in AML as defined by the FAB classification," Biosis, Nov. 2002.
Haferlach, et al., "Genetic profiling in acute monblastic versus acute moncytic leukemia: A gene expression study on 22 patients," Biosis, Nov. 2002.
http://genome.ucsc.edu/index.html?org=Human.
http://genome.ucsc.edu/cgi-bin/hgTracks.

* cited by examiner

*Primary Examiner*—Sean E Aeder
(74) *Attorney, Agent, or Firm*—McDonnell Boehnen Hulbert & Berghoff LLP

(57) ABSTRACT

The present invention provides novel compositions and their use in classifying acute myelogenous leukemia.

10 Claims, 4 Drawing Sheets

FIGURE 1A

| Unigen Hs.# gets to mRNA | length of mRNA | Gene Name | alternate name | chromosome | BAC ID | BAC start | BAC finish | BAC size |
|---|---|---|---|---|---|---|---|---|
| NM_021961 1 (SEQ ID:1) | 8850bp | TEAD1 | | 11p15.2 | RP11-599L08 (SEQ ID: 14) | 12864564 | 13039514 | 174950 |
| | | | | | RP11-756C18 (15) | 12982506 | 13132900 | 150394 |
| BX537894 2 (SEQ ID:2) | 3425 bp | | similar to glutathione peroxidase 2 | 5q11.2 | RP11-101I03 (SEQ ID: 16) | 54373904 | 54525704 | 151800 |
| NM_000090 3 (SEQ ID:3) | 5489 bp | COL3A1 | Ehlers-Danlos | 2q32.2 | RP11-622E16 (SEQ ID: 17) | 189723172 | 189897778 | 174606 |
| | | | | | RP11-634B17 (18) | 189794106 | 189976619 | 182513 |
| | | | | | RP11-1151E08 (SEQ ID: 19) | 189801124 | 189961814 | 160690 |
| X00588 (SEQ ID:4) | 5532 bp | EGFR | v-erb-b | 7p11.2 | RP11-781C22 (SEQ ID: 20) | 54695719 | 54871777 | 176058 |
| | | | | | CTD-2026N22 (SEQ ID: 21) | 54829802 | 54980210 | 150408 |
| | | | | | RP11-708P05 (SEQ ID: 22) | 54968643 | 55127566 | 158923 |
| | | | | | RP11-42K15 (SEQ ID: 23) | 46264960 | 46428008 | 163048 |
| | | | | | RP11-7J12 (SEQ ID: 24) | 46411271 | 46552128 | 140857 |
| X63556 (SEQ ID:5) | 9940 bp | FBN1 | Marfan Syndrome | 15q21.1 | RP11-348A14 (SEQ ID: 25) | 46141862 | 46333908 | 192046 |
| AK074614 6 (SEQ ID:6) | 2159 bp | putative IGF2 associated protein | hypothetical protein AK074614 | 11p15.5 | RP11-200C14 (SEQ ID: 26) | 2058679 | 2224682 | 166003 |
| | | | | | RP11-650O21 (SEQ ID: 27) | 2060017 | 2248425 | 188408 |
| | | | | | RP11-395G19 (SEQ ID: 28) | 55072048 | 55269120 | 197072 |
| | | | | | RP11-806P19 (SEQ ID: 29) | 55134284 | 55314795 | 180511 |
| | | | | | RP11-239D15 (SEQ ID: 30) | 55185675 | 55346158 | 160483 |
| NM_175767 7 (SEQ ID:7) | 3159 bp | IL6ST | gp130 Oncostatin M | 5q11.2 | RP11-321M06 (SEQ ID: 31) | 54999260 | 55218231 | 218971 |

FIGURE 1B

| | | | | | | |
|---|---|---|---|---|---|---|
| 8 | X07173 (SEQ ID:8) | 3089 bp | ITIH2 | | RP11-454I03 (SEQ ID: 32) | 7797933 | 7948167 | 150234 |
| 9 | BC042897 (SEQ ID:9) | 3049 bp | NR2F2 | 10p14 | RP11-45N19 (SEQ ID: 33) | 7866929 | 8041466 | 174537 |
| 10 | BC009831 (SEQ ID:10) | 1101 bp | RAB 25 | 15q26.2 | RP11-163P10 (SEQ ID: 34) | 94333052 | 94483707 | 150655 |
| | | | | 1q22 | RP11-702H12 (SEQ ID: 35) | 152759070 | 152923486 | 164416 |
| | | | | | RP11-714M16 (SEQ ID: 36) | 121229505 | 121423140 | 193635 |
| 11 | BC009361 (SEQ ID:11) | 769 bp | RGS10 | | RP11-278I18 (SEQ ID: 37) | 121363407 | 121528619 | 165212 |
| | | | | 10q26.11 | RP11-420N23 (SEQ ID: 38) | 121371833 | 121460477 | 88644 |
| 12 | BC036503 (SEQ ID:12) | 4482 bp | SFRP1 | 8p11.21 | RP11-11B23 (SEQ ID: 39) | 40821363 | 40955762 | 134399 |
| | | | | | RP11-818J03 (SEQ ID: 40) | 111155244 | 111327811 | 172567 |
| 13 | X78565 (SEQ ID:13) | 7560 bp | TNC | 9q32 | RP11-472E10 (SEQ ID: 41) | 111315127 | 111465510 | 150383 |

FIGURE 2A

| Significant 3-gene markers (p<=.05) gene | | | training data | | | | bootstrap | | | | test data | | | |
|---|---|---|---|---|---|---|---|---|---|---|---|---|---|---|
| A | B | C | misclassified | total poor outcome | misclassified | good outcome | misclassified | total poor outcome | good outcome misclassified | good outcome | poor outcome misclassified | total poor outcome | good outcome misclassified | total good outcome |
| sGPX2 | SFRP1 | ITIH2 | 4 | 23 | 0 | 10 | 243 | 993 | 45 | 407 | 1 | 8 | 1 | 4 |
| sGP2 | COL3A1 | FBN1 | 3 | 23 | 1 | 10 | 141 | 979 | 69 | 421 | 1 | 8 | 2 | 4 |
| TNC | sGPX2 | SFRP1 | 4 | 23 | 0 | 10 | 234 | 992 | 31 | 408 | 0 | 8 | 1 | 4 |
| RGS10 | sGPX2 | SFRP1 | 4 | 23 | 0 | 10 | 196 | 961 | 45 | 439 | 2 | 8 | 1 | 4 |
| TNC | IL6ST | sGPX2 | 4 | 23 | 1 | 10 | 191 | 997 | 136 | 403 | 0 | 8 | 2 | 4 |
| TNC | SFRP1 | ITIH2 | 7 | 23 | 0 | 10 | 318 | 982 | 69 | 418 | 0 | 8 | 0 | 4 |
| sGPX2 | ITIH2 | FBN1 | 1 | 23 | 3 | 10 | 245 | 971 | 105 | 429 | 0 | 8 | 2 | 4 |
| TNC | pIGF2AP | SFRP1 | 6 | 23 | 0 | 10 | 291 | 964 | 48 | 436 | 0 | 8 | 0 | 4 |
| pIGF2AP | sGPX2 | COL3A1 | 8 | 23 | 0 | 10 | 263 | 971 | 95 | 429 | 2 | 8 | 1 | 4 |
| sGPX2 | SFRP1 | COL3A1 | 4 | 23 | 1 | 10 | 223 | 991 | 90 | 409 | 2 | 8 | 1 | 4 |
| pIGF2AP | sGPX2 | SFRP1 | 7 | 23 | 0 | 10 | 328 | 971 | 42 | 429 | 0 | 8 | 1 | 4 |
| pIGF2AP | sGPX2 | ITIH2 | 7 | 23 | 0 | 10 | 316 | 969 | 60 | 431 | 2 | 8 | 1 | 4 |
| IL6ST | ITIH2 | FBN1 | 1 | 23 | 3 | 10 | 82 | 982 | 172 | 418 | 1 | 8 | 2 | 4 |
| TNC | sGPX2 | ITIH2 | 4 | 23 | 1 | 10 | 265 | 993 | 82 | 407 | 0 | 8 | 1 | 4 |
| sGPX2 | SFRP1 | FBN1 | 8 | 23 | 0 | 10 | 304 | 987 | 116 | 413 | 3 | 8 | 0 | 4 |
| TNC | SFRP1 | COL3A1 | 4 | 23 | 1 | 10 | 231 | 988 | 112 | 412 | 0 | 8 | 1 | 4 |
| sGPX2 | SFRP1 | RAB25 | 3 | 23 | 0 | 10 | 312 | 975 | 46 | 425 | 0 | 8 | 2 | 4 |
| EGFR | sGPX2 | ITIH2 | 8 | 23 | 1 | 10 | 352 | 978 | 79 | 422 | 1 | 8 | 1 | 4 |
| EGFR | sGPX2 | FBN1 | 4 | 23 | 1 | 10 | 228 | 974 | 147 | 426 | 2 | 8 | 1 | 4 |
| SFRP1 | COL3A1 | RAB25 | 3 | 23 | 1 | 10 | 150 | 987 | 84 | 413 | 0 | 8 | 1 | 4 |
| TNC | EGFR | ITIH2 | 4 | 23 | 0 | 10 | 224 | 995 | 103 | 405 | 0 | 8 | 1 | 4 |
| RGS10 | pIGF2AP | sGPX2 | 6 | 23 | 3 | 10 | 279 | 983 | 57 | 417 | 3 | 8 | 2 | 4 |
| IL6ST | SFRP1 | FBN1 | 1 | 23 | 2 | 10 | 145 | 951 | 202 | 449 | 0 | 8 | 1 | 4 |
| sGPX2 | ITIH2 | COL3A1 | 4 | 23 | 1 | 10 | 280 | 985 | 91 | 415 | 2 | 8 | 0 | 4 |
| pIGF2AP | ITIH2 | COL3A1 | 7 | 23 | 1 | 10 | 314 | 978 | 123 | 422 | 1 | 8 | 0 | 4 |
| TNC | IL6ST | EGFR | 6 | 23 | 1 | 10 | 219 | 991 | 122 | 409 | 1 | 8 | 0 | 4 |

FIGURE 2B

| | | | | | | | | | | | |
|---|---|---|---|---|---|---|---|---|---|---|---|
| TNC | RGS10 | SFRP1 | 3 | 23 | 2 | 10 | 302 | 931 | 112 | 469 | 0 | 8 | 1 | 4 |
| sGPX2 | SFRP1 | TEAD1 | 6 | 23 | 0 | 10 | 266 | 1003 | 78 | 397 | 1 | 8 | 2 | 4 |
| ITIH2 | RAB25 | FBN1 | 5 | 23 | 1 | 10 | 228 | 955 | 133 | 445 | 3 | 8 | 1 | 4 |
| pIGF2AP | SFRP1 | ITIH2 | 7 | 23 | 1 | 10 | 351 | 972 | 79 | 428 | 0 | 8 | 0 | 4 |
| EGFR | SFRP1 | COL3A1 | 4 | 23 | 1 | 10 | 301 | 990 | 72 | 410 | 1 | 8 | 1 | 4 |
| TNC | EGFR | sGPX2 | 3 | 23 | 2 | 10 | 248 | 968 | 121 | 432 | 0 | 8 | 1 | 4 |
| IL6ST | pIGF2AP | ITIH2 | 2 | 23 | 3 | 10 | 124 | 982 | 173 | 418 | 0 | 8 | 2 | 4 |
| TNC | ITIH2 | FBN1 | 3 | 23 | 2 | 10 | 236 | 979 | 129 | 421 | 2 | 8 | 1 | 4 |
| pIGF2AP | EGFR | SFRP1 | 8 | 23 | 0 | 10 | 356 | 992 | 77 | 408 | 1 | 8 | 0 | 4 |
| TNC | EGFR | TEAD1 | 4 | 23 | 1 | 10 | 202 | 952 | 126 | 448 | 0 | 8 | 2 | 4 |
| SFRP1 | ITIH2 | COL3A1 | 4 | 23 | 2 | 10 | 252 | 980 | 130 | 420 | 0 | 8 | 3 | 4 |
| RGS10 | SFRP1 | ITIH2 | 8 | 23 | 0 | 10 | 325 | 982 | 66 | 418 | 3 | 8 | 0 | 4 |
| EGFR | sGPX2 | TEAD1 | 5 | 23 | 1 | 10 | 379 | 974 | 78 | 426 | 1 | 8 | 2 | 4 |
| pIGF2AP | sGPX2 | NR2F2 | 2 | 23 | 2 | 10 | 175 | 969 | 141 | 431 | 0 | 8 | 3 | 4 |
| SFRP1 | ITIH2 | FBN1 | 8 | 23 | 1 | 10 | 322 | 983 | 149 | 417 | 2 | 8 | 0 | 4 |
| pIGF2AP | SFRP1 | TEAD1 | 2 | 23 | 3 | 10 | 276 | 971 | 136 | 429 | 0 | 8 | 2 | 4 |

ACUTE MYELOGENOUS LEUKEMIA BIOMARKERS

CROSS REFERENCE

This application claims priority to U.S. Patent Application Ser. No. 60/677,765 filed May 4, 2005, incorporated by reference herein in its entirety.

Sequence Listing

The sequence listing submitted on compact disc, in compliance with 37 C.F.R. § 1.52(e)(5), in incorporated by reference. Two separate compact discs are submitted, each containing the file "05-116.SeqList" (5,951,488 bytes in size on disk), each created on CD on May 3, 2006.

BACKGROUND

Acute myeloid leukemia (AML), also called acute non-lymphocytic, granulocytic, myelocytic, myeloblastic, or myeloid leukemia, is a disease in which cancer cells develop in the blood and bone marrow. The cancer develops from two main types of immature white blood cells that normally develop into mature granulocytes or monocytes. The result is a malignancy characterized by the accumulation in blood and bone marrow of abnormal hematopoietic progenitors and disruption of normal production of erythroid, myeloid, and/or megakaryocytic cell lines. It can be subdivided morphologically into specific types depending on which cell lines are involved. AML subtypes (M0-M7) are determined by cell morphology with particular subtypes such as M3 (acute promyelocytic leukemia or APL) having a more favorable outcome:

M0: undifferentiated large granular;
M1 and M2: acute myeloblastic;
M3: acute promyelocytic;
M4: myelomonocytic;
M5: monocytic;
M6: erythroleukemia;
M7: megakaryocytic; and
M4Eo: eosinphils.

By classifying AML in this manner, developed treatments can more specifically eradicate the particular defective cell clone and hopefully provide a better outcome after therapy. However, the leukemia cell karyotype is more relevant for determination of appropriate therapeutic options.

Current AML therapy regimens generally involve two stages: Initial treatment ("induction therapy") for AML is aimed at eradicating the leukemic clone to re-establish normal hematopoiesis, and post-remission therapy. AML treatment generally involves chemotherapy, and sometimes involves radiation therapy to relieve AML-induced bone pain. For patients who have relapses or have AML that does not respond to other treatment, bone marrow transplantation ("BMT") may be required, and can often increase survival.

Certain chromosomal abnormalities are routinely used to determine prognosis in adult AML patients, including t(8;21), t(15;17) or inv(16) suggestive of better prognosis; t(9; 11) used to classify patients at intermediate risk; and inv(3), −5/del(5q), −7/del(7q), t(6;9), abnormalities involving 11q23, or a complex karyotype (three or more cytogenetic aberrations) used to classify patient as being at high risk (Valk et al., New England J of Medicine, 350(16):1617-1628; Bullinger et al., New England J. of Medicine, 350(16):1605-1616 (2004)). However a significant proportion of AML patients do not exhibit such genetic abnormalities. These patients are termed the "normal karyotype" subset of AML patients, and there is currently no consensus for either risk stratification or optimal treatment regimen for this group. A means to provide a prognosis for these patients would likely be of great clinical utility.

SUMMARY OF THE INVENTION

In a first aspect, the present invention provides compositions comprising an AML biomarker, wherein the AML biomarker consists of between 2 and 60 different probe sets, wherein at least 20% of the different probe sets comprise one or more isolated polynucleotides that selectively hybridize to a genomic region selected from the group consisting of 11p15.2; 5q11.2;2q32.2;7p11.2; 15q21.1; 11p15.5; 10p14; 15q26.2; 1q22; 10q26.11; 8p11.21; and 9q32;wherein the different probe sets in total selectively hybridize to at least two of the recited genomic regions.

In a second aspect, the present invention provides compositions comprising an AML biomarker consisting of between 2 and 65 different probe sets, wherein at least 20% of the different probe sets comprise one or more isolated polynucleotides that selectively hybridize to a nucleic acid according to formula 1, or complements thereof:

X1-X2-X3;

wherein X2 is a human genomic insert contained within a bacterial artificial chromosome ("BAC") selected from the group consisting of SEQ ID NOS:14-41, wherein X1 and X3 are independently 0-500 kB of human genomic nucleic acid flanking X2 in the human genome; and wherein the different polynucleotide probe sets in total selectively hybridize to at least two non-overlapping polynucleotides according to formula 1, or complements thereof.

In a third aspect, the present invention provides compositions comprising an AML biomarker consisting of between 2 and 65 different probe sets, wherein at least 20% of the different probe sets comprise one or more isolated polynucleotides that selectively hybridize to a nucleic acid sequence according to one of SEQ ID NOS:1-13 or complements thereof; wherein the different probe sets in total selectively hybridize to at least two of the recited nucleic acid sequences according to SEQ ID NOS:1-13 or complements thereof.

In a further aspect, the present invention provides methods for classifying AML in a patient, comprising (a) contacting a nucleic acid sample obtained from a subject having AML with polynucleotide probes that, in total, selectively hybridize to two or more genomic regions selected from the group consisting of 11p15.2; 5q11.2; 2q32.2; 7p11.2; 15q21.1; 11p15.5; 10p14; 15q26.2; 1q22; 10q26.11; 8p11.21; and 9q32; wherein the contacting occurs under conditions to promote selective hybridization of the polynucleotides of the probe set to the two or more genomic regions;

(b) detecting formation of hybridization complexes;

(c) determining whether one or more of the genomic regions are present in an altered copy number in the nucleic acid sample; and (d) correlating an altered copy number of one or more of the genomic regions with an AML classification.

In a still further aspect, the present invention provides methods for classifying AML comprising:

(a) contacting a mRNA-derived nucleic acid sample obtained from a subject having AML with nucleic acid probes that, in total, selectively hybridize to two or more nucleic acid targets selected from the group consisting of SEQ ID NO:1-13 or complements thereof; wherein the contacting occurs under conditions to promote selective hybridization of the nucleic acid probes to the nucleic acid targets, or complements thereof, present in the nucleic acid sample;

(b) detecting formation of hybridization complexes between the nucleic acid probes to the nucleic acid targets, or complements thereof, wherein a number of such hybridization complexes provides a measure of gene expression of the one or more nucleic acids according to SEQ ID NO:1-13; and (c) correlating an alteration in gene expression of the one or more nucleic acids according to SEQ ID NO:1-13 relative to control with an AML classification.

In a further aspect, the present invention provides kits comprising a composition of the invention and a set of instructions for using the composition for AML classification.

BRIEF DESCRIPTION OF THE FIGURES

FIGS. 1a and 1b is a spreadsheet summary of individual markers, their GenBank accession number, Unigene numbers, genomic region at which the genes are located, and the names of bacterial artificial chromosomes ("BAC") that contain the gene.

FIGS. 2a and 2b is a spreadsheet of two-gene and three-gene signatures correlating with AML prognosis in a publicly available gene expression dataset.

DETAILED DESCRIPTION OF THE INVENTION

All publications, GenBank Accession references, references to bacterial artificial chromosome ("BAC") accession numbers (sequences), patents and patent applications cited herein are hereby expressly incorporated by reference for all purposes.

Within this application, unless otherwise stated, the techniques utilized may be found in any of several well-known references such as: *Molecular Cloning: A Laboratory Manual* (Sambrook, et al., 1989, Cold Spring Harbor Laboratory Press), *Gene Expression Technology* (Methods in Enzymology, Vol. 185, edited by D. Goeddel, 1991. Academic Press, San Diego, Calif.), "Guide to Protein Purification" in *Methods in Enzymology* (M. P. Deutshcer, ed., (1990) Academic Press, Inc.); *PCR Protocols: A Guide to Methods and Applications* (Innis, et al. 1990. Academic Press, San Diego, Calif.), *Culture of Animal Cells: A Manual of Basic Technique*, 2$^{nd}$ Ed. (R. I. Freshney. 1987. Liss, Inc. New York, N.Y.), *Gene Transfer and Expression Protocols*, pp. 109-128, ed. E. J. Murray, The Humana Press Inc., Clifton, N.J.), and the Ambion 1998 Catalog (Ambion, Austin, Tex.).

The present invention provides novel compositions and methods for their use in providing a prognosis for acute myelogenous leukemia patients ("AML"). As used herein, the term "prognosis" means a prediction of the probable course and outcome of the AML, including the following:

(a) Patient prognosis in the absence of therapy (ie: chemotherapy or radiation therapy;
(b) Prognosis of patient response to treatment (chemotherapy, radiation therapy)
(c) Predicted optimal course of treatment for the patient;
(d) Prognosis for patient relapse after treatment, for example, by prognosis of minimal residual disease (such patients have high risk of relapse)
(e) Patient life expectancy.

The compositions of the present invention are defined relative to the following nucleic acid sequences that are identified herein as being useful markers for AML prognosis:

1. GENBANK ACCESSION NM_021961 (SEQ ID NO:1): EST (TEAD1)

2. GENBANK ACCESSION BX537894 (SEQ ID NO:2): similar to glutathione peroxidase 2 ("sGPX2").

3. GENBANK ACCESSION NM_000090 (SEQ ID NO:3): COL3A1 pro-collagen alpha 1(III) chain ("Ehlers-Danlos").

4. GENBANK ACCESSION X00588 (SEQ ID NO:4): EGFR epidermal growth factor receptor precursor (v-erb-b).

5. GENBANK ACCESSION X63556 (SEQ ID NO:5): FBN1 fibrillin 1 precursor ("Marfan Syndrome").

6. GENBANK ACCESSION AK074614 (SEQ ID NO:6): pIGF2AP: Putative insulin-like growth factor II associated protein 7. GENBANK ACCESSION NM_175767 (SEQ ID NO:7): IL6ST interleukin-6 receptor beta chain precursor (gp130; oncostatin M receptor).

8. GENBANK ACCESSION X07173 (SEQ ID NO:8): ITIH2; inter-alpha-trypsin inhibitor complex component II.

9. GENBANK ACCESSION BC042897 (SEQ ID NO:9): NR2F2.

10. GENBANK ACCESSION BC009831 (SEQ ID NO:10): RAB25; ras-related protein.

11. GENBANK ACCESSION BC009361 (SEQ ID NO:11): RGS10; regulator of g-protein signaling.

12. GENBANK ACCESSION BC036503 (SEQ ID NO:12): SFRP1.

13. GENBANK ACCESSION X78565 (SEQ ID NO:13): TNC; tenascin precursor.

While individually predictive, the inventors believe that the clinical prognostic utility of combinations of these and related markers disclosed herein will be greater than the clinical diagnostic utility of individual markers. Such combinations may better classify the complexity of genomic aberrations associated with particular AML phenotypes.

Physical distances between the genes used in these studies, as described in publicly available databases (for example, UCSC human genome web site genome.ucsc.edu) reveals that, while the sizes of amplifications vary among tumors, the size of an "average" amplification is reasonably estimated as at least 1 megabase.

Thus, in a first aspect, the present invention provides compositions comprising or consisting of an AML biomarker, wherein the AML biomarker comprises or consists of between 2 and 60 different probe sets, wherein at least 20% of the different probe sets comprise or consist of one or more isolated polynucleotides that selectively hybridize to a genomic region selected from the group consisting of 11p15.2; 5q11.2; 2q32.2; 7p11.2; 15q21.1; 11p15.5; 10p14; 15q26.2; 1q22; 10q26.11; 8p11.21; and 9q32; wherein the different probe sets in total selectively hybridize to at least two of the recited genomic regions. The term "AML biomarker" as used herein for all of the aspects and embodiments of the invention, refers to its use in classifying AMLs. The recited genomic regions correspond to the chromosome band of the markers, and the compositions of the invention can be used, for example, to provide improved AML prognosis over that possible using prior art diagnostic and predictive compositions and methods. FIG. 1 provides a detailed summary of the individual markers, their GenBank accession number, Unigene numbers, genomic region at which the genes are located, and the names of bacterial artificial chromosomes ("BAC") that contain the gene (discussed in more detail below).

Thus, the compositions of each aspect and embodiment of the present invention are useful, for example, in classifying human AMLs. The compositions can be used, for example, to identify one or more genomic regions as present in an abnormal copy number (for example, more than two copies of the gene per cell in a chromosome spread or fewer than two copies of the gene) in a nucleic acid sample from a human specimen, such as peripheral blood, inflammatory sites, or bone marrow sample from a human AML patient, or in specific cells isolated from such specimens, such as granulocyte precursors, or monocyte precursors, which provides a prognosis of the AML patient as discussed above and below. Alternatively, certain embodiments of the compositions (as discussed in more detail below) are preferred for use in determining the expression levels in tissue of the MRNA encoded by the genes recited above.

The compositions according to each of the aspects and embodiments of the invention provide an improvement over the prior art for AML prognosis, which requires a much larger number of probes to provide a prognosis for an AML patient, and does so with reduced accuracy compared to the AML biomarker of the present invention. As a result, the compositions of the present invention are much more amenable to use in clinical prognostic testing than are prior art methods for AML prognosis.

The term "polynucleotide" as used herein with respect to each aspect and embodiment of the invention refers to DNA or RNA, preferably DNA, in either single- or double-stranded form. It includes the recited sequences as well as their complementary sequences, which will be clearly understood by those of skill in the art. The term "polynucleotide" encompasses nucleic acids containing known analogues of natural nucleotides which have similar or improved binding properties, for the purposes desired, as the disclosed polynucleotides. The term also encompasses nucleic-acid-like structures with synthetic backbones. DNA backbone analogues provided by the invention include phosphodiester, phosphorothioate, phosphorodithioate, methylphosphonate, phosphoramidate, alkyl phosphotriester, sulfamate, 3'-thioacetal, methylene(methylimino), 3'-N-carbamate, morpholino carbamate, and peptide nucleic acids (PNAs), methylphosphonate linkages or alternating methylphosphonate and phosphodiester linkages (Strauss-Soukup (1997) Biochemistry 36:8692-8698), and benzylphosphonate linkages, as discussed in U.S. Pat. No. 6,664,057; see also Oligonucleotides and Analogues, a Practical Approach, edited by F. Eckstein, IRL Press at Oxford University Press (1991); Antisense Strategies, Annals of the New York Academy of Sciences, Volume 600, Eds. Baserga and Denhardt (NYAS 1992); Milligan (1993) J. Med. Chem. 36:1923-1937; Antisense Research and Applications (1993, CRC Press).

An "isolated" polynucleotide as used herein for all of the aspects and embodiments of the invention is one which is free of sequences which naturally flank the polynucleotide in the genomic DNA of the organism from which the nucleic acid is derived, except as specifically described herein. Preferably, an "isolated" polynucleotide is substantially free of other cellular material, gel materials, vector linker sequences, and culture medium when produced by recombinant techniques, or substantially free of chemical precursors or other chemicals when chemically synthesized. The polynucleotides of the invention may be isolated from a variety of sources, such as by PCR amplification from genomic DNA, mRNA, or cDNA libraries derived from mRNA, using standard techniques; or they may be synthesized in vitro, by methods well known to those of skill in the art, as discussed in U.S. Pat. No. 6,664,057 and references disclosed therein. Synthetic polynucleotides can be prepared by a variety of solution or solid phase methods. Detailed descriptions of the procedures for solid phase synthesis of polynucleotide by phosphite-triester, phosphotriester, and H-phosphonate chemistries are widely available. (See, for example, U.S. Pat. No. 6,664,057 and references disclosed therein). Methods to purify polynucleotides include native acrylamide gel electrophoresis, and anion-exchange HPLC, as described in Pearson (1983) J. Chrom. 255:137-149. The synthetic polynucleotide sequences can be verified using standard methods.

As used herein with respect to all aspects and embodiments of the invention, a "probe set" refers to a group of one or more polynucleotides that each selectively hybridize to the same target (for example, a specific genomic region or mRNA) that can be used, for example, in AML classification. Thus, a single "probe set" may comprise any number of different isolated polynucleotides that selectively hybridize to a given target. For example, a probe set that selectively hybridizes to SEQ ID NO:10 may comprise one or more probes for a single 100 nucleotide segment of SEQ ID NO:10 and also a different 100 nucleotide segment of SEQ ID NO:10, or both these in addition to a separate 10 nucleotide segment of SEQ ID NO:10, or 500 different 10 nucleotide segments of SEQ ID NO:10 (such as, for example, fragmenting a larger probe into many individual short polynucleotides). Those of skill in the art will understand that many such permutations are possible.

In this first aspect, the AML biomarker can be any AML biomarker that contains between 2 and 60 probe sets as defined herein, wherein at least 20% of the probe sets comprise or consist of one or more isolated polynucleotides that selectively hybridize to one of the recited genomic regions. Such AML biomarkers thus can contain other probe sets for use in AML prognosis, so long as at least 20% of the probe sets comprise or consist of one or more isolated polynucleotides that selectively hybridize to one of the recited genomic regions, and so long as no more than 60 probe sets are present in the AML biomarker.

In preferred embodiments of the first aspect of the invention, at least 25%, 30%, 35%, 40%, 45%, 50%, 55%, 60%, 65%, 70%, 80%, 85%, 90%, 95%, or 100% of the probe sets comprise or consist of one or more isolated polynucleotides that selectively hybridize to one of the recited genomic regions, and/or that the different probe sets in total selectively hybridize to at least 3, 4, 5, 6, 7, 8, 9, 10, 11, or 12 of the recited genomic regions. As will be apparent to those of skill in the art, as the percentage of probe sets that comprise or consist of one or more isolated polynucleotides that selectively hybridize to one of the recited genomic regions increases, the maximum number of probe sets in the AML biomarker will decrease accordingly. Thus, for example, where at least 50% of the probe sets comprise or consist of one or more isolated polynucleotides that selectively hybridize to one of the recited genomic regions, the AML marker will consist of between 2 and 24 probe sets. Those of skill in the art will recognize the various other permutations encompassed by the compositions according to the various aspects of the invention.

In a further preferred embodiment, the different probe sets in total selectively hybridize to at least the following genomic regions: 11p15.5 (pIGF2AP); 8p11.21 (SFRP1), and 9q32 (TNC).

The composition of each aspect and embodiment of the invention may further comprise other polynucleotide components that are beneficial for use in combination with the AML biomarker, such as competitor nucleic acids and other control sequences (such as sequences to provide a standard of hybridization for comparison, etc.) Such other polynucleotide components are not probe sets for purposes of the compositions and methods of the invention. The compositions may optionally comprise other components, including but not limited to buffer solutions, hybridization solutions, detectable labels, and reagents for storing the nucleic acid compositions.

As used herein with respect to each aspect and embodiment of the invention, the term "selectively hybridizes" means that the isolated polynucleotides bind to the particular genomic region or other target to form a hybridization complex, and minimally or not at all to other sequences. The specific hybridization conditions used will depend on the length of the polynucleotide probes employed, their GC content, as well as various other factors as is well known to those of skill in the art. (See, for example, Tijssen (1993) Laboratory Techniques in Biochemistry and Molecular Biology—Hybridization with Nucleic Acid Probes part I, chapter 2, "Overview of principles of hybridization and the strategy of nucleic acid probe assays," Elsevier, N.Y. ("Tijssen")). In one embodiment, stringent hybridization and wash conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. High stringency conditions are selected to be equal to the Tm for a particular probe. An example of stringent conditions are those that permit selective hybridization of the isolated polynucleotides to the genomic or other target nucleic acid to form hybridization complexes in 0.2×SSC at 65° C. for a desired period of time, and wash conditions of 0.2×SSC at 65° C. for 15 minutes. It is understood that these conditions may be duplicated using a variety of buffers and temperatures. SSC (see, e.g., Sambrook, Fritsch, and Maniatis, in: Molecular Cloning, A Laboratory Manual, Cold Spring Harbor Laboratory Press, 1989) is well known to those of skill in the art, as are other suitable hybridization buffers.

In each of the aspects and embodiments of the compositions and methods of the present invention, it is further preferred that the isolated polynucleotides are labeled with a detectable label. In a preferred embodiment, the detectable labels on the isolated polynucleotides in one probe set are all the same, and are distinguishable from the detectable labels on the isolated polynucleotides in the other probe sets in a given AML biomarker (i.e., the different probe sets are "differentially labeled"). Such labeling of the isolated polynucleotides facilitates differential determination of the signals from different reporter sets in a given AML biomarker. Useful detectable labels include but are not limited to radioactive labels such as $^{32}P$, $^{3}H$, and $^{14}C$; fluorescent dyes such as fluorescein isothiocyanate (FITC), rhodamine, lanthanide phosphors, Texas red, and ALEXA Fluor Dyes™ (Molecular Probes), CY™ dyes (Amersham), Spectrum Dyes (Abbott Labs); electron-dense reagents such as gold; enzymes such as horseradish peroxidase, beta-galactosidase, luciferase, and alkaline phosphatase; colorimetric labels such as colloidal gold; magnetic labels such as those sold under the mark DYNABEADS™; biotin; dioxigenin; or haptens and proteins for which antisera or monoclonal antibodies are available. The label can be directly incorporated into the polynucleotide, or it can be attached to a molecule which hybridizes or binds to the polynucleotide. The labels may be coupled to the isolated polynucleotides by any means known to those of skill in the art. In various embodiments, the isolated polynucleotides are labeled using nick translation, PCR, or random primer extension (see, e.g., Sambrook et al. supra). Methods for detecting the label include, but are not limited to spectroscopic, photochemical, biochemical, immunochemical, physical or chemical techniques.

Those of skill in the art are aware that multiple resources are available to identify specific nucleotide sequences associated with the genomic regions discussed above. In one example, such sequences can be found as follows:

Go to the UCSC web site, genome.ucsc.edu/index.html?org=Human. At this site, select the Genome Browser on the menu at the left. Then in the "position" field enter, (in this format, e.g. for chromosome 16p13): 16:11,000,000-12,000,000 and then select "jump" (position entries have to be either by gene name, clone name, accession number, etc. or base pair position, usually in millions) Once the image of the chromosome is in view, which has the base pairs at the top of the image, and the chromosome bands immediately below, the navigation tools can be used to zoom in or out, move to the left or right as necessary. To get to the sequence itself (for 16p13, as an example), select the band designation within the image, which leads to the "Chromosome Bands Localized by FISH Mapping Clones (p13.2)" page, which has the "View DNA for this feature" button. Choose the "View DNA . . . " button which leads to the "Get DNA in Window". At the bottom of that page choose the "Get DNA" button, and the sequence appears. At the very top of the sequence page the exact base pairs are shown.

Those of skill in the art will understand how to apply the present disclosure to identify the nucleotide sequences of other genomic regions of interest disclosed herein.

In a second aspect, the invention provides compositions comprising or consisting of an AML biomarker comprising or consisting of between 2 and 65 different probe sets, wherein at least 20% of the different probe sets comprise or consist of one or more isolated polynucleotides that selectively hybridize to a nucleic acid according to formula 1, or complements thereof:

X1-X2-X3;

wherein X2 is a human genomic insert contained within a bacterial artificial chromosome ("BAC") selected from the group consisting of SEQ ID NOS: 14-41 (see FIG. 1), wherein X1 and X3 are independently 0-500 kB of human genomic nucleic acid flanking X2 in the human genome; and wherein the different polynucleotide probe sets in total selectively hybridize to at least two non-overlapping polynucleotides according to formula 1, or complements thereof.

BAC sequence information is provided below in Table 1 (and as provided in FIG. 1).

TABLE 1

| (a) | TEAD1: | RP11-599L08 (SEQ ID NO: 14) |
| | | RP11-756C18 (SEQ ID NO: 15) |
| (b) | sGPX2 | RP11-101I03 (SEQ ID NO: 16) |
| (c) | COL3A1: | RP11-622E16 (SEQ ID NO: 17) |
| | | RP11-634B17 (SEQ ID NO: 18) |
| | | RP11-1151E08 (SEQ ID NO: 19) |
| (d) | EGFR: | RP11-781C22 (SEQ ID NO: 20) |
| | | CTD-2026N22 (SEQ ID NO: 21) |
| | | RP11-708P05 (SEQ ID NO: 22) |
| (e) | FBN1 | RP11-42K15 (SEQ ID NO: 23) |
| | | RP11-7J12 (SEQ ID NO: 24) |
| | | RP11-348A14 (SEQ ID NO: 25) |
| (f) | pIGF2AP | RP11-200C14 (SEQ ID NO: 26) |
| | | RP11-650O21 (SEQ ID NO: 27) |
| (g) | IL6ST | RP11-395G19 (SEQ ID NO: 28) |
| | | RP11-806P19 (SEQ ID NO: 29) |
| | | RP11-239D15 (SEQ ID NO: 30) |
| | | RP11-321M06 (SEQ ID NO: 31) |
| (h) | ITIH2 | RP11-454I03 (SEQ ID NO: 32) |
| | | RP11-45N19 (SEQ ID NO: 33) |
| (i) | NR2F2 | RP11-163P10 (SEQ ID NO: 34) |
| (j) | RAB25 | RP11-702H12 (SEQ ID NO: 35) |
| (k) | RGS10 | RP11-714M16 (SEQ ID NO: 36) |
| | | RP11-278I18 (SEQ ID NO: 37) |
| | | RP11-420N23 (SEQ ID NO: 38) |

TABLE 1-continued

| (l) | SFRP1 | RP11-11B23 (SEQ ID NO: 39) |
| (m) | TNC | RP11-818J03 (SEQ ID NO: 40) |
|  |  | RP11-472E10 (SEQ ID NO: 41) |

The nucleic acids disclosed above in the "X2" group are the human nucleic acids encompassing the marker genes (and portions of the genomic regions of the first aspect of the invention) discussed above, cloned into BAC vectors. (See FIG. 1) As will be apparent to those of skill in the art in reviewing FIG. 1, genomic regions for each of the cloned markers for AML prognosis described above (SEQ ID NO:1-13) are present in the BAC inserts listed within the "X2" groups above. For some of the 13 cloned markers, multiple overlapping BAC inserts are provided (see FIG. 1).

According to this second aspect of the invention, the different polynucleotide probe sets in total selectively hybridize to at least two non-overlapping nucleic acids according to Formula 1 (ie: at least two of (a)-(m) in Table 1).

In various preferred embodiments of this second aspect of the invention, the AML biomarker comprises or consists of 3, 4, 5, 6, 7, 8, 9, 10, 11, 12, or 13 different probe sets that selectively hybridize to a nucleic acid according to formula 1, or complements thereof. In each of these embodiments, it is further preferred that at least 30%, 40%, 50%, 60%, 70%, 80%, 90%, or 100% of the probe sets for a given AML biomarker comprise or consist of one or more isolated polynucleotides that selectively hybridize to a nucleic acid according to formula 1, or complements thereof, wherein the different polynucleotide probe sets in total selectively hybridize three non-overlapping nucleic acids according to formula 1.

In a further preferred embodiment of the second aspect of the invention, the different probe sets comprise or consist of one or more isolated polynucleotides that in total selectively hybridize to at least three different nucleic acids according to Formula I having X2 groups as follows:

a) one or more of SEQ ID NO:26-27 (includes pIGF2AP), or complements thereof;

b) one or more of SEQ ID NO:40-41(includes TNC), or complements thereof; and c) SEQ ID NO: 39 (includes SFRP1), or complements thereof.

As will be apparent to those of skill in the art, as the percentage of probe sets that comprise or consist of one or more isolated polynucleotides that selectively hybridize to a nucleic acid sequence according to formula 1, or its complement, the maximum number of probe sets in the AML biomarker will decrease accordingly. Thus, for example, where at least 50% of the probe sets comprise or consist of one or more isolated polynucleotides that selectively hybridize to a nucleic acid sequence according to formula 1, or its complement, the AML marker will consist of between 2 and 26 probe sets. Those of skill in the art will recognize the various other permutations encompassed by the compositions according to the various embodiments of the second aspect of the invention.

In a further preferred embodiment of each of the above embodiments of the second aspect of the invention, X1 and X3 are 0-400 kb, 0-300 kb, 0-200 kb, 0-100 kb, or 0 kb.

In a preferred embodiment of the various embodiments of the second aspect of the invention, the different probe sets of an AML biomarker comprise or consist of one or more polynucleotide sequences of at least 10 nucleotides of a nucleic acid according to formula 1, or its complement. In a further preferred embodiment, the different probe sets of a AML biomarker comprise or consist of one or more polynucleotides of at least 10 nucleotides of a nucleic acid selected from the group consisting of SEQ ID NOS:14-41 or complements thereof.

In various further preferred embodiments of each of the embodiments of the first and second aspects of the invention, and related aspects and embodiments described below, the polynucleotides in the probe set independently comprise or consist of at least 10, 15, 20, 25,30, 35, 40, 45, 50, 55, 60, 65, 70, 75, 80, 85, 90, 95,100, 150, 200, 250, 300, 350, 400, 450, 500, 550, 600, 650, 700, 750, 800, 850, 900, 950, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300, 7400, 7500, 7600, 7700, 7800, 7900, 8000, 8100, 8200, 8300, 8400, 8500, 8600, 8700, 8800, 8900, 9000, 9100, 9200, 9300, 9400, 9500, 9600, 9700, 9800, 9900, 10,000; 15,000; 20,000; 25,000; 30, 000; 35,000; 40,0000; 45,000; 50,000; 60,000; 70,000; 80,000; 90,000; 100,000; 110,000; 120,000; 130,000; 140,000; 150,000; 160,000; 170,000; 180, 000; 190,000; 200,000; 210,000; or 220,000 nucleotides of the relevant sequence.

The BACS disclosed herein are as defined on the University of California at Santa Cruz (UCSC) Genome Browser on Human April 2003 Freeze and are available from the Children's Hospital Oakland Research Institute at web site bacpac.chori.org. The human genomic inserts cloned into the BACS disclosed herein range in size from approximately 150 kB to 220 in length.

As of March of 2004, detailed information on the BACS is available by going to the web site for the Children's Hospital Oakland Research Institute at web site bacpac.chori.org and clicking on the link to "Human '32K' BAC Re-array" under the products menu. From this page, web site bcgsc.ca/lab/mapping/bacrearray/human/ provides a link to the Genome Sciences Centre web page. From this page, go to the Annotations box and find the further box for "Browse clone set". Within that box is a link to the UCSC Genome Browser; click on the link that says "available," which takes you to web site genome.ucsc.edu/cgi-bin/hgTracks, where detailed BAC information, such as that provided in the accompanying figures, can be found. The BACS can be found by searching by BAC name or by gene name. The sequence of the human genomic insert cloned in a BAC of interest can be found at web site genome.ucsc.edu/cgi-bin/hgTracks. Once the BAC of interest has been found in the database, as described above, the sequence of each BAC be found by "clicking" on the name of the BAC. The first click connects to a "Custom Track" for that BAC. On the Custom Track page there is an option called "View DNA for this feature", which is a link to the "Get DNA" window, for that specific BAC. On the "Get DNA" page, the "Get DNA" button retrieves the complete DNA sequence for that BAC clone. Furthermore, sequences flanking the BAC of interest can also be retrieved from the "Get DNA" page by using "Sequence Retrieval Option": the number of bases desired both upstream and downstream of the BAC are entered and, and those flanking sequences are then retrieved along with the sequence of the BAC itself. Furthermore, the detailed information on the BACS provided herein discloses the genomic location in terms of base pair position of the human genomic insert cloned in BACS as of the Human April 2003 Freeze.

As will be understood by those of skill in the art, the human genome sequence is frequently updated, with the updates made available to the public. Those of skill in the art will thus be able to identify the sequences flanking the human genomic insert cloned in a BAC of interest disclosed herein by accessing the human genome information (for example, at web site genome.ucsc.edu/). Therefore, the "flanking sequences" as recited herein refer to flanking sequences as disclosed on the web sites provided above, as well as updates thereto. For example, one can go to the UCSC Genome Browser site as disclosed above and review the BAC information as of the Human April 2003 Freeze to get the relative base pair position on the chromosome that the human genomic insert cloned in a BAC of interest was derived from. By reviewing the human genome sequence data available at as of the Human April 2003 Freeze (as described above), one of skill in the art can obtain the nucleic acid sequences flanking the human genomic insert cloned in a BAC of interest disclosed herein. Those of skill in the art can further use this sequence to identify sequences flanking the human genomic insert cloned in a BAC of interest from this same site as currently updated in the human genome sequence, or from other similar sites that provide human genome sequence information.

In a third aspect, the present invention provides compositions comprising or consisting of an AML biomarker comprising or consisting of between 2 and 65 different probe sets, wherein at least 20% of the different probe sets comprise or consist of one or more isolated polynucleotides that selectively hybridize to a nucleic acid sequence according to one of SEQ ID NOS:1-13 or complements thereof; wherein the different probe sets in total selectively hybridize to at least two of the recited nucleic acid sequences according to SEQ ID NOS: 1-13 or complements thereof.

In various preferred embodiments of the third aspect of the invention, the composition comprises or consists of an AML biomarker comprising or consisting of 3, 4, 5, 6, 7, 8, 9, 10, 11, 12, or 13 different probe sets that selectively hybridize to a nucleic acid according to one of SEQ ID NOS:1-13 or complements thereof, wherein the different probe sets in total selectively hybridize to 3, 4, 5, 6, 7, 8, 9, 10, 11, 12, or 13 of the nucleic acid sequences according to SEQ ID NOS:1-13 or complements thereof. In each of these embodiments, it is further preferred that at least 30%, 40%, 50%, 60%, 70%, 80%, 90%, or 100% of the probe sets for a given AML biomarker comprise or consist of one or more isolated polynucleotides that selectively hybridize to a nucleic acid according to SEQ ID NOS:1-13, or complements thereof. As will be apparent to those of skill in the art, as the percentage of probe sets that comprise or consist of one or more isolated polynucleotides that selectively hybridize to a nucleic acid according to SEQ ID NOS:1-13, or complements thereof, the maximum number of probe sets in the AML biomarker will decrease accordingly. Thus, for example, where at least 50% of the probe sets comprise or consist of one or more isolated polynucleotides that selectively hybridize to a nucleic acid according to SEQ ID NOS:1-13, or complements thereof, the AML marker will consist of between 2 and 26 probe sets. Those of skill in the art will recognize the various other permutations encompassed by the compositions according to the various embodiments of the third aspect of the invention.

In a preferred embodiment of the various embodiments of the third aspect of the invention, the different probe sets of a AML biomarker comprise or consist of one or more polynucleotides of at least 10 nucleotides of a nucleic acid according to SEQ ID NOS:1-13, or complements thereof.

In a further preferred embodiment, the different probe sets comprise or consist of isolated polynucleotides that in total selectively hybridize to at least SEQ ID NOS:6, 12 and 13, or complements thereof. In this embodiment, it is further preferred that at least 25%, 30%, 35%, 40%, 45%, 50%, 55%, 60%, 65%, 70%, 80%, 85%, 90% 95% or 100% of the probe sets comprise or consist of one or more isolated polynucleotides that selectively hybridize to one of these recited nucleic acids, or complements thereof.

The compositions of this third aspect of the invention are especially preferred for analysis of RNA expression from the genes in a tissue of interest, such as peripheral blood, granulocyte precursors, monocyte precursors, inflammatory sites, or bone marrow samples from an AML patient. Such polynucleotides according to this aspect of the invention can be of any length that permits selective hybridization to the nucleic acid of interest. In various preferred embodiments of the third aspect of the invention and related aspects and embodiments disclosed below, the isolated polynucleotides comprise or consist of at least 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, or 1000 nucleotides according to a nucleic acid sequence selected from the group consisting of SEQ ID NOS:1-13 or complements thereof. In further embodiments, an isolated polynucleotide according to this third aspect of the invention comprise or consist of a nucleic acid sequence according to one of SEQ ID NOS:1-13 or complements thereof.

The compositions of the various aspects and embodiments of the invention can be in lyophilized form, or preferably comprise a solution containing the isolated polynucleotides or polypeptides, including but not limited to buffer solutions, hybridization solutions, and solutions for keeping the compositions in storage. Such a solution can be made as such, or the composition can be prepared at the time of hybridizing the polynucleotides to a target sequence as discussed below.

Alternatively, the compositions can be placed on a solid support, such as in a microarray, bead, or microplate format. The term "microarray" as used herein refers to a plurality of probe sets immobilized on a solid surface to which sample nucleic acids are hybridized (such as mRNA or derived cDNA from an AML patient) are bound.

Thus, in a fourth aspect, the present invention provides microarrays comprising a support structure on which are arrayed probe sets according to the compositions of the invention, as disclosed above. In this aspect, a single probe set can be present at a single location on the array, or different polynucleotides from a single probe set can be present at different and defined locations on the array.

In this aspect, the polynucleotides or polypeptides are immobilized on a microarray solid surface. Other nucleic acid sequences, such as reference or control nucleic acids, can be optionally immobilized on the solid surface as well. Methods for immobilizing nucleic acids on a variety of solid surfaces are well known to those of skill in the art. A wide variety of materials can be used for the solid surface. Examples of such solid surface materials include, but are not limited to, nitrocellulose, nylon, glass, quartz, diazotized membranes (paper or nylon), silicones, polyformaldehyde, cellulose, cellulose acetate, paper, ceramics, metals, metalloids, semiconductive materials, coated beads, magnetic particles; plastics such as polyethylene, polypropylene, and polystyrene; and gel-forming materials, such as proteins (e.g., gelatins), lipopolysaccharides, silicates, agarose and polyacrylamides.

A variety of different materials may be used to prepare the microarray solid surface to obtain various properties. For example, proteins (e.g., bovine serum albumin) or mixtures of macromolecules (e.g., Denhardt's solution) can be used to minimize non-specific binding, simplify covalent conjugation, and/or enhance signal detection. If covalent bonding between a compound and the surface is desired, the surface will usually be functionalized or capable of being functionalized. Functional groups which may be present on the surface and used for linking include, but are not limited to, carboxylic acids, aldehydes, amino groups, cyano groups, ethylenic groups, hydroxyl groups, and mercapto groups. Methods for linking a wide variety of compounds to various solid surfaces are well known to those of skill in the art.

In a preferred embodiment of this aspect, the locations on the array containing probe sets of the present invention range in size between 1 μm and 1 cm in diameter, more preferably between 1 μm and 5 mm in diameter, and even more preferably between 5 μm and 1 mm in diameter. The polynucleotides of the probe sets may be arranged on the solid surface at different densities, depending on factors such as the nature of the label, the solid support, and the size of the polynucleotide. One of skill will recognize that each location on the microarray may comprise a mixture of polynucleotides of different lengths and sequences from a given probe set. The length and complexity of the polynucleotides fixed onto the locations can be adjusted to provide optimum hybridization/binding and signal production for a given hybridization/binding procedure, and to provide the required resolution.

In a fifth aspect, the present invention provides methods for classifying AML in a patient, comprising
  (a) contacting a nucleic acid sample obtained from a subject having AML with polynucleotide probes that, in total, selectively hybridize to two or more genomic regions selected from the group consisting of 11p15.2; 5q11.2; 2q32.2; 7p11.2; 15q21.1; 11p15.5; 10p14; 15q26.2; 1q22; 10q26.11; 8p11.21; and 9q32; wherein the contacting occurs under conditions to promote selective hybridization of the polynucleotides of the probe set to the two or more genomic regions;
  (b) detecting formation of hybridization complexes;
  (c) determining whether one or more of the genomic regions are present in an altered copy number in the nucleic acid sample; and
  (d) correlating an altered copy number of one or more of the genomic regions with an AML classification.

The nucleic acid sample used in the methods of the present invention can be from any source useful in providing a prognosis for an AML patient, including but not limited to peripheral blood, inflammatory sites, or bone marrow sample from a human AML patient, or in specific cells isolated from such specimens, such as granulocyte precursors, or monocyte precursors. The nucleic acid sample is preferably a cellular DNA sample. In a preferred embodiment, the nucleic acid sample is a human nucleic acid sample.

In a preferred embodiment of this aspect of the invention, the method further comprises identifying the AML patient as being of the normal karyotype subclass prior to or simultaneously with carrying out steps (a)-(d). As used herein, "normal karyotype subclass" means that the AML patient does not possess any of the genetic abnormalities often associated with AML, including t(8;21), t(15;17), inv(16), t(9;11), inv(3), −5/del(5q), and −7/del(7q), t(6;9), or abnormalities involving 11q23. Thus, in this embodiment, the method is carried out simultaneously with or following a karyotype analysis for the AML patient that does not show any AML-correlated karyotype abnormalities. As used herein, "following" includes immediately following, or following at some future time.

In a further embodiment of any of the above embodiments, the method may further comprise determining the AML morphological subtype, as described above.

In the fifth aspect of the invention the methods are used to detect genomic amplifications or deletions associated with AML. As used herein "associated with AML" means that an altered copy number of one or more of these genomic regions can be used to provide a prognosis of a patient from whom the nucleic acid sample was taken, including the following:
  (a) Patient prognosis in the absence of therapy (ie: chemotherapy or radiation therapy);
  (b) Prognosis of patient response to treatment (chemotherapy, radiation therapy);
  (c) Predicted optimal course of treatment for the patient;
  (d) Prognosis for patient relapse after treatment, for example, by prognosis of minimal residual disease (such patients have high risk of relapse); and/or
  (e) Patient life expectancy.

Thus, the methods of this aspect of the invention provide information on AML patient prognosis in the presence or absence of treatment, a predicted optimal course for treatment of the patient, and patient life expectancy. In a further preferred embodiment, an alteration (ie: increase or decrease) in the copy number of the one or more genomic regions is correlated with an increased risk of recurrence of AML. In a most preferred embodiment, a decrease in copy number of the one or more genomic regions is correlated with a higher risk of poor outcome. This decrease can be an absolute decrease in copy number of the genomic region(s) to less than two, or can be a decrease relative to those AML patients with a good prognosis.

As used herein, "poor outcome" means relapse, death due to disease, shorter disease-free survival, and shorter event-free survival.

As used herein, "disease free survival (DFS)" means the period without any evidence of the original disease. "Shorter DFS" means, by comparison to the "good outcome" group, the duration of DFS is statistically significantly decreased.

As used herein, "event" means incomplete remission, relapse, or death during a first complete remission". "Event free survival (EFS)" means the period without any event. "Shorter EFS" means, by comparison to the "good outcome" group, the duration of EFS is statistically significantly decreased.

As used herein, "relapse" means that, at some point after the patient has achieved remission, AML recurs.

As used herein for all aspects and embodiments of the methods, an "alteration in copy number" means any increase or decrease in copy number of the genomic region or target relative to the copy number in a normal diploid human genome. It is understand that for most expressed genes in the human genome this normal number will be two.

Thus, the invention further provides methods for making a treatment decision for an AML patient, comprising carrying out the methods for classifying AML according to the different aspects and embodiments of the present invention, and then weighing the results in light of other known clinical and pathological risk factors, in determining a course of treatment for the AML patient.

In various preferred embodiments of the methods of the fifth aspect of the invention, the compositions are selected from the various aspects and embodiments of the compositions of the invention disclosed above. In a most preferred embodiment, the polynucleotides of the probe sets comprise a detectable label, as disclosed above, and in particular the different probe sets comprise distinguishable detectable labels, to facilitate analysis of which genomic region(s) is/are the site of the an altered copy number.

In a sixth aspect, the present invention provides methods for classifying AML comprising:
  (a) contacting a mRNA-derived nucleic acid sample obtained from a subject having AML with nucleic acid probes that, in total, selectively hybridize to two or more nucleic acid targets selected from the group consisting of SEQ ID NO:1-13 or complements thereof; wherein the contacting occurs under conditions to promote selective hybridization of the nucleic acid probes to the nucleic acid targets, or complements thereof, present in the nucleic acid sample;

(b) detecting formation of hybridization complexes between the nucleic acid probes to the nucleic acid targets, or complements thereof, wherein a number of such hybridization complexes provides a measure of gene expression of the one or more nucleic acids according to SEQ ID NO:1-13; and (c) correlating an alteration in gene expression (ie, an increase or decrease) of the one or more nucleic acids according to SEQ ID NO:1-13 relative to control with an AML classification. In a preferred embodiment, the classification comprises AML recurrence.

The method according to the sixth aspect of the invention detects alterations in gene expression of one or more of the markers according to SEQ ID NO:1-13 relative to a control with a modification in expression relative to control correlating with a classification of the AML as likely to recur.

In the sixth aspect of the invention the methods are used to detect gene expression alterations associated with AML. As used herein "associated with AML" means that an altered expression level of one or more of the markers can be used to classify a feature of the AML or the prognosis of a patient from whom the nucleic acid sample was taken.

Any control known in the art can be used in the methods of the invention. For example, the expression level of a gene known to be expressed at a relatively constant level in both AML and non-AML samples can be used for comparison. Alternatively, the expression level of the genes targeted by the probes can be analyzed in non-AML RNA samples equivalent to the test sample. Those of skill in the art will recognize that many such controls can be used in the methods of the invention.

In a preferred embodiment of this sixth aspect of the invention, the method further comprises identifying the AML patient as being of the normal karyotype subclass prior to or simultaneously with carrying out steps (a)-(c). As used herein, "normal karyotype subclass" means that the AML patient does not possess any of the genetic abnormalities often associated with AML, including t(8;21), t(15;17), inv (16), t(9;11), inv(3), −5/del(5q), t(6;9), −7/del(7q), t(9;22) or abnormalities involving 11q23. Thus, in this embodiment, the method is carried out simultaneously with or following a karyotype analysis for the AML patient that does not show any AML-correlated karyotype abnormalities. As used herein, "following" includes immediately following, or following at some future time.

In a further embodiment of any of the above embodiments, the method may further comprise determining the AML morphological subtype, as described above.

In the sixth aspect of the invention the methods are used to detect gene expression changes associated with AML. As used herein "associated with AML" means that an expression level of one or more of these marker genes can be used to provide a prognosis of an AML patient from whom the nucleic acid sample was taken, including the following:

(a) Patient prognosis in the absence of therapy (ie: chemotherapy or radiation therapy;

(b) Prognosis of patient response to treatment (chemotherapy, radiation therapy)

(c) Predicted optimal course of treatment for the patient;

(d) Prognosis for patient relapse after treatment, for example, by prognosis of minimal residual disease (such patients have high risk of relapse)

(e) Patient life expectancy.

In a further preferred embodiment, an alteration (ie: increase or decrease) in the expression level of the one or more nucleic acid targets is correlated with an increased risk of recurrence of AML. In a most preferred embodiment, a decrease in expression level of the one or more nucleic acid targets is correlated with a higher risk of poor outcome, as defined above. This decrease can be an absolute decrease in expression of the nucleic acid markers relative to control, or can be a decrease relative to those AML patients with a good prognosis.

Thus, the methods of this aspect of the invention provide information on, for example, AML patient prognosis in the presence or absence of chemotherapy, a predicted optimal course for treatment of the patient, and patient life expectancy.

Thus, the invention further provides methods for making a treatment decision for an AML patient, comprising carrying out the methods for classifying an AML according to the different aspects and embodiments of the present invention, and then weighing the results in light of other known clinical and pathological risk factors, in determining a course of treatment for the AML patient. For example, a patient that is shown by the methods of the invention to have an increased risk of poor outcome could be treated more aggressively with standard therapies, such as chemotherapy, radiation therapy, and/or bone marrow transplant The mRNA-derived nucleic acid sample used in the methods of the present invention can be mRNA or cDNA derived from the mRNA. The RNA sample used in the methods of the present invention can be from any source useful in providing a prognosis on an AML patient, including but not limited to peripheral blood, inflammatory sites, or bone marrow sample from a human AML patient, or in specific cells isolated from such specimens, such as granulocyte precursors, or monocyte precursors. The nucleic acid sample is preferably a cellular DNA or RNA sample, such as a sample prepared for in situ hybridization.

In various preferred embodiments of the methods of the sixth aspect of the invention, the nucleic acid probes are selected from the various aspects and embodiments of the compositions disclosed above, particularly the third aspect of the invention and preferred embodiments thereof In a most preferred embodiment, the polynucleotides of the probe sets comprise a detectable label, as disclosed above, and in particular the different probe sets comprise distinguishable detectable labels, to facilitate analysis of changes in marker gene expression.

In a most preferred embodiment of this aspect, the nucleic acid probes comprise or consist of single stranded anti-sense polynucleotides of the nucleic acid compositions of the invention. For example, in mRNA fluorescence in situ hybridization (FISH) (ie. FISH to detect messenger RNA), only an anti-sense probe strand hybridizes to the single stranded mRNA in the RNA sample, and in that embodiment, the "sense" strand oligonucleotide can be used as a negative control.

Alternatively, DNA probes can be used as probes, preferably those according to the compositions of the invention. In this embodiment, it is preferable to distinguish between hybridization to cytoplasmic RNA and hybridization to nuclear DNA. There are two major criteria for making this distinction: (1) copy number differences between the types of targets (hundreds to thousands of copies of RNA vs. two copies of DNA) which will normally create significant differences in signal intensities and (2) clear morphological distinction between the cytoplasm (where hybridization to RNA targets would occur) and the nucleus will make signal location unambiguous. Thus, when using double stranded DNA probes, it is preferred that the method further comprises distinguishing the cytoplasm and nucleus in cells being analyzed within the bodily fluid sample. Such distinguishing can be accomplished by any means known in the art, such as by using a nuclear stain such as Hoechst 33342, or DAPI which delineate the nuclear DNA in the cells being analyzed. In this embodiment, it is preferred that the nuclear stain is distinguishable from the detectable probes. It is further preferred that the nuclear membrane be maintained, i.e., that all the Hoechst or DAPI stain be maintained in the visible structure of the nucleus.

Any conditions, including hybridization reagents and wash conditions to remove unbound probe, in which the nucleic acid probes bind selectively to the target in the nucleic acid sample in the nucleic acid sample to form a hybridization complex, and minimally or not at all to other sequences, can be used in the methods of the present invention, as discussed above. Further optional steps can include, but are not limited to, pre-hybridization of the nucleic acid sample and use of competitor nucleic acids. For example, such hybridization conditions may include (1) fixation of tissue, biological structure, or nucleic acid sample to be analyzed; (2) pre-hybridization treatment of the tissue, biological structure, or nucleic acid sample to increase accessibility of the nucleic acid sample (within the tissue or biological structure in those embodiments), and to reduce nonspecific binding; (3) hybridization of the probe to the nucleic acid sample; (4) post-hybridization washes to remove probe not bound in the hybridization and (5) detection of the hybridized nucleic acid fragments.

Any method for detecting formation of hybridization complexes and determining an alteration in marker gene expression can be used (including quantitative or semi-quantitative methods), including but not limited to in situ hybridization (such as fluorescent in situ hybridization (FISH)), polymerase chain reaction (PCR) analysis, reverse transcription polymerase chain reaction (RT-PCR) analysis, Real Time PCR, Taq Man PCR, Southern blotting, Northern blotting, array-based methods, and/or comparative genomic hybridization.

In a preferred embodiment, detection is performed by in situ hybridization ("ISH"). In situ hybridization assays are well known to those of skill in the art. Generally, in situ hybridization comprises the following major steps (see, for example, U.S. Pat. No. 6,664,057): (1) fixation of tissue, biological structure, or nucleic acid sample to be analyzed; (2) pre-hybridization treatment of the tissue, biological structure, or nucleic acid sample to increase accessibility of the nucleic acid sample (within the tissue or biological structure in those embodiments), and to reduce nonspecific binding; (3) hybridization of the probe to the nucleic acid sample; (4) post-hybridization washes to remove probe not bound in the hybridization and (5) detection of the hybridized nucleic acid fragments. The reagent used in each of these steps and their conditions for use varies depending on the particular application. In a particularly preferred embodiment, ISH is conducted according to methods disclosed in U.S. Pat. Nos. 5,750,340 and/or 6,022,689, incorporated by reference herein in their entirety.

In a typical in situ hybridization assay, cells are fixed to a solid support, typically a glass slide. The cells are typically denatured with heat or alkali and then contacted with a hybridization solution to permit annealing of labeled probes specific to the target nucleic acid sequence. The polynucleotides of the invention are typically labeled, as discussed above. In some applications it is necessary to block the hybridization capacity of repetitive sequences. In this case, human genomic DNA or Cot-1 DNA is used to block non-specific hybridization.

In a further embodiment, an array-based format can be used in which the polynucleotides of the invention can be arrayed on a surface and the human nucleic sample is hybridized to the polynucleotides on the surface. In this type of format, large number of different hybridization reactions can be run essentially "in parallel." This provides rapid, essentially simultaneous, evaluation of a large number of nucleic acid probes. Methods of performing hybridization reactions in array based formats are also described in, for example, Pastinen (1997) Genome Res. 7:606-614; (1997) Jackson (1996) Nature Biotechnology 14:1685; Chee (1995) Science 274:610; WO 96/17958. Methods for immobilizing the polynucleotides on the surface and derivatizing the surface are known in the art; see, for example, U.S. Pat. No. 6,664,057, and are also described above.

In each of the above aspects and embodiments, detection of hybridization is typically accomplished through the use of a detectable label on the nucleic acid probes, such as those described above. The label can be directly incorporated into the polynucleotide, or it can be attached to a molecule which hybridizes or binds to the polynucleotide. The labels may be coupled to the probes in a variety of means known to those of skill in the art, as described above. In a preferred embodiment, the detectable labels on the different probe sets of the compositions of the invention are distinguishable from each other, as discussed above. The label can be detectable can be by any techniques, including but not limited to spectroscopic, photochemical, biochemical, immunochemical, physical or chemical techniques, as discussed above.

In a further aspect, the present invention provides kits for use in the methods of the invention, comprising the compositions of the invention and instructions for their use. In a preferred embodiment, the probe sets are labeled, preferably so as to distinguish different probe sets, as disclosed above. In a further preferred embodiment, the probe sets are provided in solution, most preferably in a hybridization buffer to be used in the methods of the invention. In a further embodiment, the probe sets are provided on a solid support, such as those described above. In further embodiments, the kit also comprises wash solutions and/or pre-hybridization solutions.

EXAMPLES

Gene Expression Prognosis Markers for Normal Karyotype Adult AML Patients.

Certain chromosomal abnormalities are routinely used to determine prognosis in adult AML patients. However a significant proportion of these patients do not exhibit such abnormalities. These patients are termed the normal karyotype subset of AML patients. A gene expression signature indicative of prognosis in these patients would likely be of great clinical utility for these patients. We have identified and validated several two-gene and three-gene signatures correlating with prognosis in a publicly available gene expression dataset (See FIG. 2).

Source of gene expression data: NCBI Gene Expression Omnibus (GEO) GSE425

Supporting paper: Bullinger L, Dohner K, Bair E, Frohling S, Schlenk R F, Tibshirani R, Dohner H, Pollack J R. Use of gene-expression profiling to identify prognostic subclasses in adult acute myeloid leukemia. N Engl J Med. 2004 Apr 15;350(16):1605-16.

The gene expression data consists of 6285 gene expression measurements for each of 45 peripheral blood and bone marrow samples collected from patients with normal karyotype as determined from standard cytogenetic testing. In this group, 31 patients who had died (mean time to death 277 days) from their disease were defined as having a poor outcome, and 14 patients who were alive at last available follow-up (mean follow-up 540 days) were defined as having a good outcome.

Approximately 75% of the samples were randomly selected for marker discovery, and the remaining 25% was used for testing the discovered markers.

Prognostic two and three gene combinations were sought using a proprietary technique that could distinguish the good and poor prognosis patients. 191 three gene combinations were identified. The statistical significance of these combinations was computed using a label permutation technique, and 42 of these were found to be significant at p=0.05. The independent test set classification results are presented in FIG. 2; thirteen genes are represented in the 42 prognostic combinations. Each of rows 4-45 reports the results for one particular 3 gene marker using the genes (clones) in the first three columns. The columns are divided into three groups: training results, bootstrap results, and results on 'blinded' withheld test data.

The training results are the results of finding a marker within the training data, and then determining the accuracy of the marker within that same data.

The bootstrap results are actually training results as well, but computed using a much more computationally expensive approach to marker accuracy estimation.

The test results are computed by applying the marker found using only the training data to the withheld test data.

Each of these three results are reported as: # of poor outcome samples misclassified, total poor outcome samples, # good outcome samples misclassified, total # good outcome samples. There are a total of 45 samples represented in the data. Looking at the training data and test data results: 45 samples=23 poor outcome training samples+10 good outcome training samples+8 poor outcome test samples+4 good outcome test samples.

The bootstrap approach repeatedly uses the training samples in the estimation process. The reported numbers are cumulative, and thus the total good (poor) samples are much larger than the actual number, and since these are the same training samples, these numbers don't appear in the sum above.

Top three-gene marker: pIGF2AP, TNC, SFRP1

Training Set:

| Prognosis | Alive | Dead |
|---|---|---|
| Good | 10 | 7 |
| Poor | 0 | 16 |

Bootstrap:

| Prognosis | Alive | Dead |
|---|---|---|
| Good | 351 | 303 |
| Poor | 55 | 691 |

Test Set:

| Prognosis | Alive | Dead |
|---|---|---|
| Good | 4 | 0 |
| Poor | 0 | 8 |

Training set accuracy: 79%

Bootstrap accuracy: 74%

Test set accuracy: 100%

SEQUENCE LISTING (41 sequences)

SEQ ID NO: 1 - DNA, 8850 bp, Homo sapiens
ggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtc

SEQ ID NO: 2 - DNA, 3425 bp, Homo sapiens
agacttccctctagaatcctccaacatggagcctcttgcagcttacccgctaaaatgttccgggcccagagcaaagcttttatgcctttgaagtgaaggatgcaaaaggaagaactgtttctctggaaaagtataaaggcaaagtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctacatttagatttcttgttgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcataaaaaagaaagaggatctatgagaatgccattgcgtttctaatagaacagagaagtgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcattttcagtatttctctctgcattattttttagaagcaactcaaattctgtaatcataatattaccaagtaagtcagtctttatttttgcgtgaaaatcccaagtgtagaaaaaaggacatgagtataagatcatttaacttgattccttataggctgatttgggttgctaatgtattcgtactagattagccacttgggaggaattcaatgctgcatcattctgatagctgaaatagtaaaagtcaactccaaacagcctaaattctagtataaaaagggggtgatcatacaagtcctaaagtgtagatcagcagtcactgaacctcttagagtcacaaggcatttcttctcccaaagtcatgacctttatattttgttagccttataattgactaacaaagcaacctgccaagttggtgaaggttaattattgcctcatgaaatatacattcatcgcataaaagaattaaataggaagatggccaaaaatgtaaaaaagtcgtataaatttgtctaagaagaaaaagacccaatttaagtagtctgtgacttgactcccaaattctgacctgatggatgaaagtgaagatgtttcgtatggcaaattcagtaatgctacctcagtatatagttctgtatacgtatttggaccaaagttattagataaaccaaaaatatttcatgaagcatcttctgcttcagagtccatatccagccacccagctatgaatgtatttagaaagatatttggtggaggtggaatttctaccagaggtcaagaggatttgtagggatagcctcaagaatgccagatgagtgtgtcagaaagcctgctcctacctctcgccagctgcgtgactttaggcaagtcacttaagtaccttatttcagtttcctcacctgtaaattgaacaggggttgaatggaataaaaagccctttgcaactctaaaagtcaattaacacacttactaaggtgttttaagtgaccaggaaggaaatcaaaactaacctggattgttagcgaagaaaacagaagccaccaacaagcctatctgtcctttgcaattttgctccaagagcctattagcaatttgaattctgagcctctaagaaaacttatgctcaggtggcccctccaagtgttggtgccagagcactcttgccttgtatcctcacctacgccttccatgaactcatagcagtgctgtggcactgcaggggtgttttatgcattcacgttaggagcatgagcagaactgcatatgccagcaccacatgggcagcagagactccccactgccagatggatgataatggagctgcactgggaacaaccaggactgtcccagtcaacatgatacagatgaacatcctgccttaagtcactagctctctccaaagccagataaagtgggtttcttcacttacatctctctaatcttggctgccttattcaacccacagactctatgtcagtgctggattttctccccttgccctttaggtaagcagagtaggcaggaggagatttgaaagcgtgtcatacatattgccttgaaagaaaggacattcaggtgtcccttcggggttctgtaacaattaggctatgtgtgctgagagagggagcggagtcatttgctgatgtgctgctacctgtaactcaaatgcctcataggaataccagcggacaaacacatagaggaaaagttgaatctttcctatattggacaatcttccttcagtcttgtttctgcatcaaaaagtctgggacacagagtgctacaggatgcctgggctaaggactgtaacagaaaaatatcaacatcagagcctggcacagtggctcacaccggtaatcccagcactttgggaggccgaggcgggtggatcacttcaggtcaggagttcgagaccatcctggccaacatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagaaaaaaaagaaaaaaaaaaaaa

SEQ ID NO: 3 - DNA, 5489 bp, Homo sapiens
ggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggcccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacagggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 4 - DNA, 5532 bp, Homo sapiens
gccgcgctgcgccggagtcccgagctagccccggcgccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaagcttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcaactcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatgaattcttccttagacttacttttgtaaaaatgtccccacggtacttactccccactgatggaccagtggtttccagtcatgagcgttagactgacttgtttgtcttccattccattgttttgaaactcagtatgccgcccctgtcttgctgtcatgaaatcagcaagagaggatgacacatcaaataataactcggattccagcccacattggattcatcagcatttggaccaatagcccacagctgagaatgtggaatacctaaggataacaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtgaattcaggtagtaaatatgaaactagggtttgaaattgataatgctttcacaacatttgcagatgttttagaaggaaaaaagttccttcctaaaataatttctctacaattggaagattggaagattcagctagttaggagcccattttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttcc

SEQ ID NO: 5 - DNA, 9940 bp, Homo sapiens
agtatttctctcgcgagaaaccgctgcgcggacgatacttgaagaggtggggaaaggagggggctgcgggagccgcggcagagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaacgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatactctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagaaaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtaygggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttckgtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaaaaaaaaaaaaa

SEQ ID NO: 6 - DNA, 2159 bp, Homo sapiens
gttgtgtgtgtatgccgtgcgtttgtgtgctgtgtgtgcatgtgtgtgcgtgtgtgtgctgtgcgtttgtgtgtgtgctgtgtgctcatctgtgtgctgtgtgtgctgtgcgtttgtgtgtgtgctgtatgctcgtgtgtgtgctgtgctcgtgtgtgtgctgtgttcatgcgtgtgctgtgtgttgtgtgtgtgtagctgcggggatgcataaagtatgagtgctttttaggatgggaattgagatgtaagatttgggggtgagggtcgtgccaattacatttcatttgcatggattttggttttcatgctctgtcctcccctcctttggtcttactgggtccctctgactgctctgtgatttttagtgatggaaaagggagtgaggagccagtctgggttgttgctattttcggatggccagtttaccctgaaaattcccgtgagaagggagatggcggtagcagcgacgtgcccacctgtgatttctggggcccttcttttctctttgctggttcagggactcaagtccaggccaatttgactcaaagtccaagggagaagagaaagaggggggtggggagtgccaaattcctttattttgccaattgtttctcagccaattcgtttttaatactttttttttttagccaattgattttttttggtggttgttttttttaaagccaatttctgagcttttgtggggtgtttctaaaaagccaattagttttaagagggttgttgtgggggggggggggaagggggttagtttaatgttttgattttttatgtgtggggataattggggataatttggggggagggtatgtgaagggtgtttaaagccaatcgattttgtacatgtttgaagatgctgctgtgcttcctcagcccgatggagggggccgaggagagtagcctgtttcggggaggcggggcacggggactgggtcaggagaagccccagggggacgtggaaccgagagattttcgggatggaacctgatggaaacgtccgtggtcaggaggaggctgcaggatggtggcgccgggctgcagacttgcggcagttttgctcacttccgattgctggccatctctgggggggcgcccccgtgggcggggtcctgggtgggtagagcaatcaggggacggtgacgtttggcctccctgaacgcctcgagctccttggcgagcacgtgaccccggcgggcacgcaggagggcaggcaggcccctgcgcaggcgctgggtggactgcttccaggtgtcatattggaagaacttgcccacggggtatctggggaagttgtccggaagcacggtcggaggggtcgacacgtccctctcggacttggcgggggtagcacagtacgtctccaggagggccaggtcacagctgcggaaacagcactcctcaacgatgccacggctgcgacggctcacacggcttgcgggcctgctgaagtagaagccgcggtccccacagacgaactggagggtgtccaccagctccccgccgcacagggtctcactggggcggtaagcagcaatgcagcacgaggcgaaggccaagaaggtgagaagcaccagcatcgacttccccattgggattcccattggtgtctggaagccggcgacgctgccgcccacctccctgctgcgtgtcgcaaaccgaacagcgggcgttggccctcctgccggacactcctctgccagcgccgctctggccgagtcgcgggggccgaatgtgcgacggggcagagcggggggatggcttttttttggggggggggggagaattcgtctgattgtccagggaggacgggctgtcttcgggctggggcgggccagatgttgtacttttcgggggggaaaaggtatcgggaaatgaggtcagctgttgtatcaaggatagaggggggcagagatagtgggagagacagagtgaacgtgaaaggggggggccgaagagagggcgagggggagagatgaaaaacaaaatccaatcagggcgataaatggcggggggcaggacgtggtggtctccaggctggcttcgtgcgttcttgcttttgtcactgcccccctgttacatggggggggggtttaatttggtttctgagcgcataaagctaaggaggggtaaaaaaaaac

SEQ ID NO: 7 - DNA, 3159 bp, Homo sapiens
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagataacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagaaaaaaaaaaaaaaa

SEQ ID NO: 8 - DNA, 3089 bp, Homo sapiens
gaaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctagctgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttatttcagctacaaaaacacaggttgcagatagccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatg

SEQ ID NO: 9 - DNA, 3049 bp, Homo sapiens
agccccggcgcctataaatcgcattccctcccgcgcccccctttttagcatatttgatcactttgattctctgttcttttctctccgcggtgtgtgtgtgcgtgcgcgcgtgtgtgttttcttcttctcctcctcctctccccgagttgcctcctttctccgggtgccgtactgccttttttcccctctttcattctttctctccgtctttttctcccccctctgcgcacgaaggatgtgcttctaggtggtgatctgccctcctctctctcttttatcatttctcccccgccgccggcgagttgactctttccctatgtgtgtgaggcggcggcggcagcagcagcagcagcggctccggcggcggcagcagcggcagcagcgacttcagcggcggcggcggcgctagacgcagcggctccgggcccgacccggcggcttcggggcgccctcccgcgccctcttgcaccctcgcacacacaaaaggcggcgcgccggagcccgagacccggggagccgccgccgccccgccgccgcccgcagccaggggagcaggaagtccggacgcagcccccatagatatggcaatggtagtcagcacgtggcgcgacccccaggacgaggtgcccggctcacagggcagccaggcctcgcaggcgccgcccgtgcccggcccgccgcccggcgccccgcacacgccacagacgcccggccaagggggcccagccagcacgccagcccagacggcggccggtggccagggcggccctggcggcccgggtagcgacaagcagcagcagcagcaacacatcgagtgcgtggtgtgcggagacaagtcgagcggcaagcactacggccagttcacgtgcgagggctgcaagagcttcttcaagcgcagcgtgcggaggaacctgagctacacgtgccgcgccaaccggaactgtcccatcgaccagcaccatcgcaaccagtgccagtactgccgcctcaaaaagtgcctcaaagtgggcatgagacgggaagcggtgcagaggggcaggatgccgccgacccagccgacccacgggcagttcgcgctgaccaacggggatcccctcaactgccactcgtacctgtccggatatatttccctgctgttgcgcgcggagccctatcccacgtcgcgcttcggcagccaatgcatgcagcccaacaacatcatgggtatcgagaacatttgcgaactggccgcgaggatgctcttcagcgccgtcgagtgggcccggaacatccccttcttccccgacctgcagatcacggaccaggtggccctgcttcgcctcacctggagcgagctgtttgtgttgaatgcggcgcagtgctccatgcccctccacgtcgccccgctcctggccgccgccggcctgcatgcttcgcccatgtccgccgaccgggtggtcgcctttatggaccacatacggatcttccaagagcaagtggagaagctcaaggcgctgcacgttgactcagccgagtacagctgcctcaaggccatagtcctgttcacctcagatgcctgtggtctctctgatgtagcccatgtggaaagcttgcaggaaaagtctcagtgtgctttggaagaatacgttaggagccagtaccccaaccagccgacgagattcggaaagcttttgcttcgcctcccttccctccgcaccgtctcctcctcagtcatagagcaattgtttttcgtccgtttggtaggtaaaacccccatcgaaaccctcatccgggatatgttactgtccggcagcagttttaactggccgtatatggcaattcaataaataaataaaataagaagggggagtgaaacagagaaagaaaaggcaaaagactggtttgtttgcttaatttccttctgttaagaaaggatataaaaggatgttacaagtttgctaaaagaagagaggggaagaatttaatggactgtgaatttcaaaaaaaaaaaaaagactgtcaaatgaacttttacagaatgcattaaaaaaaaaaaaactcctgtgtcggtcagaacaacttgctacttatcatttttgtataaaaaggaaattagtctttttctttttttggtaaatttttgaaaaatattgctaaaagtgcatttaaggagattgggagacaattagcagaatggagaaagtaagtcttttttttttccaaattattaattgtcctgtgtctatgtacctctagctgttcttttttgtacttttctggttccaaaccagtttattctgtggttctataataagttttgatataatcttggcttcttaaaaactgtgtatcattaaaatatatgttctgcaagaattaaaactgagtccatgaaaataccataggaagacataaaactttaaaaggcaactcaaagatgatggaaacgcacttacaagtggtgaccaaaatttttaggtgaagtcgagcactctaattagagaactggaggaaccacatataacacttaacttcccctaccctgcccctccccaaaagaaaccatgacaaacctagcttttaaaaaatattttaagaaagagaatgaactgtggaatttattggcagccaaggaatgtgtccaagacacatgctgaggttttgaataaaaagtgaacttttgtaatttgaattgggtcccgcttagttcttgaattgttatgaaaatcctatatctgtttgtatatttgcaaaccctttgtattataattgttgatattttccctttttaaaaaataccattgaaatcagcatgacaaaaataacactgttggcacttataggtaacgtgattgattcagtatcttagagtttacagtttgtgttttaaaaaaactgaaggtttttcttttaagtgcaacatttctgtatactgtaaaagttataataactgaactgtttggtcgagtctttgtgtgttatattccaaggaaaattgaaagtattcagaaattaaaatattatttgatatctgaaaaaaaaaaaaaaaaaaaaaaaaaaaaaaaaaaaa

SEQ ID NO: 10 - DNA, 1101 bp, Homo sapiens
ctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaaaaaaaaaaaaaaaaaa

SEQ ID NO: 11 - DNA, 769 bp, Homo sapiens
ctcgggcgcccgcggcgatgttcaaccgcgccgtgagccggctgagcaggaagcggccgccgtcagacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggaccgtgccgggtttatcattgctttgttatttgtaaggactgaaatgtacaaaacccttcaatgggatgtgtgttttattaactgcttcaccagtaaattttgcatgatggctaagctaacataaaaaaagaaaaaaaaaaaaaaaaaaaa

SEQ ID NO: 12 - DNA, 4482 bp, Homo sapiens
agcgggggcactccagccctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacatttaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttacgattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttaaaaagcaaaacatctctgcagtttttcccaagtgccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgagcagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaaaaaaaaaaaaaaaa

SEQ ID NO: 13 - DNA, 7560 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgaatccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtttggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcggctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattggagggaccactgggtgagagaggaataaggcggcccagagcgaggaaaggattttaccaaagcatcaatacaaccagcccaaccatcggtccacacctgggcatttggtgagaatcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgaaaaaaaaccggaattc

SEQ ID NO: 14 - DNA, 174951 bp, Artificial Sequence
  Synthetic BAC sequence
agacctgttggtttataggacgccaacacttgtcctgaagcagcgttgtggatttggtggtggagttaggcggtacgtatcacagattgcagggctctgggagacttttgctaaggaggttagttagaatttggtggtgtacatgtgtaattagatgcctaagtatgtctcaggaaatcatgaagcttaggtccagtgataaaatagtagaatttaattttgaggcacgtgtgccagagcttatttacccaaacaaatgtaattctctttgaagtattaacttggaaagactgtgctttgtgatatttccattcttcagacctttttaaggaaactttatgggagcaagtgctttcccagcttgcaaaatacggctttgaatgcattcagcagaccattcttgagcattgaactccccttaatatgggcagagaagtatggcttttccctagcggtggtccctgggacctagcatgggttcaccaagaacgagccaccccaggctagcttcgcttctttctctgaaaaccttattaagcagaaaactatagtttatacaatgcataaatgagacctttgatctgctttttaattttatctactgtgttgaaaacagagacatagtctgagctgaatgcaagaactatggtctgaactgccccttagttaatacctaagagtgacaaacatgtgttgtaatgggagatcagtactatgtgatttttgttgactgtgcgatcacagtaagtttgtgatgtggcttctgcagaagcgagtgttacctcggagtgtgcagatagaggaggatgcataccatgttagaacacacttggagccaggggttctgttttccttccttcgctccctgcctctctccactatactgtatgccaggtacctttctatgtgttgggatgcaaaggtggacaaaagaaagcccctttagagagaacgtaaaaactagggtttcttcagagggcagcaccccagatgataaagagaagaaaccacatgtcacacaaaatcattcaaaggatggggtggatgtgggagtggtagtatttgccctgacttagaaaagactctgcagagacatgggtgaagaagcagcacatttgtccagtagactctagttataatcttaaaaggcagtcacattttggctcaattataaaaaagatattcttcacagtcctgcaaaggtggactgggcttctgctttaggatatagcgagaagtattgaagcagggatcaaaagaccatttggtggcttactgtgaaggtcaacaatataatgaatctcctttaaaatttccagtcatgaaaattgtataagtgagcaggcatgtcatctgcctgcaagacacatgctagtaatgaaggaagatgtatatcacaatgaacatgcctgctttatattgtttatttatttctttgggggcagctgaatatgatcaatttagagatgttagaacatttgtaactatagtttgtgagatgggcaattttaactgcaggaagtcttcagaatcacagcacaggttcaattcactgtggttgttatgtcataattatatattgtggatgtctaattccttttcaaacctagaagtaaagatcatgtaacatatcctagccaatattaaagcaatattattataaaaatgatctctgatgtagaaccactagaattagggccttaggtctacccatattgagtttgccctttttatttgcaaaatgcttgatcccagattgctatgagagatagacataatagtgatctttctgcttttgatagttaggtatcatagttttaagacagcccatggagttttagaaattgtgtctgtgtctacagaatcatgtgtgtgattagataaagattagtaggtacagaaactagctgaagcattgattgatacaccttgtaccttccaaagaattgatctgtttaaatcaagttagttttacagctccgtttgttgcttctctagattgattaggtggttttatgatgtttcttttatttttttcactaggaattttgctgagtatttttaatacctgaattgacagactggtttatcggtgttgggggtctgtgtgagcttctcattagtccatttacaatggcagcactttcatgtttaaatgtagacaaacctgtccctaatatttatggagcctgaggcaaagagtgtcagtggaagctcatgtactctatgttgaaatatttaaaggaaaattcgagttaatacactgttaaataacattttctcacctcctactttgacaaatttactttaataataacttggaacccaggttcaaatttagaggcctgcccccttctcttcccactccagctgtatgttgtaacatgttcatatggatgctgcagattgcacaagcaaaccttcttctccttcctcctgctaacagctgttcccaggccactccttgcagtgaagcatactcacacctgtgacacaatctgcccttttgagaacagattcagggaagtggcctacacagaccttggaagtggaaaagggttattggcttgagagttccaaagtcttgggtccttggtcgatggtctaaaaggtgagggtgttaggtgaagtgtcctcttgatcctcaaaggctcctcaccctgggaggaggaggaagatggccagaagaagaccagagcaagaccctctaaagtctagggcccaagttgggccctctggccgaggtctaaggactgtacagaatatggataaaagcatgactaacttccaactgcctttcatacttcagagcttgaaaccgagtagtttcaaccaagtagttgggttggcctaagtagctttgccatttaacctcgtaaatgatctaaacatcaacatagtctgagagttgaataaaaaataagtgaagtagttgttcattgtcaggtcaggtttgaattctctcatacttgaaatccctgcaactgtgaaattgcctgtaggaattgcaggttgtgctaaacaatcaaacgaattggtaggttggctcccataggcaaaatcttgaggctgtttggggcaaaaaaaattacaaaatataactagtaataagtgggatgcaataagaatcaaatgtgatccaattttctggggaagcaaattgcattgcactttgttttattttaaaaaatgatgtgaaaatacagagcatcacagcacagacaaatatcttacaccagttttcacaataaaatccccaaatgtgaaagctctccctttttgcaaaggcactttggaagcaataatgtttgtgtgcatagttgagtttatcagagtatactgattttttatcccatgaggttttcaaggaaagtgcagctggtcaacctttagtgttttctttgccacagggtatagttctgtttctgtccgctcaaatacagtctttcaggaaacgaattctctgtaggataccttaaaatgtctttgtgttgtaacacagggtagggggcagtatgtttaataggttagtgtggatacgtgggtcctgaaatcacagtcctgctttttgctcctggctctgccacttctagttacttgtgtaaccttgagcaagttacttaaccttctctaagtttcagttttctcatcagtaaagtgggttgaataatagtgcctttgttaaaaggtaggtatgaggattgaaaagtataggtaaaggggttagcacatagttaacattcaataaatgcaaactattaatcactattagctcacttgtgtaaggaaggcctatgggtttatagaaaggtaacattttgtggtaagagaacctctccaggggaacctctgtaaactccagagggctgcacggaaaattccactgtggatgatgggccttctcccggagtttacctgttaaggtgaagtaggtcgtgctttgaagtgcttggcagtggccagacctggacaggtactgagagttgcactgggtgctgtggttgctgtgtccccgccttccatcctaggtagcagatggtagtccttactcatctctgaagagtcctaagtagcccgagtcctagatgtaatttgttgcttatccgcaaagtggttttgaaggatatggtttttcttctttgggtatgaaacataagaggatgaaggaaaaatgagaagttttgtttctaaatgaatatagtacacagcctcagaaaatatggggaaaagatgagaaggaaaattatttttatttctaaatgcactattcatttcattttccaagtaacttgtggctatcattatttttagtgatttatgcttaaatagtcttccttgggaataatcaaatactggcttcaaatatagacagggaaattataggtcatagtaggctcataaaataacgcttagaatgaacttgggatgggacgtggaacagggcagcagactttccaccaggcgccattcctgtgttctcagctctacccttgagccttctctagtggggccccaaatgcaccaccatgatgtaagggtctgaccaactacttagtttctagcagcccagagtgaaggcacctctctgtgccttcctcttcgctaagcctcagtttttttgtttttgtttttttcccttgcaaaaattgagacagtagtgtccaatttgcagagggtctctgagaatgaaatcagaggcacgtagcaactgcctggacagtgccagcactccacctgccacccctccccactgccctctatttgtggagaggtggatgattttgctagtcacaaagcctgtcttctttgagacagtagggaaaaagcaaccactgtgattcacagaatttcctgaataggcacagctgcaatttctctgcctttactcatcaccataaacatactttaaagttgtcagttatgttttctttctcatttttggtgttgaaaaaaattaacctttgagtttcagtttccttttctgtaaaatggggagaagaatagctcccattccataaggtggctgtgagaatgtgagaatacaggtgacaggctgcataattctcgcaaaatgctgttggagtccctagaaggggaggaggggagctgtgaaatccggtttggaattgggaattttcatcctgagcttgtgttaaggaaaggaatgaggcccatcccaaagtagaaaccaaaaacgttcttactgaatatggcacaagcactggttttctttcctaatgagtgtggtcattattagagttaagcctttccctgcatggcaagtgtgaacatgtctgcagaccctgaggacaccagagcggcaggctttgaagggagagcagtggacactcagtgacggggccactcacagtctagctctgaccccaccagatcctgtaggttcctggttcttgttcctggtgaattcctgactatcacctttacacagtgatagagcctttatttccactctgcatggaggcatattgcatttgaaagattgaaacccattgctgtccccattgacagggagcatgttaagggtaagatgctgcatttcactcattgctgggcccccatttctgaatctggacttgtgtcttgtaggcattcaagaagtagcagttggaagaatgtcactgatggaattgatgtctctgtgtacacacccccagatcaaagaccatgcttcttggtctagccataggaactctccacccttgagactcagccaggacgtggggcccagcctttctttacctccctggtagtgccctttttagagataggcataaaatgacagtgctgcccctcaagtctaaaggagggggcaaaacgtagcgtcctgtgcttcaccactgggggctggctgggccactgttaaggtctgtggagacttctgtttgcaggagaggttgatgaaaacccttggctttagctgtggccagaggatccaggctttaccttgtatgctccgagccctgtgcctggcaagtctgccacatggttatggaaatgttcctgaggcatgaaggaggcctttctggaccagccgatggggagtgggtgaggaggtgtggaggaggaaagaaagaaaactctttccccattcttttttttttttttttttttttttgagatggagcctccctctgtcgtccaggctgtagtgcagttgtgcaatcttagctcactgcaagctccacctcctgggttcaagcagttctcctgactcagccttccgagtagttgggactataggcgcacaccaccacgcctggctaatttttgtatatttagtagagacagggtttcaccatgttggtcaggctagtcttgaactcttgacctcgtgatccgcccacctcaacctcccaaagtgctgggattaaaggcttgagccactgcgcccttcctctttccccattcttaagtacctagtaacaggtctgagctgtttagaggtgtaagggagcttgcgaagttgggaagtgtccggatgtatggacgctggagcattttccccatgagggtctaagcctgggaaaatggccagattctactcagagacattctcccattttcttaaactaggggtgtgctgggagaactctgggctccttgcccacaggacagccgagaagcttttgtcttcccctctcttgctgagacacatcctccctctgaacttcccaccttagtcttcggagtcgttttagactcgagattgctagtgacttgaaggttctggtctttctgctatgattgggatctgtgctgcacccctgggtctggcagtgtccccagcagtgggatgctgcccagcagtaggtctttcatgctgacgagcacagtggctgatgtcattgtgggggagttccttctgtggccatagaggtcttggtctttaacgctatatctcctcctccctggccctgaaataaattcctttgggctgctaactctccttcctttagtggctgctgttagttaatagtccttttcctagactggtgagatggttgctttcatctcagcctgtgaggctgggagtcatttggatggaggtggccagaagctacttgaatgctccacggctatagaggacattcagcatccattctgtttttcttaccaaatgcatagaggccagccctctcactggctcattgtatgattcaggtgggatgacgtcccttgcaactctggaagtagaccgtgattgatataagcctaaaacagctatgtccacggcgattgattgagggatggtgcctgaccagtcacatccagtgagatagaggagatatctttctggggctgctgggaaagtaaagctttctttcgctgaagctttcagaagagaatcacacatcctgtggatggtgtagggtgaggacatgagttctatatgggagcagttttctttcataagaatcccacacatgtgcaggactggttactggttggaaccactaagtaacctattgggaggcagattggtaatgatgccatctaagctgttggaacaagacttcttagttaaataagccactaagccccctccattgcttaaaagccagtttgatcattgtttcttagaacatagtgacctgatatgcagaccttcctcttgtgaatttgttgaggacttttcctacaaggtcttctccaaggtctgtgtgagggttcggcattagcatctgggaagccagggatcctcatgctaaggcagaacaaaaacaggagtcagggctggagaggggcgtctgtggtctctggggcaaggcagcttgaggtgggacccagaagtccagggaatcagagaggaacagtgggttggagtagatctgtgggttggaataggtctgtgagaggtcttaggggagtggtcttgcccacagtggagtggccccgaatccactgaggatcccgggatgggggtgcaggccttcggttatcatagactgtatatgtgtatctgggtgggggtgggggtgggggtagggtggtgtgtctaagttctttcatgtctggggtggtgttgtagatcgaacttctcccaaacaggctcagccacaccggtaggacgtagtctcttcctgttttgctttatgatgttcctgtctcttaagctgaaaagagcccctgaaagccactatttagttgcctatactgacacacacctgcgattggatggatcgtctcacacagagagttatgcaccattcatagctaacctcagggccggggtggtgctcagaaacactgtctttatgatatacatgggcttttgagctcgtggcttgtggttgtggactgagaaaattgcttcctgggtttatagagatggtaggggaaatgaccctcttgccaccacttattcagtgatggcttcctggtgtgatgcttggggatggatgtgactgaaaggatttcaggagttaattggaagagtacatcatagcatgcatgattgatccctatgtggtattatcattattagaatcccaaaaaggtgatggttaaaagagtacttaactatttgctggtcactggagagatggaaacactgaacatgtttgtccttatcctgcaagagctcagagcctaatatggacagcagatctgtaataaatattgtaggggatggtagagggacagattcacattgacacaaatttttaaaaagtaaatatttaaaagtaaactttttccctccagaatattactggtattcatcttcttccagatagaatatctaatataaaacctatgaaatttatcaagagaaggcttaatacaggagatgctggaagcgcatagattttcctcaaatccctcttggtacatgtgaatccactacatccagaatcaggccatgcatcttcaccaaatcattccctttggggaagtcgtggctcagtgctcttctggttcaggaacactgagccagagtaaatcacccctaatggtcctctctgcagccagtgagatttctaatacagcaagaattcaatagaacaatacctttctaaggtactagctagactgttaagaggggctaatgtggtagcagcctcctggcacaaaggcaagggtctgtggttagtgactgtcgtgtctgtctgagcagggagaatgtccgtgagcagaatagctggtgtccagatgctcctagtgaacttttatcagtgagcagacgtggcctgggagggcaagccagacagtccagccggcttggagctggaagggaggagttcagtcttaggtcaagatactgtgctgagggaggtggagctgtagaggcagtgggcaaactgggggctccctgggagccctggaagcagcttccaccactttggatatttggcaattggaggtggaaggatgccagggaaggtgtttgggtttcttttctctgtgaagttatggcagtgccatcttccaatcagccatcaagagagccacctttaagagtgcctcaagtgagccaaattaggggatcgccgggacagaaaagctgctgaggtgggatgagcactgtggatcatcttctgcccttctggaagtctttgtgggctggacatcccaaatgtgggcctgggaaaataacatttcccatacttcatgtgtgtatgtttcattttttacagtggtgcttttgataagcagtgtaacatcaaagccaagaactgtgctttccatttctggaaatatgaggagcccagaggcttctctttgagataagagctgtgtgactgtgtgagctacttaatttctccaaacttcagtgtgcaccttctttgcagggctgtataaggattcattgagatgctaaccatgacacacttggctcacagtgggtacttagtccttgtcagctttcctgcccgtctgcaggggtggcagtggtgccagggggtggcgtgctgaactgcaagttcatctgggatctcctggttgtgtttggatttagctggggtgtgtcctctcctcctacaccttgagtcaccagccaaggtggaggagagaggatggggtgtagcctgtgtccagctctctcttggacatggttgggaggtgctgaccacaagtccgaggccctgaaaagaagtgctgcaaggaggatgtttctttccccattggcacagcatcaaggttctcaacagctggacacaaacaagctgttctgggagccgtgtctcattccccttcacctcctgcttgctgcctgctacgctcactggtcaccagggctgacgtatggggaggaatggagagtggtctcactgacagtggatgtcattgtttgctctctctggaaggaggatgtctgaccgaggccagagaccacgctcaggggacctggacgcccggggagttcaagcgagcctctgtcctcagtgatggagtcctgggccactggggcagtgtttgggtgctgcttccactctggctcttgacaacagagtttgttccctttgaaacaagtttgtaggaaccagagtgtgtgaggggcctttggcagcgctgaaggaagggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattggaagtgattcagaagccgaataaatgaagagcgtgacagcacttgagagtctttgcgcatgtcatctcatttaatcccctaatagcagcaagggcgagaggcttagacatgttaggaagcttgtcacaccgtaagcaagacagccaggaattctgatctcaagtccagccacccctgaccatcgcagagctctgtgtgtgtgtgtgtgtgtgtgtgtgtgtgtgtgtgtgtgtgtgtgtgtgtgtgtgtgtgtgtccccgtccgtcccgagctgtgtgtgtgtgtctgtgtgtgtgtgcacgcgtcccggagcgcacgcacccatcagtgaatgctgcctccacgtgggcaaggcatatgcgtttttctttcattattctcagaaacaggcatccagtgcagaacgggcctgtaatggttgctgactaagtgcttaatggagatgtttctgctgataagcctcagttgaaaagggaaagacgcaggcaagctggccaacatcaaagccgggctttgtttatagataagggtaggtttcattctgtgggttccagagcccctgtccccaaatctcagagggggtgagttttaaacagaaactgtgtttatctcccgcagtgggctggaagacaggcctgctgggactcagaagcttccctccctcccatcctcccttccttcctttttccctttcttcttccctccctcccttcccagatagctagccactgccctcatttataacataacataaataatgctctctctgccccagctgtttccgtttggtttttgttcttcacatattttattcgtacttgattgtgggttatttaaagtaatttggaaaatatgaatattaagtagaggaatctggagaagaggtcacagaactgtaatggacccaagctgcaaaaatgcaaaacacagtgtgtaaccatatgtgtgtggaccttccctcttagttaaaactggccatgacatgatggtatgcccctcttaacaggtgtttcaactagatgtaaccaagtaataagtagcttcaatgattgggtgatgacgattggactaaattgtaatctgggcagaagtatagaaattcaacagttttaagggcatttgtgatatatgtgtatgtgttacttatgtgttcttcaggacacagatggggccaaaggacaaattttctgtgttttcagcactggggtgcatgagggagcaggtgtcggccacaccaacacatataagttgttgcctgcgggtacagatcaatgaattctttcctgttacttcatggctcagaggaaagaaggaagagccagcaagttaagatcatgtatatgacgtagagctaatccttttaaattacatgttacagcacttcaggttttgatatgcccaggactgaggtccttttaggttttcagaagactgagaattcttaggaacctagacagggcctctgttaaggctgagcaagctgcggtctgccttcctgtctcttctgttgggcagtcacgggggtgctgatgccaggtggcttgtgagccttcccactttgcactgtgcctgcactcgggtggctttttatcaatccgatactgttgcactcacgtcccactttgaggctggatgaagtcaagctgcccgccttgctgccaccctctctcattccagtgtctctgaccacactctcactaggccctctggaaatcccctgtaggattttggaggagcattctgagaacggttctcttgtatacgctcttgttgtcaggacacttgagccaaagttgttggtcatttgccccaggagccccttttcttctgcacgctctttttccaggggatttcagggtaggttcaacactttaagttaccccgccccctttttggtatttgtagtggcttacacgccccaggtaactgaaaacttttgttggcttattaggggcatttccacattggagctgtaatccgtggagatcaggaagacgttttctttgggtgacttttttctcctggtgatgcagtgggccagtgcaaggaggagggtgagtttagttgctatacacaagccaggtacaagacttccagagtgagagggataatttacaccctgtggctatttatttagcacatcttttgtgtgactctccagtgctagggacagggatctcaagatgagtaagacctggttcctgctcttaagatgctcatggtttagtggaggggacaaagtgggacacaggtgatgatggcattacaatgagaatgtagagaacctacaactgctgcacccctccctgttcttcaagatgccttctctggccatcagggcagcatgtgcagaggcccgctggtttggaatagtgtttctttccatgtgtgatgcagcgttccctcaaagccgaggcgaggtttatgcacactgcccaattgaaatgtgtctcatgttcactcgctgctggatcagcagaacctcgcgcagggcactccttgggctcacgctagctactttgcctttgtttcttcaggccttgcgctgcttggattgaattggattctgccacgctgatattattatctcacgcctttaaagccagaatttgtaataaactactaatgttcttggaataaaggcacttcagagcatgcgtagcttgaaataattcttctaacacctagaaattagccaattttacttttgaaggagatgagaataaacatttagtggtcagccagacggagaataaatggccagcatttgagattttcctgctcctgtttatggagagagactggcatgtacctaattcccaacttgttgatctgttgtaccctattttaattattttgccagatgtaaacattttcccttttttgtgaacggagtgtttacaccatctatcacatttaatgtattcggtgcctgtgagtgccgacctcttcaaaatttgtcgacttcatcatccgtgtgctgtccagaaatgagatcttgatgccccccaaatgaattatgaaaagcttttcatagtaatataattgatccactgttggccacacttataaaaaaatcaatgttaacgtgttaatatttcatgagtacccacgttgccagctccttgcaatgggaccaaactataaagaatgagaattgtttcacagtagcccagcacatggacagagtgccaagaaagggagttcagggttgacttgaaagtttgaagcgcaacagggccattgaaacacagtcctctgactcatgtcagattgttataattatttaatgcccacaatgcagctttgtccccacggatttatactggagaggtttcttacccacacattgtggttattagctgcaaagaaagcggcgtttgtttataatgacatggggtatatctggatggcaaagaaaacactgcagattctgtcttcttaggaaggaggcaggaatttggcagataacctataggaaattgggagacatgctgtcattacttttcatatatgtgggtggttgcagccaataaccattagacaccttttagttttcacctttgtcccaaactcttgagagaatggaattgcatgcttacttttcatctatatgacgttatacagctggtatgcccagagtgtatctcaacttaatctttttaaatgtgtctcccaaaatccctttctcaaggttctacatcctgcctccatgaaatttggtgtcaccaacattgtcttacagaaccactgttactatttttataaagagtttataaatatgttttgaaaagttctcatgtggctagatctcatcaagggattttttttcagacttgaaaaataaagttaaagaagtaaggctttggggcctccctggggacatgtctggtttggagatcagtggtggtgctaatggccctgagtccggcatccggctccttgggagaagaaaggtcattaagtcagagaggaccagtcaagtccagctcctccaaactgcttttctgtgtgtcttccttggatgtcctcccttcttcccctacatggaactctcagttgcctttgctgtcagaggaggttcaatatcaatgggtttctcaagcttagagggcaacagggagacattgaaccacagtagtgtgaaattgtccgcaggtacttacaagctggggtgtgcagatgcaatttataattgcaccggaaatacttgtaacctttatcatgcttagtggtggaaataagaaaatctatgtgagtcagcttagtactaacttgggaccaatatgaagcaactgaatcctcttaggttttgcaagagagctacaaatagaaagcagacacaaaacataggctagagtaacagtaaatgtatctggagcctcaaatcaggactcatatattcaattccttattttttgttttctggttcaacaggaagtctgggagatctataggaatttgaattacctttaatggtttatggggaccagagaacctaaactttagaattgggattgtcctggaaaatctggaacacatattgacccagatccagacagtgggttatggaatatgatgcagatgatgagccaattaagagaaaggtttgcatttaagcatcttcctcttgtactggtgactgagtgactccaaggtggcaccattatcaccggtgcttgtgcagaggtgatttttttttttttttttacactttgctgtctgaaatgctttaaatgattcttttaattaaaaaaattagttacctatataaatattcacttggtaaccccttcatttaaacagtccatttatgccttatgcacttgtatgtgtgtgtgtgttgtgtttcacggtaacaaagttttttgttttttgttttgagatggagtctcgctctgtcacccaggctggagtgtagtggcgcgatctcggctcactgcaagctccgtctccaggttcacgccattctcctgcctcagcctcccaagtagctgggactacaggcgcccgccaccaagcccggctaatttttttttgtatttttagtagagacggggtttcaccatgttagccaggatggtcttgatctcctgaccttttgatccgcccgcctcggtctcccaaagtgctgggattacaggcgtgaaccaccaagcccggccggtaacaaagtcttaaaagcggtcttattctgtaatacgttggccagttttaaaccatttgcagtaatgcatttaaaagatgttatttcatagataacaaaatagcttcttgattttcatgataaacatagacttggagcctttttctttttccccgattgtgagtcagctcttggagggcatggacagtttctcacacctcctgggattagaggtggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacacagcaaaggttttaagtggataagtatgtatggggagtgggacgtgatctggtttgaataatgtatactcaggactcttgccatacagtaatttttttcaacccgctagacactgttgctgtggggaagtggagagtggtttcatccatatggcagcatcatggctgtgtagccctaaagccataggcacctcccaccccacccacccacagtggcatccacagttttagtctctaatagcactttgtctcctgagaagaaaagcaaagttgtttttcctttcttcttctctcatccccaaagcgttctccttctcacccaaaccatgatctcagatcttaggagttacaggtcagacatgtcacggagcctgtttgagatcagttgtctacgttggtgatgaaattataacaccctaaaagaagactttggagtaggaacttgccagggtcatcagacatggttgggttgagagaggaaatgcgattatacaaaaaacgtagaatacaaagtagtgcttattctgtgatcatggctactgtttcaggggacaggactagaagggaacccggacaaagaaaaacccttggcctgtgcaggctgtggggttgtgagtgctgtttccccaaattaaaatatctttattattgtcatgattttgttgtgccattgaggtacattaacttaaataaatcaaagcgaacaattttaagatgacgagtaagtctggagaaaaacctaggaccccagaaagaaggcatattgtacatcccagtctgctgtaacttccggagctgctgctgatgacaaagggctttaaggcaagggaagtgtttgcagcactttgggggctctatgcctgtctgcatgcttgtttagtttttgccatggcctgttcaccagcctgtctgccctgaaactgggaaaggtggatccagctgctgtccaggccttcaagaagcagagccccattcaattgtccacttctctgttgctgcccagagccagatcctgtgtgggatacttggcttttcaagggcctgtgtatggtgtgttgttgagtagaaatgtctgagatgctcctttagtagcacctgattcttttggatcagtgatttgccatttcttatatgaaaacgagaagttcagagttttgaattctggccccagttccatcactttcttgccctgtgaccctgttctcctcccaaaacctttctgagtcttcatcattaataatgtttaattggatcacatgaaatgatacaggtgaaagcatttagaaatggaaagcactgtgggggaatatttttgttcataattgtatcataatgtggacatggagagttaacctttgtcagcgcttagtttctcagcctttttatctattaaatgggagtacaaatgataccttcattgggggttccctgagcatgcagtcggaaactatgacctcttctggaggaccatgacttttattttttgactctatagtgtaggaacatcttaattaaagattatggaaaaaaatgaaaaatgggtttataaaaaaatgcccagatccaatttcatgtatttgtaaactattgatcaacaacctgtgtggaacctatggccggatatgaattatccagtattagcattgatatgaatgcttttatcaatagagcattgataaggcatttcatggaacacacatgtcagctcgttctctcactttacctacctcctccgctgtctgcctcccctctgccttagatcttctccctccccttttctctttcctcttttcctatactctctctcctttttctcttttccttttttttttttttttttttgagacagagtctctctctgtcacccaggctggagtgcagtggcgcgatctccgctcactgcaagctccgcctcccaggttcacaccattctcctgcctcagcctcctgagtagctgggactacaggcacccaccaccatgcccggctaattttttgtatttttagtagagacagggtttcaccatgttggccaggatggtctcgatctcctgacccattatccgcccgcctcggcctcccgaagtgttgggattacaggcgtgagccaccggcagttgtgctgcaactgtagagaaactagaggtctaatttctcaaatactggtcctctgtgaattgaaatatagatcctccctcacagatatagattcggtgactgaaataattattttgaaggaaccattgcatacgtgacatacttactgtcagataaagtctttggagggagatgggatagtgtgtggtgtccaccctgtcacttctgccagggcgagggctcacataatttattctaagcttcccatcctcagcttctgcgcaggagtacaatggaagatggggggtggaggccttgcctgtggagccttgactgggagaaggacaaagaaggcatgtagctggagaggtccagtgctttttccagggctggaggctgggaggtgtcctcatgcactcctataagctaagcagaagccagagagctttccctagtcatgcagctcacaggatagtgtgcagtagagctctgctaaaggaccttcagttttaagagcgccttcactccgtagtatcacagataaaattagcatccatattagtaagcccaacccagagaaccatgcaattatctcatgattttatttaatgactgtgctcttttcacagcttatcagggtaatctttggagcatgtcctgattacatgttgtacagaccataaaataagtgaacttaaaaagcaattcaaagctagctctaatttaatttataatttttacatctcaagacaacatttttagtagataattgtccagtatttggttttgtttttttgttttttacatatgtcaatttttacttgtcttgcagtttccattcccccagcacatctcatctttgctcatagcagcgaagaagagagagcatctgtcctggttctccttcaccttgctaatcaggctatccccctcagctcttcagggaatgtataatgacaaattagaccttgtaggacttgtgcatggagcttcagggtcttttctaaatggcaaaccaaagtggccaacacttgctagctgtgtgatcttgagtaagttacttgacttctgagctctgatttcttgcctttaaaatgttcccacttcataggtagtggttgattcacaaggttgccatgaatcaacaacgtacctcagtgaggtacctacctgtgagaagtgcctagtccctgaaggcgtttggaagtcatttcccagggcaggtcagatactgaggcttcccaggctgctgtacaggtgggcatgctggggaccttctcagacaccctggcctctttttctttccatctggcacaagagatgctttttctagttgggacatgcaggaggaaagagagagcaggtgcttccttgatgtgaataatttatttttccttcagatcattctgataatgcaccaacctttggatgggaaaaggtgcaaagctgggatatgcactagtgttacatcactggagttatgttggggatatgtccagtgtcagatttttttgtccaaaatcccattagcagaggaaaggaagaagatacatttccttggcaactattatgtcccaggcacagagattacagaggcaggagtgacagttgttgagggatacagtgggtatgagagggagggatgtaaactgaagagttcccatcataaaatgtggtagaatgttcacaaaggctcacctaccctaccccagggagacatttattctaattttgggggagactaagtgattggggctattcacttctccgagacaccagaaaatgagaacgtctgtaaaattaagaatatgaactctagttctgtctgcatttccaacttcttcattgtttcctttctcacaagattttaaatcccttgaggaagtcatttttcaaacagtattttctgtgaaatccccaattgtaatgtctactttatttactcctccactcatccttccttatcaggtttattgcatagtataatggaatatatgaaattaaaaataactacactggacactgggctctgcatacagtaaatattcagccgttgtctgcagacttgcctaagtgtgtacgcagtagttattctaggcaggtgctgtgctccaggctggaagttgtgtataggatagagagagagggtgcctcagagctggcagtttcctccagcagtcaaattctgaacacccagctatgcctcttgctggggaatctaaactttcacctttcagagaaaacaaggtctttggaaccagtgtgttctttcaaacaatgttggatactgcccgattgtttccatccgggaaccaagttttcaaaaagaagtccggctgctttgttaagataagagactgttgtgtgaaaattgctgagtgagagctcccactggaggctccttgtcttccaggccattaccagtttactcctagctgggtgatgggggtgagggttggggccagattgctagagccccattcctgccagttcctcccagtcctgaactctggggtgagtagaaggtagagagggttgatggggccgggctcctggcctggcagaaccgtgctgacctggagcctgttcggaagctggcagtgattgcagtctctcccggactgttgctgcccttgtttgccctcccttctgtttccttctctctacttcgagcattcattacatgagatggtgctgttttttcatatatttgttatgagtaattttatctttcatctattagatgacatttttgattctgttcttaatttaaaacacacactcattttttaaagtttctaagtacgttttttatttgtatgtgatcatggttcatcagtataagaaaatatttagccagttctgtttcgtaaagtcttcaagaaagataatagcttgggtggactgcttcttcatgcactttattaatgtggcttcctgttaagatctgaagccaggcagagatgtccacttttgctacttatatttaaaattgtactgcaggttcagaaatcaaaggcatccggattgggaagaaagaaagaaaactctctttattttcagatgaattgagcctgtactagaaaacctaaaggaacacatgcccaatcccgattcccccaaagtacgaaccgactaatgagttcagcaaccttacaggataaaagattagtatacaaaaatcaattgtatttttacatactagcaccaagcaatctgaaacccacattatgaacacaattctgaggaataaatttaataaaatcagtgcaagactagtttattgctaaatgagagttatcccatgttcatggattggaagactcaatattgttaaatcttcctaaaatgatttgtagattcagtgcaatccttatacaattttagtatgcatctttttaaaaaaaattgtcaagctgtttctaacagtatagaaatgtagatgacctagaataaacaaaacaattcggaaagggaagaaaaaaagattaggggtcttatatttcttagtttcaaaacttactacaaagctatactattcaaatcagtgtgttactggtgtaaggatagacagtggtgtaagcatagataatggtacagaattgagagtctagaaataaaccattacattattgtcaattgatttctctacagaggtaccaaagcaattcaaaagcaattcaattcaatagtcttttcaatgaatagtgctaggacaattggatatccacatgcaaaaaaggtaaatttaaattcttaccgcacacggtacatagaatttaactcaaaatggatcctaggctaaagtgtagaaggttaagctaaatcttttagcacaacataataaaaagtcttcatgaccttgagttaggcaaagagttcttagatattaaactggaagcacagcatgtcaaattacttttcgagaaggtttgctagctcattcagtgggtgaaaatgggtgaaaagtgagcacattatttaactatattctcttgttcctagttaggttgaacatatttttacttaccactcaaaaatattaccactttctgggctcttgtaggtctctgtcacatcttcgaactcaccaaacctttcaggagaaaatagttccttggagaagtacataaagttgtgggactttgtaccttggattacactttccctgtcaactctgggtcctccatagtggggaatccatagtggtttttgtcctgcaaataaaacagtgtgactaagtaattttccagaaatgaacagcagagtgggaaatagacataagtgagagtaatataacaatcacggtgtgataaattagcatgggatttgaaatcaacctgtttgggttcaaatcatggttcacctcttaccggttttgcaaaccttgggtcagttacttaactccatcaaatccttcacttcatctgcaaaatagagataagaaaattccttttctcttagtgttgctttgagcatcaaatgaaaaaatgtgtgtaaatgtttagtgctttgtacctagcatataggaacccattattaagtaatattacagtttggatttcagacctgtgagcttagggctcagactctagaggttcctgaactaggttttcctaggcattgcatgtagagtcttatcttaaaaaagttttaattgaaagattggcagcaaattcttcttgtcacttcagacatgatttcctttggggctcttgtactcccatggtttgaattcatagagtaactcaagggcaatagggaattcctctcaactctctgtctccaagaatacctctgggtgctggagagatgccacttatcaattctgttgttattgtttttagggctgtaagccttctggatagaactcagtggattttcctgagtagtgaagaattaagtgagatgagggaaaagcattgagagtaattatcagcagtggactatgcctgagtttttgttagccctgaacttacatatcctgactttactagtccatgagttcttcatagtcaggaactgtaccttttaattctctgcatctcctaggggctttctcagtgctaagcaaatagtaaatattcatgagatactgggattgtgcccagcattttctgagttttcaaatagatgaagttatagaatcatattcatatcaaaggaagttcctgtgtataatctcatttcattctgtcaacaaccctaggcttggggtgggtgtgttggtgtggatgagaacacttagtatccctattttacaagtaggaaaagtaagacccagataagttaatgacttgctaaaaatgatacagctcttgagagacagcagacatttgaatcccatctactgattctaggtcctatggtcattcctttgctttatgttgcctgttttgcagactgtcaaacgcatcagacacttccagtggtttttcagtgggtttttgtcctagtgacagtccacacatcctgctctcctattatcacatttgcaggaggaagtgagacatcttttgacactggtgatatgggagaaggagaaaaatcctagaatcaaagatacttactccttgcttccctctactcatactctctggaaagaaacgtttagggacttcttgtgttgtgcctgttgtgccaggacagctcaaatggatgcttttgtcacagcccctccacctttagcagaagttgttgtattcctagccaatgcaaaaataaacaagtgagggaaaatgacatttcctggtaatggaaagtagcagttggtgagactttagacaagaagcgggtgttccagccaatgagcagtgaccacagtggagctagttgtcggtttacttggctgaagaatatgtttgcctgcatcctgattgtcaataaagacgtttaaaaaccccagcttgactctggcgggctgagggtgctgccgtgccactgctgcaggatggagctctcttcctggtggagacttgattcacaaggacgctaattattcattcttcctccgtgcagcccgctgaaacaattgctgtgcttgttcggtgcacagtgtggcgtcggacagtcaggcctttttatgtaactgatggcgctgtatgttcatattgttctttatgtacttattttatagcttatgcagcagacattcgagtcaattagcttcttgtcttgcaaactgggcactgctgttctagaaccaagttagaagggtgtgttgagggcgacccgggcagacctctctcctttctttttgtgctgtgtgggttggtttcaagttacagcatttttattggctcttgtttgctgaaccttggtttcaaaagctgatgtttgagttgaatttcttaaagatacagcttttgttttcacaaaactgaagtcaggcaatatgcatagcccttgggagtgtgggttttttttttttttaactgagtgattttttttttttttaaatggtacctattaaccaaaaaatctaagcgaatggtttcctaactcacttttccttaactggcgtcagcatggagtccttgtttcttattgatttgcatttttttttttttctgtatagccttactcctgactcttttgtcctgaattttttttttttttaccccgtatttcttgaaacctgcctgttttggggacaagttggagtttaaataaattagttaaattctgttgtgtatatttctgcagatgataatgtttatgaagcatagattcactgttttgtgaggatttttaaatatcggaaagaaaatttcctgcttcctctttccatctccttttctgtggttttagccccctcgcccttaagagccatcggtttgttattgctgattgaggtagtggtggtggaagcagaggctctgatccagagaaactccccaagacggaagtgcagcaggcaggatttttatccagcggattttgacccagtagaccctaaagaaggtgcatgacagagactcatatttaccataccattgaattctcagagctttccgtggtggctggcccaaggcaattgttcaaaacatacgtgagagaatgaatgaacaaatgaccttgcctaccaaacgtctccctccctctgtgtaagcatcccttaaactctcccaacccaggtggccttgacatatcccatgctcacccaggaccctgaagtatgcctcggagcaactggtttctcctgaccagttagtgtcaactgagactaatgcagaaaacattgcttaccctaatgtttgcctttagaagtaaaatccaaactgaaggaaaggaccttgaatttgttttttattcttgctgacttggaacattgataatgctcatactgatcctctggctaaacatttttcttcctttatccatgtatttattgagctctccactgttagcatgaaaggtggagaagcaggaatacatggtgtgtgcttctgctagccttttactgtccagttgtagagagtaggcccagtgaactcagtcaggtgtttataagattgagcaattgagcagttgctgtatcctgaagactgtatctggtgctttactcttgtataattcttgagacaggaatacctgggtgttggcatcaaggggctgttgaggccatctttatttctccataacacccagcacaagacatttacatgtatgggttgggtagggtaggagttcatagctgtccatagagcagggcagggacatttctgagaaggtcagagaggtttgatgaggtgattttcctgagctgggccttgggagtggagagatagagggagaacaggtgcatggacacagaggccagaagggcatcagacaaaggacccctggggctgtgggaaagcccccgagccattgggaaatagaggagcttagccttgctaagaggagagaattcagagagccatgaggtgattgaggtttcaaagaccaaataaacaaaggaagacagcatcttggggagtgggcaagaccatgcctcacctggcaggtgaggtcagaggatacctgacctacgaagatccacaaaggctggcagtggggggcatcccagtggacagtgttgtgatgagcaaggggcccagaagtaggaagacttaaggagtcctaggccttaaggaagactcaacccaaacctggctacctctttaggcagcttgagtcttggcctctcctaccagctcctgaagggtagcttcatgttacatctggctgcagagaccctcctttttagaagcaggcagggagtggtgcccaggctctcaggacctcctcttgtctgggagactgcagcctccccacacgacacagcccagcccctttgttcttgagtgcctgctgctcacgtggtcttaataaacaaaatctagaacgtgctcatcctttaaaaaaatctgttagcctggttaacgtgtatataatatgtataaatatatgtatatacactaattatatataaattatattttgtgtcagttatatttgcaatcacacacacacacatgcacgcacacgcacatgcacatgcacatgcacattcacattgtaattcctatttaaagggaaaaacgagccagttttttaaagggaaaaaacaagcaaaaggtgtagggagagggagacacccatctctgcccccatccgctgattctcttcccttttctatcctccctctggctgggtttacggacaggcccttcttcctcctgcccttcatctgccgcaggacctcagtgctggtgatggtgagcccatgaccctccttctctcttgttctctgctcttgtggaggctagttccagccgttcagttccactgaagcaactgctttggcagacgaagctctctctgcctgaaatttcttactttcttccttctttggttcccatttcaccactccatggttcctcctccaggaagccttccttgtctggttttcttccttctaactctccccagccctgtctaaatcttacccttcttcagagcccatctcaaattttgtttcttccatgaattctttcctatagagcttgtccttctcctgccccctctgccagctgagggctttcttctttccctgaattcccccagtgccctgagctgatcttagatctgccttgtttgccattaattgaggagtacatattccccccaaactccttgagggcagatgctctgccttattgtctttgtgtcttaaaaatcttgctcttgtatagtcaagaaattattgtttgaaatggtttttaaaaatagggttctagaggtgtttttgttgttgttgttgtgttttttgtttgtttgttttaccaaaggaaaatattccacctggctgatatagtgagaccttatctctacaaacaattttaaaaattagccaagtgtggtgacgtgtgcctgtagtcccagctactcaggaggctgaggtgggaggattacttgagcctgggtggcagaggttgcaacaagccgagatcatcatgctgctgtactctagcctggtgacagagtgagacgctgtctcaaaaaaaaaaaaaaaatgtagagtctcagtttgcctataatatttatattgcacaataatacatttacttattttttacttattgaaatatgccacttgtttttaaatagcatgtaagatgcagatatttgcacttttaattgatatgccaggcaggagatttactgctctcaacaggtattaagaggtaggaaagctgccccccggcaagtttcttagcactgtggaactgatcctagtgccatggtgagtaagtggcagacctcagattcacaccacgtctctgactcccaataaaccacactgtccccccacccccaaccctcatggtgattaaaatgattactatgtacacacaaaatatattaggttacaggttttttgtttacaattctaagcttctaagctctgttcatttgtatcttcataatttgggggcctatgaaggattgtttatccctaaattgaaagcaagcaaactaacaaaaaatgagatcaaacattgtcagagacggttgttcagttaatccaagcattcaacaagggttataaatacggcatagaagactagggggaaaaatccaagtttttgataaattgtcctcaaagctaaactgtttcttagcaaagtgagaaaaggcataatgttcccaagaccaaatttaatctatacattcttggtaagaccttatttttctcctctttccattaagtttaaggtttccttctgcttcttgcactaatcattaataactatactgttgtcacagctcaaaactttcctattgacacttcagtcatttttaaagatcttgaatgttcaacctctatgaagctaaccttttgcactctattaaaatttaagaaccatttgattctcagtgaatgccccagctactggatcatgaaagcattaccttgtgccaagggcatgatgcagaacactcattcctttttaacaaataagaagaagtttgacttttcatttacacatcctgccaattgctaacaagtttccatctcgttcaaacaccagattgatcctaagaaattgaaaatattgatttaaccctctgtctgatttgtactgcaggcacctgctagtgcagtcttagcacattacaattgcttggctgtaattcctcaggggaccactaataactaccacatctgtcttttcatcttccgaaattatgctagcagttgtccaagtcaattgtgattcatttgatactgctctccttcaagacatattgcaaccaaatagacttgctcaccagtaatatatctgatgacatagttagttcttgttaattgacagaatgattcaggcttttatggatggcattaattggtcccttgtgtccatgcaataattgaccagacagagaaggcagcattttctttcaccaagtcaggagagttttgaggtgagataaatgtagtaaggatgacaaaatgtctatatttttaatcaagactttatcaatgagttgaaaaaagaagatttggggggaattcagatcatcttaattatgaacattgcattgcagcctgcagagatgtgctgaaatgcaggtctgccttctctttggcctccttgtgctgaatattttaatgcagggtacaacatgaatctaatatatgcaaagcagaagagtgctgtacctgaactaagataatgaaaaaggagaactataagtagctttgtttttcttttgacattcatcattagtgacccaatagactgggcatgtaaaatctgaaaatgtggaatttgcattacctcctgcttgctgagagagccagaacgttagttacatttactcctgttgccatgctactaaaaaaaaaagcgttggttccttttttcctacaggataaagttttcatatataacaattttcacaaactgcctccaccatttattcttccttcccatttggtcacacagaattaatatttccaagttatggtaccattttgtcccttttttgtacttagtatgctctttctttaattagtcattttatagattcccactcattcttcaagaatcccataggtgcctcccgaatttctcaaaccaaattagctgccccctccttgtgtttactcatttggttgcttatttccccaactagaccttgagcttgccttgggcgtgggctgtgtctgtttgcttgacacaggcagttatgtaaggacttaataaatgtttatggaattgagttgcaattgttgcattttgaggaatgagaatttaagatttgaatccgagagagatgacttggatcaaactagatgtcaagcaacctgtacttccaatgtgaataagtggctgacgaccagccctggggaataattataatttggtgtaaaacaaaccatttgaggtgtggaagatgaattagtcagttgacgtttgtagaggggagggtgagatatgagttatgtggaatagattttctggtgtttgatttacttagactattctttttaaatcatttgtcacataggatagacagtggctgtaacagatatccatggaaactttggacttgtgaacatctgacatgacctccttttaagggcagtgcaatctgacagacctgggctgaaatcccagtgctaccatttattagatttgtgttttgagtgagctccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacagaggttcacacctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctctgtgacaatatatatcactttcatggggttcagagcttcttgttatagctcaggaagttacagagggagattgggagctaatgcaccaaaaccggcagtgagtatgtgtaatggggtcaaaccttgttggttttttttagctacaaagcagcagatcggccactgtgatagaatttgatttttactggtttgggatagattcctggtgatgctgatagtttattacccaatgtaggtctagaatttatacttgcagagcattttcatatttgtgggagaataaatttatttggctctgaggttggttggttggttggtttgagaaggagtgttgctccgtcacccaggctggagtgcagtggcgcagtctcggtcactgcagcttcagcctcccaagtaggtggaattataggctcgtgccagcacacccggctaattttttttttttttttgtatttttagtagagtaggggtttcgcaatgttgaccaggctggtctcaactcctggcctcatgtgatccgcccgccttggcctcccaaagtgttgggattataggcgtgagccaccgtacccggtggctctgaggtttttaaatggtaacacttaagtaaacaaactctagtttctttctaacatatggctggcctagaagaatgtgttattttttcataatctacaggtagagaaatagaagaagagaacttctattcaaagaggcaaactcagggattctgaatgccttaatgctgctatttggagttttatttgaaagcattaatattttctttttgggggtggatggagaaaggagaggtcttagtcaacgggtacaaagtttcagttaggaggaataagttctagtgatctcttgcacagcatagtgactatagttaataataatgtggcgtatatttcaaaattgccaaaagactaggttttaaatgttctcgtcacaaagaaatgataagaatatgaggtggcagatgtgttaattagcctgatttaatgattctgcaatgtatacatatatgataacatcatatgatatcacaaatttatctgtcagttagaagcaaaattaaaaaaagatcttttaggccgggtgtggtggctcacgcctgtaatcccagcgcttcaggaggccgaggtgggtggatcatgaggtcaggagatgaagaccatcccggctaacacggtgaaaccctgtctctactaaaaatacaaaaaattagccgggcgtggtggcgggcgcctgtagtcccagctactcgggaggctgaggcaggagaatggcgtgaaccgggcaggcggagcttgcagtgagtcaagattgcaccactgccgtctagcctgggtgacagagcgagactccgtctcaaaaaaaaaaaaaaaaattgttgcttttcccgcgatgatgaataaaggggtcacttagtgtagtgtggatgagttcaactagactgcttcctcctaaccccaaactggaatcgttatgttgcgagcatgagactttagcttggaggagagagcgggtttggtaattttggaacctggtaaactttaggggccttagtaaatttcaaatatatgctacaggattgctaattatagtcaacttgctgtatattaaagctccagaatgtatttatttttgtgccacctttcagtttctgatttcagtccctggaaaaccacccattcttgtgctgactattccaccaactagtttatctgccttagaggttattttggtaaactttcactgcatcacggacttagcagggtaaaagtcggagagtaatggtacatttgtcataacaagaaaaagcggatctatttttctttggcaaagatcacctttggaaagtgttgtattatgaaatgcagagttaaatacaactaactcagctttgatgtgtcctttgttaacgttcagcctctaagcgcaagttgattaatgatgcacatcccacagtgactttttctcaagcccagcaaactcatatataccctagtgtataaaagcaaacaacttaattaacttactcttcatccataattatcttgaaattaactacttataatgtccaaaagtttatgctgcaagcatatttaaaaatctgttgagagtaaaagggacggtataattggttaccctcttcctttcttgcccacttagctattaatatgaaaagtagctactcccctcatactctttggctgtgtgcttaaaattattattattttaatttctgcaaacaagaaaagggctttctgttattttttcattgagcccctgccctgggccaggcatcgggtcctcagtaacggacagggcagttttggctactgttctcaatgagattagagtctctttggaagctacagataggttatactagtctggtagggctgccataatagaatactgggtggattaaacaacagaaattaattttctcccagttctgcagcctggaagcccaagagatcaaggtattaacaggtttagttactcctggtacctctctccttggcttgtagatggccgtcttctcattgtgtcctcacacggcctttcctttgtgttcacgcatctctggtctctctttctctccttcttcttccttcttccttctttctcccttctcccttctcccttctcccttctccttctccttcttcttctcctcctccttcttcttcctcctcttcctcttcttcttccttctcttcctcttcttccttctttcttccttcttcttttttttttttttgagactgagttttgcccttgttgcccaggctagagtgcaatggcgcgatctcatctcagtgaaacctctgcctccagagttcaagcgattctcctgcctcagcctcccaagcagctggtgcctgccaccacgcccgctaatttttttgtatttttttagtagagactggttttcaccatgttggccaggctggtctcgaactcctgacctcagatgatctgccctcctgggactcccaaagtgctgggattacaggtgtgagccaccgtgcccagcctaatctatgggattttgaagacaatactgtcacttaatgacttacaacacatcctcatgagacctaataacagaagttctgggttctgtgttaatacgggacttccttttgtgaaacttgtaatacactcaggagaaatgtgtgacaaataggattctactttttaggggcatttggagcactgtattgtccttgggtaataatgcttaatgtggacgatgctacatggcctccaagaatatccctaggcccttgatcctttaagggagaaaaccaacctttacttttcgattgtgtaattgtgatcagaatagcctctgagatataaattccaaatatatctgaattggttttctttaattaagaatacttttggattcaaatcatactggcagcaaattaaagacatgtttcatgtgtttactaaatgttaatgatgggattactttgaagataaattttaacattttaagtaaaacgttcatgtaaaacaaaagtttattatagattggttttaaaatgagcactgcttcagagtcaggatattcttagtaaacccacaagtgttgtggccttgtgcacgtcttttggtttctttttgctttcattttgtcatcagcaaaattgaaattgttagatgaaattgtctctaaagtgttttctagagccaaacatttctgattctctaatattaaagtctctaagagagtttctctaagcccaggcagtacagttaaaaatattttcgttgtttgcttgttggttatagagtgataatattttgcaattaggaagcttggatgagaaaccacacacgtgacataaaatggtttctcaacagaaaatctgtgccgctcaaactggggaaacagacttataaattccttttgacaaaagacacgtcaccacacaagcaagttaggacagaactctgagcattgtttttcatagacttgggacaattcccaaatattcttttttctcaaaacaatatttttcattccaatttacttattaaaaaaaaaaactgggagccgggcatggtggcttacgcctataatcttagcactttgggaggcagaggccagtggatcacctgaggtcaggagtttgagaccagcctggctaacatagtgaaacaccgtctctactaaaaatacaaaaattagccgggtgtggtaatgcacgcctgtagtcccagctgctcgggaggctgagacaggagaattgcttgaacctgggaagtggaggctgcagtgagtcaagagcgtgacactgtactccagcctcggtgacagagtgagattctgtctcaaaacaaaacaaacaaacaaaaaacaaagctctttttgaagatcacgagcttcagaaagaaatactgcatccactctgtccacatgtttctggcctgtccattcagttaacagttattatgtcccaggtgctaggctgtgtcctggggactgaggtaacagaaattacaggataaagctcctgccgtgtagtagtactttagggagtagtagagatgttggttgggaaagaagtgatgccagaatgtggcgggggttatcagagcaggttcagaacgtaaggagcacgaccagggaatcactaacttcgcgtaatggaagggtttgtttcagttggatattaaaagatgaatagaaatttgcaggcagcaacaagagttggcattctaggtgtagtaggggactatatgatagaaagcccacattgaaggtaatgtggtaagactcattaatctaagaaagatccttctggttgtagccttaaggaagggtgagagtgggaacagatggaaagtaaggaaaacagttcggaggcagctttaagagaccagaaacgggcctggcgcggtggttcacgcctgtaatccaagcactttgggaggccgaggcgggtgaatcatgaggtcaggagatcaagaccatcctggctaacatggtgaaatcccgtctctactaaaaatacaaaaaattagccaggtgtggtggcgggcgcctgtagtcccagctacttgggaggctgaggcagaagaatggcgtgaacccgggaggcggagcttgcagtgagcctggatcgcgccactgcactccagcctgggcgacagagcgagactctgcctcaaaaaaaaaaaaaaaagaaaaaaaaaagaccagaaacgaaatcgggccaaggcaagaagggtggaaggtggatgagtctgagagatggatgttttcactatggaatggttgtgtaaggatggggagtcagaagaagccatgagaagcttgtgagagttaagaggccatattcagtgttgtgctggtaaatataacctcctataattaaattgtaaagaggtcagtccaaattcatgtactggggttgatcgtttctgcgtaatagtctttcacttaacttttactcattttcactttcacgaaataaatggccgtgtcttagcctgggggcctaggtctggggttcggctgtgtgctcttcctgcagtttggaagtgccgtctatgttaatagatattcccaactctgcagatcttctctcgaggctgaaggggccccattcctatcagaagcctctcatttttctctgaggtagaaaaactaaggcatagacttcatagggaagtttatatgcaaatggtggctttctgcacgggcccctgtgagtggagtgggatgagatacccagtggctttcagagttctggtggatatttgattgctctccattggtagtaactttattgcttttatagggagagttgtactggaaatttgccctccctgtccttcagctggtttgttcccaagccagacctgtctgaaaattgaaatggaatactttttctcatctcaagttatcagttgtagctgtcaggaatttgttactgtctgctaaagccttttaacatgaaaatacgctaagggcagtgcatgtgtgagtcatgtgggaagttacattattttatggatgcagagagggacacagacccagatttattcataggtgaaaggggaaaaggaacagaatttaaaagggaaatcctgaaaaatatgtagcctctgtggctctgcctcttttcctacctgcgtctcttatacaccatggatagaatgtaagctcagtgggtacagaagagctgtcttttttccctcctttggtcttcttagctgtccccaccaggccatgcctataatcggtgcttagcaagctactggcttaagagagtctctgtctgctgtgagtgcagctcctgagatggtggggatggatgctggttaggaagtgtgttcgctgccttagcataaagaataagtacagtttttctcgattatttttctccaagggaaactcaatggggaatgtcggtttcatgctgttcttggaggggttggtttagaattctctctggcttttctgagaatccctccacattccccctccaggctgctgtcatggtagctgcccttctttcagctacttgcattttttgggagatatgccatcttccttcagtttgcaccctggtagcttagctccttcagtgtttagagggaaatgggagatggagaatcgaagcacactagtgctttctggtgttctctgcatgtgtttggaaggaatgtaaaagtagctagggcttatcgtggtatcatagcattatagggtatgagacctttggggaaactgaggctcacaaaggctgataactttacctagagtcagtgactgctaatggcagactcctagcgtctgtacttttccacacttacccgttcatatgaaatagtctgggaaggtctcttttaaaatgtatcgtgacctctcctataaacctcaaggttacatatgttaaagaaatgtagtcggctttcctcatgtgccgaattctgaatcaagcttacccaaacccccaaatcatttccacagagcagaggaaaaaaacaaaacaaaacaaaacaaaacaggcaaatgtgaatcatgggaacctattataatgatatatagcttgtcataacacattataatattacagcaaatgtatttaactcactgaacgttctcagggggctcttagctccctttaaaagtgttctccaaatctctgcagcaagatggagctgcctagtccacctcacttttgaccaaaccaccgttacgagaatacctattgaaaacccttacactgttgctgtttccctgggcttaaaagtatgtttggttttgtcagtacctggaaacaggaagttgagatttgaggagaaatctttggcagttgtgcactaagcttgcgggagttaggagtctgttgccacggaaaccacactgctgcctcatttattaatggaggcttggtgaacttccggagatactcttagcctgtcctgtaaattcattctagagaaatgcagggtgacttttaagagatttctctgtcgtttctcaagcattctctcctgggtcttcatgagctccagaaaattgcttgtatgcaggttcagaaccactgatttttatctggcaagcatgtctgaaggccgtttcctttttttcatgcttaaatcgtgtttatgcctgcctgccttgtccaataagtgaatttttttttattatgctgcctttaagaattacatggatttcaaatgaaggaagaaggaatacaaaaatgaactaagtaaatatattgaaaaccttctgacactaactttaagagagttataagcatcaaagccttttctaacttttaaaattctaaacttaaaaaatctaaaatgaatggtttatttcttctaattccagtgagatactttaagaacatttgtctgagacattttcaaattttgttctaatttcactaaactaactctattctgctaggcagagtaacagcattggaagttgcttccaggaaaaaaaaaattttttttctagctaattgtttatctgggaggatgcaaatggtggttttaagtcctttaagtcatccatcatgcctggcagcctctattgtctcattgttggatttgagccaagtcaggccctttcttggtcttgggagggtgcacatagatcttgctctgccaaatctgtgttcacaaggagtccgagcccagctctaagggtaggtaatgttgtcagatctatagatcccctcagattggaaaagatcatgcatcctcgttccttatgtcacactaaagtagaaagtagcactctattcaaagtagaagtgacaggacttgttccctcagttcttccagtgtctacgaattactgttagtttttaaacgcatttttgtggatgtaataaaatactgtttatagtcagctacgaagtaagtaattacaatgcgggaaatgaaattcaatatagctttgttgtggttttttgaattttaattaaaccagtcttagagtaaattataaatgctgctgcttttgttgtgacaagtgacattgacaaaatattaatctaatggattgttattcacaaaagctaaatcttttcaaatctgcagggtttggttgtttattttgttttacttttcagtttgtgttttaaaaagtctagagaaaagaataaagttttaaaaccacatgaaataactccatgtatggaatatttcattgttgatgtcttgccagccataattgcatgcatctcatttatggcgctgaaaacttgttctttttaaaaatcagatgtttctgtggtcacttttttgttattaaaactggagccgggttaaataaccaaccattgaccacgaagcctaatattaaaggaataatcagcccatgttcctattagatcatttccgttttcttttactttataaattaccttgttgcttaaaaatgacattttgttggttgtgaagtcctcttatagctaaattattcaagttattttctttggagattcttttaacttgaatttatataaactgtaaagaatgtacattaaatattcagaaacttttctttatgccagtttcttattttcacccatcatgacttaaagcttttttttgttttagcattttaatgtttaaataaatgtaaataatttagttacaaggtctttatggtagtgccgccattgtttttaagaagacaaattttaatccaaggttaaaaacttcacatttgcttatctctttttcctcttaagaactaagagtccagagattagagtaaaatcaccttttcctcatagttttttctttcaacgtgttagaaattcctgtttgaaaaggaaagccagttcctccccctttttatgtttgaggggatgatggtaaaatcacattattcagtcagtttccacatgtgatttgttgcctatattttttaatccagggattaaattgttgccaccaccagcatcaaatcattggggggcaggggtggggaaggtgcgagacagttggttatagacatccaaatatgacgacagaaaaatctccacagcaatatggcagtggagcatttgctgacttcagagtgccagatcaaccccaatatttttttcagggatgctaaacctcttgtaactgctaaattggatttgttactgaatgaagtatcagctgctgttggacaagaccataaaagccagccggctggccctttgtaggcagggcttacccaacgattgatatgttttagcacttttgggattattgtgattaagaggaaaccattctgaatgagtgagcaaagggggtaaggacacacagcccacagctggtgagcagcatgtgttggctccaaggaagtcaccattatggctttctcctggttcctgccctgattgacgtgtatgaaatcttttttttttttttttttttttttggagacagggtctcgcctgtcgcccaggctaaagtgcagtggcgcaatcttggctcactgcaacctctgcctcctggattcaagcaattctctgcctcagcctcctgagtagctgggactacaggcacccactaccatgcccggctaatttttgtatttttagtagacacggggtttcaccatcttggccaggctgttgttgaactcctgacctcaagtgatccaccctcggcctctgaaattgctgggattacaggcatgagccactgtgccgggcctagaatttttatatgaggaagtggtgtccttattttctccagttgcagctctctctgcagggaaagagacatttggaatgttgtggacttgagaactctgaatgctttcaaagcactatcgtgtgtgtgtgcgcacacgcacacacagtagctagaagtgttagtctagcacaggagttaattgagttaatgtgtagggaattcagtaataacaacagagcgtcctctttcatttcccagatccaaagctctgtgacatgcattaacaatatacctccatgtagtttgtgtctcagtctgtgtacacgtgtgtgatggctaaatgggaactgcacagccagtggatttgtgaacttgagcacttgcacctggctaagggtttattaagtgtggaaaccgtactgttgttgtaaaacagttttcatctcaagaaccacctgccccttttagcggtggccttttgcacgtgtcttgcactagccaagacaagtctatccaagagggagcttgtggagtaggttggtgtttgaatctttcccagtactcccaaatgcacatagaattggtcgcctctctgggtgtcccagggggctgtgccccgctcatgttcagagtttgctcagcataccacacaggaaagaggccggcttgccaggtcctgcggagcgcctttccaagcctgtgaaaggcacgaatcatccagcagccgagcatgcttacagctggccctttgctagctttgatctgcgaatcaggccacaccatgaatgcacttattgtcatgttatgtgtacacagtgtgtgaattattgaaaatagggaggcctgagcctcatctggtagagattacagtgcaggcatgctgggcgaaggtctgtaattgaaaatccccagatgctgtttatttggcctttgtcacatgacctgctgcaggaagattgtctgaacaaaatgttgcctgcatggagagtggagcccgccctcccccaccccccagagcctccacaggctcagtctgtgcacagcttaaacacctgcccaaaggatttttaaaggcttaaaatagattcactcatagcatttaaatagagggcatcttgcttgttggtttaaactgcttaagcggttgttgacttgtggaaccttctatccacacaagggtttgctggataatttcactctgagatatctttacaaagcaacattcagggcccgagccacataagtagtttgggctctgcctttttttttttagaagtcaaacttctgtgtggtgaatgagcttgcagataaagctgtgttgactgtatatattccttctgtctgtagaaaatattgtgggtactgagaataaggccctgagttagcatgtctgacttccgtttgtccagttcattcttacctattctgcctataaacaagttgaggtgtttcttagaaaatttgtttttctcaattaaatgctgaatgttatgctctctgtcagtggtggattgaagtaggatactaaatctgaaattgatgaagatcacaagaattaaaaacagggaagattgagctaattttgaagtaagaagggctttaagctttccaggttcattctgttagggaacaaaacagccacatgtcctctttcattgccagtctgtctcagctgtgcttgtggcttcctctttgatttcttggagcttaagaagaggaaagattcatgggtatttctgcattccataagcatccaacacgactgtgagctccttgaaggcaggagccctgttgcattcttctttgcatccccagtgcctgccaacacagtgctttctctgtcttcctgcggcttccccctccctttctgcctgcccattcaaagaagacagtcactgcgtcccatgagccatgatgtcatatattcagatattttttctttcagggagagactcaagtcaacagtagcaatatcattaagtagcacattcttcatgcagggccagaggttgggaggatggagtagttgggagtaggatgtgggtcctgccttcacaaagctcacaatctgccaaggaaaaagcaaaaacaggcagaatgtggtgtagcaagcttgtgctagcagtgtgcacaaagtatggtgagcaggaggggcagacccagcccactgctggggagtgagtggaggaagtgccagctgcagaggcctggcagctcaggaatcattcattgttcagtagatttggtggggtgggggtgggggtggtggccatttcacacaaaggaaatagcacccaacatgacaggaataaggatttttagagacagaagtgtgtgtagagagtggcaggagaaaagacaaaaactgatttgcccatgtaacgttttaattttttacggatagaatgtgttcatgtgttacctagatcattagaaatttattttattttattttagtttttagagacgggtcttgctctgttggccaggttgttcttgaactcctggcctcaagcagtcctcctgtcttggcctcccaaggtgctaggattataggcgtcagccactgtgcccagcctagaaatttaaaaggagaagaaaaaccaagcagctgtcctgaatctaagctcaactgaggaaggtgattttcttggtttgcttggtcatcatctccagtgggaaccctatatcataggccactgctttctctgtcgtgactagctggtatggggttacctctggctgcttctagttttgagataggtctgatgtggctagggcagtggggtcagtgagccagagcatggcaaccctaggaggaaacatctctgggcacctgtctcaggcccttcctgagtacatctatccatctaatcgttccgtctttgattaccattgtttggcttctagcctcatttctcttcctagaccataaactccttgagggcagagagtgtgtattattccagcgtgtttctcttctagagcctagcctaattccttttgtacagaaaatattctataaattttattgaatgggagaggaaagtgccttggggccagattatgtaggccttggatgcttagagagttgaggctttattcttctgtattgtggatgagaaattagagaactttaaagtgatgtgtgtacaattcagtccatttcatggctggattctgccgccatctaagattttgttctcattaaacacttaacagttggtctaatgttaaggattaaggaacttggaagacaaagctgggttcaaatcccgactccactgcttaattagtttgggaacttgggcaagtttcttaacttctttgaactgcagtttcagcatgtataaaatgctgagctaggtagaattaggtgaatgtgaaggttaaatttgtggtgtataagcacagtgctttggccaggtgcagtggcttatgcctgtaatcccagtactttgtgaggctgaagcaggaggattgcttgaggccagtagttcaaaaccagcatgggcaacacagtgagaccccatctctacaaaaaattaaaaaaaaaaatagctgcgtatagtggcacacgtctgtagtcctagctactcaggagactgaggtgggaggattgcttgaaaccaggaggtctaggtggcactgagtcatgatcacaccactgtactccagcctgggcaacagagtgagacgctgcctcaccaaaaaaataaaataaaaaaaagcacagtgctttgcatagtgctggtgcatagtagatacacagtgcatgtcattgcccaactttcttgctttttttttctttctttttattttgagatggaatctcgctctgttgcccaggctggagtgcagtggcactgtctgggctcactgcaacctccgcctctcggattcaagcgattctcctgcctcagcctcccgagtagctgggattagaagcacatgccaccgtgtccagctaatttttttgtatttttagtagagatgggattttgccatgttggccaggctggtctcaaactcctgacctcaagtgatccacctggacctcccaaaagtgctgggattacaggcttgagccaccgttccctgcaaaagcccaactttctatagcctcccaccatctctaaactccgcaatagtgtttcatttagcttattccctgaatttcaatttcttcagtttgagttcattttaaaaatgttattccttctcatcatgcttttcatatttttattagattactgagtgcctagacatttagatactccttcagcatgttttctaagcagcaagtcatccctgagcatgccattttgacttaatgcttgcataacttacctttgtgtagctattgttgtagtagcttcagaagttgatagaattcttctggtgatagttgtttttacaacaagaactaaatactggacgtccagtgagggacatgctgtttaatgcaacacctccagcctattcatagacttaattatacagtctgtcacaaattttaagaattttggctatacttaccttctggcaaaaacctcattcctgctatttattcagtggagaatctatttcaaattaaaagatttgtgccctcttaatgttaagatagtgccctcttaatgttaagatatcacaataagtgctctgtttacttggaaacaatttttaggaccatgtcattttgaaaattgaagaagatacaaagattggaaaagatgttcaatttcaacaacattagcaatagaagcatcatgggtttataccagatgccatgtagtacggtgtcctgaacagaaaacctttttcaacccttttaggaccctatatatcagttcaagcaacgaagacatataaacctggtgcagtgacattacattacagttaaagaactgggccaggtgtggtgacacatgcctataatcccagcactttcggaggccgaggcgtgtgtatcacctgaggtcaggagttcgagcccagcatgaccagcgtggggaaactctgtctctactaaataacaaacaattagcctggcgtggtggctcatgcctgtaatcccagctactcaggaggctgaggcaggagaacagcttgaacccgggaggcggaggctgcagtgagccaaggtcgtgccattgctctccagcctgggcaacaggagtgaaactccatctcaaaaagagttgaaggaccattttagagccccagaaggtgccagagccttcccattttctgttactaatgcatacagcagccctctagagtaggaactgttatttccattttacaggtaaggaaatagaggtctagagaagttgagcaagtttcccaagttcacacagctcataagtccagtttcctcagaagaatctaggcagtcatacctttgagtcaaaaaaccagaaatcggcagcattgcatcattaaagattcttcattataaactagcggtgtttagcacttcaaatgtgtggatttcacacttctctaaggccaaataattaataaatagagtgcttttagcaaaccttttcattaataagactttcttgggttaatgttaagattagctttttttggaccaggtctctatggctgtggcttggggaagtggcagggacatgggtatagggcatgaagaagcaatgagcatgcattggtcataagagacgagaacaaaggtctgaaaaattgtgccacttctcactgaaatagttgcaactttaaaaggatttacagatttcaggtgatattggcagtgctgtctaattttcataatctttttctagatcttttcttcggattttctttatacaaaagaggtgagctccttcattcatttattaaaaccatttattgagcgagacacggaaagaaaaaaactatttcatgatctcacttatacgtggaatcttaaaaaaaagtcatacatatacagagtagagaaaaaacaacaacagaggatactaagaaccagaggaggagagaggaaacggatatgtaggtcaaaagatacaaagtagcagatatgcgtctagaggtctaatgtacaacataaggactatagttagaattatgctagacacttttaggaggattttaactattgtcgtcacacacaaaaaattactatgcgatgatagctatgttaatctgtttcactatggtagccattttattatctatatgtatctcaatatcactttgtaaacttcaaatatatgcagtaaaatttattttttaaaaaaatggctgggcgcagtggctcacacctgtaatcccagcactttgggaggctgaggtggacagatcacctgaggtcaggagttcgagaccagcctggccaacattgtgaaacccccttgtgtctctactaaaaatacaaaaagttagccagacatggtggcgggcaactgtaatcccagctacttgggaagttgaggcaggagaatcacttgaacccaggaggcagaggtgagctgagatcattccactgcactccagactgggcaacagagcaagactccatctccaaaaaaaggaaaaaaaaaaaactatttattgagcacgtacttaatagctaccagatctggggtcacagagaaccagacaggtgctttaccatggagcagtcactattctaggaggtggatgaatagtctgtagataagtaatggcagtgcagcagtagcaggggtgcatgctcagtacttgaggttacaaagcaggaaatgactaactcagtttggatggctcccacagacattggggaggaagtgttccaggtagggtatacaggaatgaataggactttgcaggtaaaagagaagagaaagaacatgtaaggataggtggttccacaaaggcatggaggtatctttggaaaagaatgacagtggtctggggaactctatgaagagccacattctagaatagaggagccctatacaggagtgggctcttagctttaggtaccagactaaggagtttgtgttttgcttgtagtggatgagaacctgttggtataggaaggcaacataactagatgtggaggtgaaagaaaagacaaatgcctgcaagatgagtggcaggacatggtgggcgcctgagagcctgtgggtagcagtctatttaggtcacagttgggggcagcaagttcaggctccattaaatctcatctttttttcctttttttttttttttcgagacagagtctcactctgttgcccaggctggagtgcagcggcgcgatcttggctcactgcaacctccgcccccttggttcaagcaattcccttgcctcagcctccctagtagctgggattacaggtgtgtgccaccacgtcaggctaatttttgtatttttagtagagacggggtttcaccatgttggccaggctggtctcaaactcctgacctcaagtgacccacccgccttggcctcccaaagtgctgggattacaggcatgagccaccatgcctggcctccattaaatctcatctacactttaagtgtatgggataccaagatgtgaaagacatggactgtaccttgaagaggcttgtagtctgttacacagggaactcagcagagtctgattgtgggcggttccctgacacatgaagtaaagaactatgagaccaggacagaatggtgaagctcatgctgcttgcctagttaagagtcaagccatcattcccctcatatactaagtgacttgtttttaattcatagtactttttgtttcactttataatattgtggtctttcccagttgctggtctggtgaagtgggctctgggcacctggctgtctggcttacccctcttcatacactccatgtctagcacatgtttcaggcacgtttcaggtgaggtttcttggaggggacatctgagctggacctggaaagattttccttggtggtcttaagggttattgcagctataataccttagcatggcagggtgggttcagggaactggaagcttggtaggtattttgatggtggtaaaatgaattgtggtggtggtcgtggtggtggtgtgtcatgaaaaatagttaggggccagatggtggggacaacactgaacaccatactaaagcagtttattcctttagatgtgggcagtaggagccttggaaggtcttataactgagaactgtgttttaggtagctgtgtagaggatggattagaaagaaaaatgatcagaggcatagttacagtggtaaggctagtcaaactactcattagaggattaagaaagtgattatgtggcgtatctttattgcctcatagagaatgagccactaagaaaacttcattcatatttctttttcatctagaaatagttagaacagaaataacttctatctaacatagcagtgttgtattcactatgcagccttaaacatttttacttgctcatctctttctgacccctgtaacccaaggcaaatgtgtagtttgtaagcggttcctctaagatgcgggagaacacagtgttctatggagttgtcacatgataatgttatcagctgccgttgactgatacaaactcctgagaaggtgggacttgagttatcgccagacactcactggcagggatatgagatagaagttctgagtaaccaggagttaacacagcctttctctgtatgttctttctctgaaagctgttttttttaataagcccctgggtgaatgcagacacatattatctccagggattgctattgtttacctcctgaaggccgtcagtcctttggtgaacttctagtttgggaacaagtagtaccagcccctgacaaccctgaatgggcggcctggctgtttctggtgattttccacattggtgctgatttctggtcaatgatttatattgaggattaactgagaacttcctcgttggatatgctgtgggactggttcagaggctgtttttcatgagcctgtccttacacctaatcttagcctgtgccccttctccctccctggctctccatccctctcactctgtcatttactccatcagtctgtagccactgaggacctgctgtgttctcagcactggatgcacagtgatgagcaaaacccagtttatgctctgggctcctgtggacttctctgtctggtagtagaggggtaggcacatgttcatcttatagtctcattcagataaatggaacacagtagctgtgctgtgtgctgtgaccgagaggcgtaggttcctgtgagagcacatgttagggtgatctgaccagttctcatgggttggagttcttccaaacaagacataagcacctccaaggcagagatggcgtgttttctttttctttctttttttagacagggtctcactctgttgtccaggctggagtacagtggtgtgatcttggctcactgcatgcttgaactcctgggttcaagcaatcctcctgcttcagcctcctgagtacctgggaccacaggcaggtgctaccaagcctggctgatttttttttttttttttttttaagagatagggtctcactctcagccaggctggtctcaaactcctgggctcaagttatcctcctgcctcagcctcccaaagtgcttggattacaggcgtgagccactgcacccagcttgagatggcatctttttacccccataattttagcatgtttcttgtgttccatccacacacagtccatgtgtgaccagtggatgactggccagcttccgtaggcctcctttcttttccactattgctgggacaagttgctatggcatccgtgtagaagaaatggttaattagtaactcctcacaggttagttaataaatgttctttactgcttcctctggcagtgtccacagatacatacctcctagatcttcaggaagatggatggggagataaaacacccccattctgtagacctctcccaagacagtgacatgtggtttcctcagtgtccccttcatctatactttttggttgttggcttgcttgctttctttttttttcttttttctttctttcttttttcttttttgttgagacggagtctcgctctgtcatcaggctagagtgctgtggcgtgatctcagctcactgcaacctctgactccctggttcaagcgactctcctgcctcagccccccgagtagctgggattacaggcatgtgccaccacgcccagcttatttttgtatttttagtagagatggggtttcaccatattggccaggatggtcttgatctcctgactgcgtgatccacctgccttggcctcccaaagtgctgggattacaggcatgagccattgcgcctgaccaggttgttggctttcatatcctaaaatatttttttccttttgatgaaccccagctgatgaaaacagacttcatgggctaagcacagtagttcacgcctgtaatcccagcactttgggaggccaaggcaggaggatcacttgaggctaggagttcgagactagcctgggcagcatagtgagacctctgtctctacaaaaaaaaaatttaagaattagccaggtgtggtgtacctgcctgtggtcccagctacttgggaggctgaggtgggaggatcacttgagcccgggagatcaaggctacagtgagccatgatcatgccactgcactccagcctgggcaacagagctagaccttgtcttaaaaaaaaaaaaaaaggagtggtgggggcatatgactagaaggcagtttagcactgtcttgtagaatcttgcctgagaaatttctttgtaaaccactctccccatgctttgtgctgatgccggcatggggtctcctgtggaagacatctttctttgcttctttccactgggttatcttcttcctttttttttttttttaactttatgttcatgatctggtgccaaattgggactacagggatgtaggagcctcttttctgacctgaagaatgactcggtccataaatgttgagccacctgagaaagggaggcggagaagagatccatgtcattggttcttgttgccaaggactttatgacttggttgcaatcatgacatgtgctgaaatgatatcacataaggcagaaaaaaatacaagttaccagcaaagaagcccaggtcaaaggctgtgaatgtttagggaaaggggaggcctccaccagctggtaggttcatgaaggatgaggccttgggaaggtaggcagattccagacatgcagaaatgggcaaggacagtacaggccatgacagcagttgtgcacccaggtacaaagttcaaggtgttcacaggaaacattcgataatctagtagtactactgggctgagcggggtggggggatatgtagaagacccttgtttgatgtagctttggtctagcagtcaagggaaatgagttttctttctgattttccttgttttaatatggaagaacggggtggagaatcctcacacatccttcccagtgaagggaaagggccagcagatgtttccttagagaagccaagctagagcttcctaggcccagggcagtccagtccttcatgggtgtgagtttgccttaggactggccacggccagggaagagaagcattgcatttgttgcttctttcttggtggctccctgactccattcaattacaaagtggctcttacactgttaaagcttgagtgtctctgggctacaatttctagccacagaccttcatttgctgtgcctcaaacatgaccttgaggccacatcacattatatatacagcccacaacaacgttaaccagtcttctatctggtaaggcaagcgcagtgcaaactccatgcctttcttctgggatctctctctgtattgcccctttagcaggaaattccatggcaatccaagatgcaagagaagccaatgatgggctcatttcgaactgtgttatattatttaggaaaaagaaaataaaatgaaataaaaactagattacagtgcctggtgaggatcacagtgtaaaagtgacaggtcaggttgtgtttgtccttgctgcttatgtgcagccggtgggaaagacaagggcagctacaactacagcatctgaggcttaaagaggtgacatgttgtgcatttctaaaataatttttatgttgtagagaagctttatatctctctctgactcactggacaggcgtggtgtaaggcagaaaggaagacggtccccaggtgactgcaggattgttttaggaaaataataagtaacttaaagttagctttattgaaagtcatttttgtagcatcaggtttactgaatcaagcatctctctctctctgtctctgtgtgtgtgtgtgtgtgtgtgtgtgtgtgtgtgttagaagatcatggctgcaacaggactatgctgcatagcttggagacccactttcagttacatcagtgatggtgctgcttatcttctggcccttaggaaatgctgcgtcttagtaacatgatcaaaatccagggctgtggaatctgtgagctcacccctttggagggcagggctgtagaaatatacataggggccagtgcggtggctcatgcctgtaatttcagcattttaggaggccgaggtgggcggattgcttgagcgcaggagtttgagaccagcctgggcaacatgatgaaatcctgtctttacaaaaaaatacaaaagttggtctggtatggtggagcaggcctgtagtcccatgagctaccacagtcccgtgctacttggagagctaaggcagaaggatcacttgaacctgagaggttgaggctgcagtgagccgagatcgtgccactgcactccagccagggtgataaatgtgagaccctgtctaaaagaaataaaggaaatagagataggacttaggatgtcgtatcagggccgctgacaagactctcctcagaacctagttgatacaccatgcatatacaatcccaaacagccaaaaagatcttccaaaattgtttggaatggcatacttctgtaaatgggtaagtataattaaattctggaaagatttagaattaaacatataaaattttagtagaattagagccatagtgttaatgtttttgatttaaaggatttatgtatatttgatatttcaagtaattaaaagaaataatttggcctaggtaacagatcagcctgtatttccaaattaaaatgtacaatgaagtagctcatttagacatttgatttgggggaaggttgaaattgtactagttttataagcaacattttagtgcatttaagataatttattaggtttctaagacttgtttaagggaagattttataatttaaaaagcaggtagttctaatatttaaaagaaataattacttattcatggcttgaaacatagatgaaagaaagaacatgggtttttgaaaagtgagcttgctcatctgaaaagcaaggacatgagagtgaagatgagctttcaatgaaataatgactacagcgtaatgcccaggccacagtactcagtaaggacctgttgaagtcataatttttagaagtcactgaacaacaggatacgttctgagaaatacgtcatcaggtgattttagtcattgttagaaaatcgtcaagtgtacttacacaaacctagatggaatagccaactacacacctaggctgcaaacctgtctggtgttaactgtactgaatactgtaggccattgtaacacaatggtaagacttgggtatctaaacataatctaaacatagaaaagacagtaaaaacatgccattataattttatgggaccaccatcatgtatgcagctcattgttgaccaaaatgtcatcatgtggtgcatgattgtacttcagtcaaagtgtgagttgacactgtttaactccaaggggtgccatttgtataggctgtggtacacagtcaaatagggctgtcttggatattgattttattcattcaactccaagtgctgcaagaaattaaaagttagtcaggttatgtgtcacatctatcaaggtattctgtctgttttcccagaaaataaacaagtttgagggtaggagacatttttgtcatctggacaaggttcggacaaaattgtatgtaatacagagccctggatctatttcgccttggccgctcaaatagccctgaacaggatgcacagtgaggccccaggttggaggatgcttggcttgtctgcagacattgtcatttagctctggcttctcgtaattaggtactcctagctgggctctgttgtcagcgagccttcaagacaaattgcaaaatctgtacaaccatctgagagatggagaagtagatccaatgatactacaggggatattggtagttctcaaaagtttgaaagagaatgcttagaaaagcaatcctcaaaactgaatttagaggttcttgtcctgtggtaaaagggttcacaggatctgagaagatcttgcaggcaggaatgatagactgaatctaaggggatgaaatggagtagaaaaaatgtaaggttctgttttgaggtctgaaaatctcagctatgcattaaaaagactggaaacaggggtagggacatatcagaagacgagcccgtatgaaaaagacctaggagtttaagttggcatatattgataatttattgtgctccttaaaaatttaatgcagtgtttggctgcattaacagaggtagagtatttaggatgagagaggtaataaactgactctgatgctatagcaggagcactgccacagttctggactccaagctttgaaaggaagacagacaaaggatggtcacaggatggtgtgtgggagtgttccaaagcttgtcagataacaaagtaacacaggaggtttagcttgtgtacaactccaagaggaccccagagctgctgttaatatctgaaaggcagttaaataaataagggactggacttcttgttaagaggaacaggaaggatctggggatgaaagttaaagcagacccccaaaaggagggtcttcttattcttaaatatgttctaagatagaatgggctacttcctcaattttagaagtgctgactaaggcttatgaggactttcaggaatgcgaatggatgacctaggggtactttctagcccccagatttcatgattcctttgccttccagtgatgaccatgtcctgcacagtcccagcactggcaggtggtggacagagccatgactctaggacattctaggcagtgatgagagagtcttcgcaattctcagacaagatttccctaaggacattttgatgttcgtcttcatcagtgtttccagttctttactctgctagggaagatctgggggatatggtcacttcctttcagcagaggctgtgttatttcctcattcattcttttctctgtgcccagcagtgtgctaggtgctagggggacattgaggaagaagacagagttcttcccctcttcaagtatgcagtatatctgggaggaagtaagacaacaaacacaaattttacaactaactataaagttataaatacagttacagtttgggtacatcctaggaagaagtacagtttttgccaccatgggggtgtagaacaaggcaaccaaacctagttgggcaattagagaagacttccccaagggagtgacatccaagtgaggccttgaaggagaaatagaatctagcacaatggtctcaggctggtgaagcacatgagtgaatgccacagcagcaagcttcagacttgttcttgaccaaaggaatttttcacaaggatagagctgagctgatacaaagccagccaacagtagtgctatgaaatggtggttttccatttactgtagaaagtatgtagaaataatttcagttcctggtattagagcaagttgaagtcgtaaataggacctgcttagaagaacccatgtcttgtatgagtggtttttatttcacgtggtattttggtaatacattctctgcttagcttctggggatattttttcctatcatggttttctgaagtcaggttgtctgagacttctcagtttcctggtgggatagggctagaaggtttttgtttatacttttgggcattgttctttccccagaaggttatataacttggaggagattgagtcatttttttcactgactacctttagggggtgtctgccttcgtactgttagcttcttgtcattgtccggcttccgtggccacagcagctcgttcgttctcttgtggctgtgattttagctggagtaaactatgagtagaaacttgaataagaaggaaagtgaatatgaatgtgaatatgaaaaaccaaagactagaagagaactgggtttgtttagtcccagactaatccttgtctgtatttgttgcttatatgagtgacccaccacccacagcatacaaacagacaaaaaggcacatcttaaaaagataaatttcagctgggtgcggtggctcatgcctgtaatcccagcacttaaggaggccaaggcgggtggatcacctgaggtcgggggttcgagaccagcctgaccaacatggagaaaccctgtctctactaaaaatacaaaattagctgggcgtgatggcgcacgcctgtaatcccagctacttgggatgctgaggcaggagaatcacttgaacctgggaggcagaggttgccatgagccaagatcgtgccattgcactccagcctgggcaacaagagtgaaactctgtcttttttttttttttttttttttaaaaaaaaggataaatttctattcttagatgctggtctaagttcaaatttaaatgcctttcatcttaatttttcctagtaaacatttttgcagacaattgtgctgttttatttttctagtattagtaaacacatagttgtaattttaaaattcttgattctgaattttgttttttgctttcaagggctttgttggtttggtgttttggtaacccacctcatggtaaattcttctttctttcaggtaggaatgaattgatagccagatacatcaaactcaggacaggcaagacgaggaccagaaaacaggtaaaataacccacctggaaattgtgcatgtcagcgaatggcccaaaaaggcattttggctgcagtggctggctatgctttggctcctaggagcccccaatttgagttccctgtaaggacgtcagtgttggaggtattttaaattggctcagttttcactgttcatcatttcagtgaccctttattatgtggtcttacaagttccttttatactcacatgggaaaatgtcactgctaaggacggtgtatgaaccgctcctgtactgtatttcaaagctgacatttctttcccaaaatgtgcacctgtgaacactgcaaaaactgcaagtgcaaatgcacttgcaggtcatgaaattttgaggttttgtgcattgtaaaatcctggagcgattatatattagtcataatttcaatgaaaaagtaacgccagcagccttgagtattggcctgaatgtaatgctaaatgatgtgcgtccagggaactgttgctttttaagcgatggctttttgtcagtagctgctgtgactgaaatgaagttacaacttcaatacctctgtgcagagcagtatcaggaattctctgccctttggcagagctctgcctttcctcgttctttcagatgtaaaacagcccaaatctctgacatgagccagtttagaactggaacgaatgagaaattagtgtttaactaaaaacaaaaaaaagaaaggaggaaaaaaaaaaccctaaaaacctcatgggtgagttgttcacagaaaagaattattttttaatgtcgatttatgctgaatgatacagcatgaaccttaaaaactgtaatcagaccaaaaggctaactaaaccgtggtctcattaagattgagcagcagatttcagttctcttcccagtgaggaattgttttcatgagtgtttataacggggagaggcttttcccaggaatgctacttgtgccacagcctgggagcctggctgctgagtcagcacaaagagaggtggcctcctgccagcacgcagaggcagcgcattgtctgtttgggggatgctagtggccctcgtcaagtcagagaatcacagaagaacaaaattcgggtgaaaacaagtaacagcaggagccagatggagggctgaagaggatgggggagtttctgcttctctgtacttaagaaaagtaccaaagcaaattggaaaaaaaaataattgaataattgaagctcaaagacaaagttaaagataaaaggaccgtttattataaatcctgttttagagccgctggagagttggaaatggggtaatcaccacacagtctgagtcgctgaacttttaaatggaaagttctacatttcggaaaccagtggatctaatcatctacattctgacagtgcgggacctgggctgtctgctggtctgtgagctctggtcatttgcccggtgaccccttcactgagggactcttctaaatttaaccaagtcccactgaaagagatgcagatttcagtggaatcattgtgtttcagaagctgggctcggctacatttccacgccccggcatcctggggatgtttttaggcagcagttggtgatacctctccaatgtgaatttgttgttcagcaaatccatgtggttttcaacccagatttttaacaggatggctggctggctgtattcacacatttcgctttgtaataatatgcaaatccacttggcgcccagtcaatacccaaaagagtggaaggattaaagatttttataagggcaaaaaaaaaaaaaaatagctctgctaactgggtctttccatttctctttgagatctaatttacatgtcagtattattttaacgtttgctacagaatccagagctcttaatgagatcagaatacaaccaacagcttcagctttttgattctgcagaatgtgctaatttatggatagtctcttctaaattgagaaaaagggattttccctcctgatactgagaagctataaatattttcatttacctttactcccacctttttaattttagaatgaaaacagcccctctcatccctcccaaaattagtttttcccagtgcccatgatttctcttgggtgggaagactaagatgagtcttaactttcatcctgaatcaagtcactgcagtgatgacccagtatgaaaagcttagagcagcgctgggggcttgtgtctggctgggactgtgtattcctaactgcagagctttgttgagatgcaaataaccaccccccaaccccaccccaaaaccctcccaaagagtagcgattttatatttgatttccttttttgttttgttttgttttgttttgttttgttttgttttgtttcccctcataaacccgaacaatgtaggtgtctagtcatatacaggtcttagcaagaaagaaagttcgagaaattcaagccgccattaaggtacgtctggcttgcccacttgtagggggcttttcatctccatggttacaggcttttcctttgttttcctcccttcccctaccctgcaggtgtctagtcacattcaggttcttgccagaaggaaatctcgtgattttcattccaagctaaaggtatgcgcttttctgctttttggcttgtggttgctatgcatctcacttcctgttttccatggtgactggtgaatgcctggtgctgggattctcgtaacctagtttccttgcatgtgagagctgtttacatttctttgtgtttaatctctctgtttctgtactagcctcacattaaactcaatgtgtgtgagcgcgtgtgtgtgtttgcgtgtgtgtgtgcgtgtgtatgtgtgtgttcctaataacaatgcaaatgcagcagagagctggtcttgataacttttcagcacagaaacatgattttttttttttaaccttcagatgtccaccaagcagccatgggctaggaaagcttaaaaaaagaaaagtccagagatgcaaaattgagtagaaattatttagaaagaatcatttccaaagtggtcatgaaattacctttttaaaaaatttagaaattattttaactcatgcttttgatgtatttttaagaagacttataaaaaatacgtctttttcatgcatgtctcttccctcagagtattttcagccagatttcttccacattgcttactactgttttttaagtgaatggcgctcttattaaaagagaaatctgagcagtggcctttaaaaaaaaaagatagatcttagagatgggaaaactcttgatcaaacccatttgcagtttcatttgtacttgagtttgcttaaatttttttttacttgtacctcatttttcagtctcaaaatatattttataggaaaaatgggggcattgataatttttcatatacaacttctttctgctttttccctttataaaatttataataaaacatacctgacttttatttttctgtaatgccctattttagaaatgcaaagagattatagtttgcaaggaggagctttcgtttataataaaaattgattttggcacatattgatggctttcccatgtgcctttttcggttctgttctgatatttttctatacagtaattaaatttgtggttttgttctgaactaaaaaacagtgtagtctcacaacacttgagtggtgagcactgggactcttcccaaagtccttcgacttttttttatgcaaacaaggctggctgtggaataggacaagtgattaggaaggagcatttggtgtgccctctgcagtgggcagcatgctggctcgctcgcacgtgtggctgatggtggctggcttttagctgcactggctgagcagttggaagactaagataactttgtagatcctgctttttaaccaaaggtgcaatactctctatatggatgtaactaccccagtttttgctcaagttctgactctgtttctagtttctctgagctaatgaattaatgatgtacaaagaagtttacagataacaatgttgtttccatctgtgatgatatgaattgctctatttctgcactgtctgtgtggttcctgtggactcaccagggcacacagccttagactgaaagccctataagtgaggaataaagctcttctgttcagaagggattcccatgtgatataggaagcactctttttctcacttggtgaattttagagttttcttccatagaaacaatttttctgttgctttatacatgtacatatgtaaaaatacacagcggtatttatgtttgtttctaaaaaaaaattaacaataataaaaaagaaacattcccctgactttcagccctgggccactctcttttggggcaggcacaaggaagagacagaaacagaagcagtaggatagcaactggctcagcatttaagctccaagaaccacctccgtcttcttgtagtttcttccgttctttcctaccatattgttcttggaaaaatggagtcctttgtttttccatctgctaataccaactgagtgttccaggcatggtgcttgctcactgtgatgggcagttaacagccaatatcctgttcagggagctggccatgtaaatgggaatgtaaactagaggagcactttgggtaatagcgggagcagccaaaatgaaatgtggggtgcatcccggggatgagcttcgtggagagtatactgttaagtttggcaattgaaagaggaaaggcagcctaatgcgtgctccctcatttaagctcactatgaagtgacttacagtattctgcttttggggcatgatactgaggaaactggggctgagagagtataattgactagtcacaaagccttcctagtaagtggtgaagccaggatttgaactcagatctttttgcaccctaaacgaatcattgttttagataaaattttatctagtgaaggtgggagaatgttttcaagcagagggcttcacaccagcacactgtacctaaactgtcacccctcacagtctttggggctgggcattcagcctttgctaccagcccttcacttggcatccacattttaactttgagcccttggtcaaaacgtggacttaatttgggttggtgctgtgagggtcatcagtaactgggggaatgacatggtcctggagacagagctgcttggcaccactctgagggcattaggacagtcgcagagagtgaggctgtctgtcacctgcttgcaggagttggtgctgctttctttcactccctccatgagcattttatctcaaaggcagtatacttaaccttcctaaccagccattaccaggatatgggctcaactctgttgatgtcccagctccatccatacccccttgttcagctctggaatctaatagcacatttgtgaggaggcagggacaagcatctttaccgaggtcatcatggggtcaggctgatagccatggtcttcttggcctcccacactagctagtgagataaactcgctacagataattgaggtcatcccaaaagacaacaaggatagcttctgggtgggtggggagcagaggggagtggcaggaagtatccaagcttaaaagagacactgtgctttgcctgggaagatgtaggaaggcctcctggagcaggtggctggtggctgaccatcccagtaactatccttgcagacactgccctagccaggttggttaccacttctccacaaactcagacgtcgaaggggtagacaaaggtctatggtcctcatgtgaagaccgaaaccagacttgcatttgtctgtccctctgtggagttggaaaagtggcttacccgcaatggaggccactgccagatgtgtcttcctggtgagtcttcttgcttataagcttctctttactttccagggaagggtgtggcagagttctttgggctggtgttttccagcctttttaaagtagcaaaactcatgttttgaattgaagcttactccctcaaatccttagtaatggcctcttaggctattccattgaatcaggtttgaaaagccccctgttttaggcagaaggaaaaggaggtgtctacctcttatgctgtcccttccagcctttacagagagctcctgtgtcccatttaaagcccatgtttttaaattctgtagttttgaagttctgccatgttcctaggaagaaaacagactccaggagagagtggtcatttgatgtcacattgatagatgagtcatcctagctacaaaagttactctcctgaaaatccgttagaataaattctaaaggtcagctttatgcttctactaattggcagttgttctcaatgtgcttgtttgtggactagatcacccccaaattgtgtagacttaaattttagtaaagaaaaaaattgttctagtgaaagtctaagatttctacgtagatttgaacttgaaaagcataggaatgattactgaattcagtccagtggttttcattgagaacctaagtgtgttctaggtccttttgtagacgttgggcacatagaattgaatccagagtttctgttcttgaggaacattgaacttttctgttatttttccagtagatatccacagctagggggctctgcagtagaaattaaacaggatagtgcagaggctgcccaagtgaaaagaatgattcattctgggagtgagggaattaaagcttcatggagaagtgtcattagaactaaacatagttgaaggcagagaatttccataaagttgggactatctgggggaccatgaagagcatcatgtaattggggacatgcggtgggaggtaagactggaggagcctaagggaagggccctcgattatcccactgaggagaagggattcatctgtgggcctaggggcatacatggggttcattcaaatttaccctctggaaagacctcgccagccaggttttgcaggatagctaataagagggaggccaagctggagtcagggaggctaattcctgggctgctttaagagtggggaagagagtcacaggctgggaccaggggccaacccacaccccctggggctgctccgtggcacttagcactcatccttggctggctccctgctttggtgctctctgcctgctctgtagtctttcctactcattgtgtttaaagaataaattataagttctgtccttatgaagtctgaaaagtgttgtgtgccagaacttttcagaaagattttcaatagcagcatttaaaaatcaacttattaaaattgggttctcttaaagtaatggtaattgactaggagtgtgcatcaaaattatgaagtttttgttgcaaaatttaaacagtacagaaaatatattaaacactcatgtttatactatctggaattgatcattttcattatataagttttttttaatgaaaaatcaagtggcaaacattattctgtactttttcctctacccaccctccgtcttcaaccaaaattaatcttcctttctttcctaccacccacaatgtattttcttgccacttacttcccttagaaaatcaaatccagtgaaagctctctcttctcattttgctcctagatttttgcccattgtctttttctttttcttttttttttgagacagagtcttgctttgtcgcccgggcgggagtgcagtggcgccatctcggctcattgcaacctccgcctcccgggttcaagcgattctcctgcctcagcctcccaagtagctgggattacaggcgctcatcacgacactcagctaatttttgtatttttaatagagacggggtttcaccatgttggccaggctggtctcgaactcctgacctcaagtgatgcgcctgcctcagcctcccaaagtgctgggattacagacatgagccactgcgcccagccgatttttgcccaattatctaccatgaatttgtgcaatagccattggcaccaacatgagacttttcctctggaatttttagcagcttaagatagactcggccaacaatttggtgaccttggatacagaccctgactgcagaggagagatacgaggttcaggacatataggggatggttgaactagaaagggaataatgcgaggagacagtgaaccaggagcagagaagctgggagagtagagacaaagcgtcagtagactgaagctgagattcaagagctcggtaagatggaaaaaagaaaaaaaaaaaggcatttgtggccagagcacagtgattttggaaattaaatttatacattcagagttgtggggattttctcccccgccccccccggggttggggcattttcaaaatatctaggacaaggctgggcacggtggctcacgcctgtaatcctagcacttcgggaggccgagatgggcagattgcctgagctcaggagttagagaccagcctgggcaacacggtgaaaccccgtctctactaaaatacaaaaaattagccaggtatggcagtgtgcaccggcagttatagctacttgggaggctggggcaggagggttgcttgaacttgggaggtggaggttgcagtgagccgagattgtactgctgtaccccagcctgggcaacagagcgagactctgtctccaaaaaaaagaaaaagaaaaaatgtctaggacagaagctagagtacaaactgcaggcctagaagagagcttagctttgaaggagttgtttcttagtgatgggagtgctatgtgtttgtctcctactcagacaaaacccttttgacccactgctctcaagggggtaggttttatagatgacccacagcctgtagctgggcctgagtctacttctaaagtagaagatgaatccatgcagttgcagtgtgaaagaggcttctaggcctatggaatatccatttaaaaatcctgaggatgctgagttagaggtctcccttggaccttgtgtcaccagctgcagcgacagcagtgtcaccaacaccagctttacctgttgtcttccatctcaccctttcccttagtttagcccctattggcgtctccagtggagtagtgagaagcagcagcatgtctgaggattagctcacagccttagaaattattctctacttcgaattgtttcacttaccattaattcatgaaaaagtcattaactgtttttttaagctccagggatttattatcccagcatgtagaaagaatgcagaagcattctccatgtgttaagcagtctttttcctactcagagtttctttgtagagttccatgcaggagtctctttgcctgtatgttcagttgccctaagaagttgttcagaccctgctcagagtccttctttccccattagcagcaaaaaggcagtcctttcttgctgttttcagaagctcacggtagccacagccaaggtctgggaagcaccaccacactgtgggccatctccatcttcccatgaagatgggccaagccacctctggttcacttctcgagtgtgtttaggtgagtgtatgactcgggacaaaactaagaggaaaggaagtcttcgccgtgccctccgctcggcaggaatacatcttaggcagtagatgtattcacgtcaggctctggatgtgtattgaagaaaaacctgtacttgctgacattgcatcatcccagtagagcagaaagagacctgagcccctctgattatgtccagtcgccggtgactaatttatgagctacatgtgctcccccggggccattttcttgttctcgccctggtggcctttatgatttgatttctgaacaggccattctttccaaactgctgttccttccaataggcagagagcttaaagttcaaattgttgatttaattcttttgagttcaagaacttcactggggcattgctaaagtccacactgctgaatcatgtttgtatcatcactgattccatccaggaatgggcctgtccacagggaaggtagacgtacttcacttcactctgtgttgctccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatataatctttcctggcatttcccaatcttcagggggagttcttttgcatttatgacatatacgctttctcctcaaagatatttttattaccttgtttttaatttaactgaacgaaaactaagattggagacaatttctcaggcttcagttggaaccacttgccaacagtgtggtgatggagaaattaatgatgggagccagggcactgaatatgtagataaagataattctgtgtgaactgagccaggtctggattttctttataagggcaacagaaacagtctcatcattctacatttttatctcttcatagcgaaatcccattgttaattggcctccaacttagataatgccctagaatgacatctatccaaaaggttatctagtgaggacaagggctcctgagtatttcaggtcccgagcagaatccagcttggaaagccagtccattacctggcccccgtagactgcaagctcacccagggccaaggctgcaagcaccatactaagtacttgaagcagtcctgaacaaaagtgtttttatctttgatttataaattaggacacagaggcgtggaatggctaactggcttgcttagagtcacaagtctgaagttaatccagggatatctggtgccacaagccaagctctttgcaggatgttcttctgccttcccaaagagtactggtccaggatgaggttcattttcctgacttggaatgctttgcattgtctccctccactgagccctcttcattgtgtctttatgtttgaaagaaatagaagaaggactcactctggagcttaacttgagcctggagccagtttaggttcctctggccccttgctgtcacctcttagagaaaagggggctgaggtcagaagggtgccttctcccagacacctggatccggcaggaagctgtcctaaatcccaggcttcctgggagagagtcatgaggcacacctatgagtttgctcgtctgtagtcctcatctacaatcctttatgatgtgaagccccacatcagagttaaaggaaacgatgttgacaattataaaataccaaatatagctgagtatatttaaaaatgaacaatggtaaaagccttgaaaatttttccttggatgtgaatggagtctttggcatttggaaatacaataaaatgaattaattgctgcttattaggcagcgagtcaggagaagcatgaatgtgccttctgtcctctgcgttagctgttacctgactgaagtagtctccttttgtatttactcctgccttttctaatgataagcaaattagagatcatagctagaaaaaaaatcaagtgccctccatcctttttccaaaaccataatatagttctgtgatgtttatctgctcaaggggtatggctaataattgcagaggtcatgtggagccacatagtgcaagattagaaagaacatctgcaagattacttcttaggaaagtattttgtgttttgtctttttctgaaaaagtgattgtgcaagcaaattgctgtctttcctcccttgcactatattgctggttaaagcatatttgaagaaaaaccatttaataactatcaagagtttttgaatccatggtcgtttttttgactttactattttttctgacgtatttgatggacttctatatgaataaattacattggaatcctatctttaaattctgaaatcatggcccatgaataaactgtttggaatatattgattatgctgttcattaaaattccatatatggcagctatcatatattgtatatgcaagcatgtaacctttttatgttatctttaaagtttgttcatggtaatacctatagaatatgagataattgattttgcagaataatcaaaagctgagaagcagaaggaagagaagggaacaagactcctctgatatccagactgatccgtgagatgtccttgagttttaagagtacaccactccagccatgtgcatttgtgatattgctgtcctcctgtcatgtatattacatgtagatattttccaaacattgtgtccatttcaaccataaaaaggaggcaatcagcagaacagagagctatagcagcagtagccttgctctccttcatgaaatatgaaagcctgtttttacttagaacaataacaatttgtaaggcttcaggctgaggagtttatgcatgacacagcctgctggaccatgtagcagaggcagcgagaccattgagtgtggtgtgttggaaattggttaatgataaaagtagggtagatgatgagacaggcatcccgagtctcaggtcagttggaccgtttgttcttagaacccatcctctttcccatcaaaagtccatagaccacccatagttcctgctccatgagtgttttctgcattgcaggtcatgggcttgggttggggttcagttggaaaagggagatttcccttttctttccccactccccaaaacatttggctttttatgtcctcattctttgtaatcttagggatagagggacggaaaatcagcaataagtagtcagtgtgaacttgtccaaacatttttctaggatgcaattttcttattcttgctcatatgcacacgcacgcacacatacacactcagaatatttcctgtaacctaagacttcacagagcataattccgtattaacctaacagtttttcagcatcaaacaatgtgctcacctttgtaaatctcatccacatctcagaaatgttggtgtgaagacatcttaaaattagtgtggtgtacaaatgtagcatgtgtttgaatttacctagcttcgcttgtttggatagattagcctcctcccctttagagtgaggatgagtagtgaggatagagtcgaatgctttaaagtctgggatattaaaccagagtgacacagaggagcagttcactcaggtctgacacttagagttattttttcaaagccaggcaggtatctctgggctgcaaatgacaatttagaggtccttccattgaaatctcttagcttggcattctttcaaattcccgtttcaggataagtgggtctgtaggcagacccttggttctgatttcaagatatccctggtggtgcttattatttccagggtcacattagattttaaacaaaaacattttaatccttttaattttcaatatatattgtagataaaggggagatgttataaaaattaaatgagtagtcagagtagctcgaccacaaaaggtaggaaatcactggtatagacattttagtccatttgcagaaaattgcctattctcaaataggtaggtcaagtgcagaaagaacctctacttgagatgaaatttcctttctacacttagctttctattaggacagcagaccaaagctgcccaaattttaacatcctgctgtcttctcactagtagtttccttgactatatgcattgaaaagtatctgtttataatggaatttaccctcatagctacaaatacctttaaacccagaaggacattaggcagtaatgtgcaacttttaattttataaataaagaaacttcgaagtcattaaatgacttgatccacataatgcagctcattaatgtcaggcagggacaggtttgaagccaggtctccggacaccccagtgggtacaccttttatagtcttggagcaagttggtgtcataaaagcaattgatttgctctcctgctcttgaactcctgttttcatttaggtacctggtagaatgctgggtaatgagagagtcaaaccttactttaacagaagaaaaagatcatgttctgaagctgtgtgacataaacagcaaagataggtgcttttctccttttccacactgactgatttccgtttcaaaaaagaatatcaaacttgtttgaagatttcaaatgatttttaataagcctagcaaatttcaagcaactcaataaagcgggatgtggagatgcagggaactcatttggacctggacttagaattcatgagtcaccccacccaagtgtgcacaaacagattctgtatttgggcaagcagaagtgcctctgtctgcagaatttcaaatacgtggaactcttcgggtctgtgagaggatccacgatgttcttctggaatggagccaagccctcaagttcttttgtagctattgctcagatgtgtcagtcaggcaggcaagacgtctgtgctgccattttccaatccccctagcctgggccccagagaagttgtaaggcttgttctgtgctgaggaaggcacctgtggtcatacctgagccattacctcagtttcagaaatctgccttgagagcatttataacccccttggtagaggttgagtggcttgggggctggagtccaaagtgactggtctaagagaaaccaatggattcgtattgatgtcagggtgatgttgatggggaatggagttggtgtgactagggccatggtttctgttcatgggctaccctctgaggggatggacaagcgaggagcaggtaaagccacagaatagccaacagtagattgcctggcactgaggtctgcatgtgtgggcccagtttgtcagtttatcataaaatcccatacacttcaagatttgccctctttctggcatcctcagtatctgacatgtttcaaatcttaaaaaaaaggttagttgaggaagctagctttaggttagaacatttgacagattagcaaatggagccccaagtcgaagaactgccatctgataagaaggagataacagcagcaaaaggatcattctgagtcactctggccgttcttttgaggcccaggaatcctgccagcttctagggcccttggagtgtcactcggccacgggaggtgtcattacagatgttcataatgaccttgagcatccatgaaaagctgttacttgaggctccttagtttttcagtcacagccagagtaatatataagacataaaaattaatgtggctgggcgtggtggcttacgcctgtaatcccagcactttgggaggccaaggcgggtggatcatctgaggtcgggagttcgagaccagcctggccaacatggtgaaaccccatctctactaaaaagacaaatacaaaaattagccgggcatggtggcatatgcctgtaatcccagctactcaggaggctgaggtaggagaatcacttgaacctgggaagcggaggttgcaatgagctgagatcatgccactgcactccagcccgggcaacaagagtgaaactccatctcaaaaaaaaaaaagaagaaattaatggaagtgttaggctccgttttctttttcccccctcccctccctttccttttttcctcccttcctccttccccttttctccctcccaccctccctttcttccttccttttctccttcattctttttttttctgatggagtcttgctctactgcccaggcttgagtgcagtggcttgatgaacacagctcattgcagccttgacctcccaggttcaaacagtcctcccacctcaggctcttgagtagctggaaccacagaagtacaccaccacacctggctaatttttttttttgtgtgtgtgtgtgtggagacagggtctctctatgtaacccaggctggtcttgaactcctgggcccaagtaatcctcccacctcagcctcacaaagtgctgggattataggtgtgagcagccacacctggtcttcccctttccctttttctttattggctctttttcaaaggttaatgtaagctttttggaaattcacattgtcttcctgacagttatagggcaaagtagtatctacaccctgggaacacctagcacatctttcttagaagcccttagcagttgttcatgagctttgattttttaaaaactcctttggccttgcttttgatgccttgatgtgtttttttcatcacctttggttatatcagtaagcattgaagcaccctctctgctggtacttggtgtcttagcctgaagctccctttgacgttccctggaggtggaaagcactctttttattttgatgtcaccattttgtttttgctttgatggcatttgggcctggaatatagaccctctattggcaccggtagcctttatatgcctacgaggctcaaagccctgcctgtgcccaccgggcctgtctcataccaggaggctatttctctgtctgtcctggggaagccacagaaccagtgcaaaggagttgaggggtagttttttattgttgctgttgttgggtgcccttctcaatcattgcctttctagatagccatctggatcaccttttcttcctaaaatgtgaaaaggcccacacccctatgcattttattgttcccaagtattatatgtttgtgtacatatatacatatgtatatatacacatatatatatgttttttttttaaccaaagaagaaaaaaaatccctttttatgcaatccttttaacaaattgtttattattgtatccaggtaacaagcatggtaagtattttcaccaaactgagtattctgtattttagctgtgcttggcagacttttttggctagctttgtgttgttagccttggctttcctagaaaagacccgttcaggaaaaggagaaaccacgtacctgtagcatcccctaggctcctggcttcagtacgaacccacgtagccttagccccacggcggggatacctgagaaagcatgcaccccgccagcatgctgcttggccctgttacccccaacccccgctgcttctgagcctctccagccaggtgtctgcagggcttccaggccttgcatgaccccagcagctcctgggaccatggccctgtgacagtcaggacacacagatagggctcctcgagctctgtggacggtcctaccccagtccacagctacatctcttctctcactcctcctcccatccgtttgcttaaaagcagggcctttatttttttttcttccttaaatgttttaagtaattggagaaatcttctggaagctgacaagctaaataaatacgttgtccactcttctgagaggcttcacattctgttggaaaatggatttaatccctaaaaaaagccttgccccattgggtcttcccagtaaatgttgagaggtacggtaggttgagtgtggtttagccttctggctgtgttatttatccatgcatgtttgctttttttggcctattttgtggctctgtattttagtccatgtgctcgtggctgtgcctgtgtaacctgcctggtagccatgcgttatgtattaagttggtgtgtcactgtcaccttcaaggatcagactgcaaaggataaggccctgcagcacatggcggccatgtcctcagcccagatcgtctcggccactgccattcataacaagctggggctgcctgggattccacgcccgaccttcccaggggcgccgggggtaagtcatgagctcagtccagtaatgacagctgctggggttggggttggcatgtgccagtgttaagcctcccacctccatttcttgtcatgtgggtcaggtatgtgagagggcaaaggctaccttgtcaactgataactgagtctaaagtggtgaaagtaaggagggaagggaggcagagagctagagagaaagggagggggaggagaaggaggaggagaggaagaaaagaaaaaaggaaaaggaagagggagaaaatcagaagaggaaggaattctgagtccctgaagacatggaattaaatgtgcctttctgggttgggctcaggcgtcttctctctttatctttttcctggcccttggtctctgtccctctgtcttcaggggcaactagcccctaaagggacaaggtattctattaacatttacattttgacacctaccaaaggctgagaagcattatgttataatctcaatcctccaggtaatcttaaatgctgcttattgtcattgccattttgcagatgaaaaagctgaggttattcagtagcaaaacaagagtttggatagctgggatcatagtggaatggatagtgatgtcaagaatcagccccagggttgcttgactcctgaggctgctctttccctcctctatgtcatgccccctttccagcccacaccaatcgcagcagggaagctcgctgcagagaagctgcctgcattgccgcttggagctcctggccttgttcaagctttgtcctctgccttgctgggtcttcactgctgttgacgcagaatattatgcagggaatgtttcagaatgaagggagggtacatggataaatcagtcagttcaaatattggtgagccccctgcagcacgcgcagatctttgcttaggtgtaaggaaaacaggagctgctgcctgcgtctgcccttgggggcattttcaggaaggaggcgctaaggggagctctgggttgccagtccaaggatataggttgtggtctcgtgcaagtggtgaccgcatttgcactctgggaaagcgattctgttgggtgatcgaacctgctgtcttttagcaggggttgtgatgcgtaggcatcctaaactgtgctttgaagtaaactcgtaattctgaggcctttgcattttgccttccagttctggccgggaatgattcaaacagggcagccaggatcctcacaagagtaagtctgaggaggggtgggcactgacaactacgggctggtcccagcccacgtggggagagctcttcctggaccatagtgtctcagggcctggaggagaaaggagcattacactgaggtcccagaaggcatcccctttttattgtgtacttaggcccctggcaggaaagagactggcttttcggatctgggagaggtggaagcaccccattcccaccttaagtattagcagtcatccagctggaagcaagaagtggacccctcttccttcatggtattgaaggctgagctgtggtcctccttgcctgagaaagggcggcacaggtgatcctctagcccatttcattctagccagccctgtagtaggatggctagtagacaaatcctactgatgccttgggggcaagagaagaaagatcagtaaactggaaataagggctatttcgggataaaagaaaggaaaccttgcctatatgctgtaaaaaaaaacttgcattgtttggcctagagaaggagagcctgaagcatgtcccacactttgcctagaagtggtgactgcttgacctcagaggttcaaaggcagatgccacagcacaaggaattcaggctgtctttccagcacatcccattgaactggaatgaggcttggtggtttgatccctacctggctgctggtccctctcagtttatggaacaactgcctctgcctggggtgtgctaccacctgcaggcagggaccacagcggtgaaggacctcccactgggaggtcatggtggggcctgggtaatagcccctgctgcagatgcgatctcttaactctgtctgccatctctctgttcccagcgtcaagccttttgtgcagcaggcctaccccatccagccagcggtcacagcccccattccaggtgagtgtccctgaaactcctttttgggagcacagccccacacagctgacagctgggtctggcactttgttcccagagtcaagagatgctcaactttgccacagccgcacattgcccctgacttgcaggatccttgggtagcctgtagctcaggagggccacagggtcccgattcccatcagtcatctcccaagagcttttcagatggtttgtttaagaaacaggaagcctcctcactttcactgaagacgctggattatcctcagaaggcgaagttgctgcagcatcttcctcaatataaactggccaaattaggcagtctaagtctcaaggccagatagggtttcattcaccctttcttagataagtagatttcggtcctgctacctttctttaaaggagagagtacatggaagctcaaagtggaaaacatgaatctgtctagcctacctgtctccttccccacaaggcgcaccccccatccccacctgtgtgtgtagaattactcctttgcactacttgaggtgtacagtataaaagtcactgctctcccttatggattccccaaactgaaaatgctttcacgtattgccctgtgcccgagtgctacggagcattcagagagaatattctatagtgctagtgaccacagtcttaaggaagatgggcaaacacaagaagtgcatggcatgttcgggtctcacaggaagtctttggaagcattcacttctcactgtcctgtcattcttggcttggtccccaagtagaccccttggtgcaggattagatgtcctcatactgcagcccttaaccttagctgaagttggcttaatgaggaacacatgctttgtgcttatttgactgtttaccatcactggggccctctgccagcatctgtcgtctgagttatcctggccagagccggtggagagggggctgttggcatttccttctgggtcatctgtagagccctgttccagtatttgcctgaggcccaaggggaggtgagtgaccagcatcaaaggtgacgattgctctttcagggtttgagcctgcatcggccccagctccctcagtccctgcctggcaaggtcgctccattggcacaaccaagcttcgcctggtggaattttcagcttttctcgagcagcagcgagacccagactcggtgagtgtgcccagagaggtgtgtcttgaatccaggatttctttccctttactgtttacctccttgcttctctttctttcctcctttaccccgccccatgcctgacaaatatcctgtgtgaaaacgggcctaggaaagaatagccttttgattaagtaaaaagggattcctattggcagatttgtagaaaacagcagagcaggaggtgtattactgtcctggaccccaaggtgctgtggggaatacttgagtcagagagagggacgtttacaagctcttatgttttgtaaaatttaacaagaagtaacatttattgagccttgccatatgcctggtcccatgcagagttatttagatatatgatcacaattcatcctcataaaaaccctaggaagctaggtactaactgacaaatgaggaaacagagagcgtaagtaactttcccagagtcacacagttaatctctgatggattagagattcaagctcgggtcctgaaaactctaaagcctaatcatttagctgttattccatactctctttccaactctgttttctcaagatagcaagttgttctcttcttaagaacaacttcttaagaagaagtggccaggcatggtggctcacgcctgtaatcccagcactttgggaggccgaggcaggtggatcacgaggtcaggagatcaagaccatcttggccaacatggtgaaaccccgtctctactaaaaatacatggccacgcacatgtagtcccagctactcaggaggctgaggcaggataattggttgaacccaggaggcggaggttgcggtgagccaagatcgcgccactgcactccagcctggcgacagagcgagactccgtctcaaaaaaaaaaaaaaaagaagaagtaacaaaatggcactttagcagtttgccatagagtgcagtgcattataatatcataaataccagtaacattggcatctggactctatttgtcactttcttctttcctacctcccccacccccatcttgtacccatcgtcccattgtttctcagccaggcatttcccatacatatgtgatcctcccttctttcccacccaacaagccccgtaccctttcttcacacccactccttggctgtgagtatgagcgttgcatctgtgtgtgggtgagcccaaggcaaaaactgaaggaatccttagtttgtctctgagatcctcaccaactctcaccacgttctctatctcaccccatccttcccatctcataagtcccatgctgtctgtgtgttgcctgccttaatgtcatttctattatcgggagacagtgtcaagaatgagctaagagcctgtggtagataaccgagatgctgaacaattggaggtgacctctcacgggagtgtttgcacttcagcttgagggaaggcctcccgtggggcagaggggcttgaccagtcatcaccagagtggagaacccacatgtggcccactcatgtctttgtccacaaatcatgaactttgggagctggtggaaaaatagagctgcttccaaattagggggaaaaatgagggaaggaatgtaaattgggcccatcaggacaggtacaagaaaatggggctattcagaccaggaaagagaagaaaaggccaactggatgactccttccaagcagctgagtggctaacaggaagagtgatggtgagggttaaatccgtctaggtggaaggcattaagacaaactgaaagatgccctgcgtgactctgtcctgctggttctttctgggaagcatacatagttctttggttgaaggctgggctttggcccagatgctgcttctgcctcttgtaactggtgtttccatgacactttgttgtttacagagtactttgtggttgagtatttcattctgtccttacagtgccccatcagataggttctgttttccccatgataggttctgttttccccattttacagataaagaaactgaggcccagacatactaagtgacttaagattaaacagaaggaaacaggagcccaaatcttgtatttcattgtatccttttcactatcgtaaaagatcacctcccagttttgagggtctcttgaattgtctttttttttttttttttttgagacagcgtctcgctctgttgcccaggctggagtgcagtggtgtgatctccactcactgcaagctctgcctcccgggttcacgccattctcctgcctcagcctcccgagtagctgggactacaggcgcccgccactacgcctggctaattttttttgtatttttagtagagacggggtttcaccgtgttagccagggtggtctcgatctcctgaccttgtgatctgcccgcctaggcctcccgaagtgctgggattacaggcgtgaggcaccgcacccgggcttgaattgtcttttcagtctgaatatctcctgtgtaagcaaatttctgtttgcatatgactgttttttaggaaacagctccaagacactgggaggcaaaagtccccacatgatttttgcttccctggttaaaatactatggaatcatttataaaaattctctttttttaaaagaaattaaaataatgtggtagctccctcattgttaactgtgctctccagttatggacctcttagggcccagaaggctcgattgcctctttttgttgttagtatttgttgggctaaacattttgaatcattcagaccattctgcaaacattcgtgtgcacctgcatgtgcaagaagctgtacaggagaggggctcatcgctgcccagacggccacagcctccgcccctggggagtataatgcctagcaggggagacagacacgaaacagatgattatctgagagatcattgcaaagtgctgtgacttctaggaaggaagaatactgaacgctgtgagtaacaggaaacagggcaagcttccttgaggaagtagcccttaagccgaaagatggaggattggacagggagagaataagggagcagaatattccagaggtgatgaagctgaagtgtatgtggcagtatattaaatcagtgactatttttggaaagtcaaggcccactaagttgctagagtagaggccagagataagtgtttcaggtacgttcaggatacatatgataatctgaatgggtaaactggatctggcctgctgttgttgaataaaaaagcttgacttacatagactccaccacatgacttaaaaggccctggaatgaaaggaaggcctggtgtaacatccttgggacctttgagaaagatagttatattttaggggatatgaattggggattgggagaaattagaatttatttaacaagtattttttgagcacctactacacgccagccactgtttcaggtgttagaaattcagcagtgaacaaaacaaagttctttttctcatggagcccacacttgggtggagaacacaagaactacccaagcacataaatacccagtatgtcaggggatgctaactgcttatgtggaataatggtcctttgtcacaactgatttttttttttttttgagatggggtcttactgtgttgcccaggctggcctcaaactcctgggctgaagtgatcctcatgtctcaggctcctgagtagctgggactacagttatgcactgccatgccccaaccttcttcacaattgaaagttacttgctttttggatttaaagtatataatttcagaaaataataataccccctaatagatatgttgatgtttctggcttgtattatgatactaagtgatgtgcattagacattaccagccagagctctgtcactgctgtgaaattattttgcctaacctcagtcactattgttggtgtcgcttctgatattcctatgttacaaacactcattcttcagttgaacacaaatgatttaatatatgcaaatgaatgtggaagtttttttgtttttttttttgtttgttttttttttttttggagacacagagtcttgctctgtcactcaggctggagtgcggtggcgcgatcttggctcactgcaagctccgcctcccaggttcactccattctcctgcctcagcctcccaagtagctgggactacaggcatccaccaccacgcccggctaattttttgtatttttagtgagacagggtttcaccgtgttagccaagatggtctcgatctcctgacctcgtgatctgcccgcctcggcctcccaaagtgctgggattacaggcgtgaaccaccgtgcccggccgcagattgttaataggatctatatttgattttagtggacatgtgagggcctgaaggttggttcttgtgctagagggaaaaagtggtggctgaccagttgaagtgatggagaattaataaaattatttaaagcatttgacagtatcttaagtaccagcctctcaagttatatactgtgtgctttattggacaaacacaacgtgctattacaatcaaggtataatggtacttcagggctaaggttacactgaaaaatttgtatcatgtagatagtttctttggctcttagagtttttgtgacttctcagactttaattttgctatagttttgttccaacaacagaaacattaaggccatctaagataaactcagctgatacattttaacaaatttgggcatacagtacttaaaatataacatccagcattaaccacattaatttgataagcgaacaaagtgaccaataattaaagggccctaagtaagttaaactttgcatttgaattctctagatgtttgttacagacagacatgtacatatgtttccccctacttctttgtaacggcttaggctcattagacccaaggggttataaaatatttttagtagagaagagaacttataggtagtgctggcaaaaaaagaaattatgtagccaggttccatgctatttgtcattagtgacttctttcatctttattgagctctgtgaggtaggttattctattcccttctacagaagaggcttggagagatgctgccttacagtagccagctttgcaccccagcctgcctgtagcatctcttaagacaagataagacatgattgctggctgggtgtgatggctcacgcctgtaatcccagcactttgggaggccaaggcgggtgggtcacttgaggccagaagtttaagaccagcctggccaacatggtgaaaccctatctctactaaaaatacaaaaattagctgggcatggtggagggtacctataatctcagctactcgggagactgaggcaggagaatcgcttgaacccaaaaggcggaggtggcggtgagctgagatcacgccactgcactccagcctgggtgacaagagtgaaactccatctgaaaaaaagacatggttgcatactttggtaccaccaaagccaagagaagaaccttagtttatctcctccttagtctgaagtggccttagaaccagcattttctgaaatttactcgttggctcaccacatatgtcacccttgccaacattgaagacttcctcacaaccccaccactcctagcaatagtgatggccaacatttactaaatattttctgtatgccaacactatgcattatcttatgtaatccttatgaagtagcttgcccagtgttagacagccagctgacatgggaagtaggattcagatccaggtctgttgactccacatcctgagatagtgaccaaaaggctatacggtccatttgtagctgatgagtagtctgtttttgtagcccagggccgtaaggagctaatgggagaataattagggggatgatcgccccctgctggctctgtgtcatgtgtaaaccagacggcagcttccccaagttggtggtggtttatgttggaggagaaccagcgagtcagtccctctgttacctttggctctactggaagctaagagaaaaacagcagagggtgaagaaaggaaggaagagtgtaaaaaacaaagactattttagttggaaatatactttctacatgatttcagtgttgcatatcaaaggatctcaagtgttaagtgtgatatcctccacccagggtgggctatttaaaaggggcctccctgaaatcagggtccagtttctggaggccaagttaggcagatgaaaacccggcctggctgagctgtcagctgaatcctgaaagtacacagggagtggttttcctgataaagcctggagtgatgcctccacctcaattctggggcacggcgggttcctccagccccccaccagggcagcagctggcaaacccctgcctgctcagactgcccggtcaccaggctgtgtgtctcatgcctgttgtggtctggatgccatagtgagcaggagccaggaagaaagcacagaaaggatttactcaggcgggagttacacaaccagaggagggaagagttgggggtggagaaagaggcaaagagattgttctctttagattttgaggaagcactcactgccttgcagaagagaagttccatgatacagtagaggaacaaacccgatcagggaaggcacacgtttgctcaacatatgaaactcatttatttttatttttatttttttaattgaggcagggtctcactgcattgcccaggctggaatgtagtggcacaatcacagctgactgcagcctcgacctcccaggctcaagggattgtcccatctcagcctaccaagttgctgggactacaggcatgcaccaccacacccagctgatttctgtatttttagtagagatggggttttactatgttgcccaagctggtcttgaactcctgggctcaagcgatccacccacctcggcctcccaaagtgctgggattacaggtgtgagccaccgtgcccagccaagcaacttatttatatattatgtcaataatgatcatcaccagcacttatgagctctgtattagtatgctgagcattatgtccagtctgtacataaaggaaccgtggctcagaaacgttaaataaagttatcaagctctacctccaaaaacggtgactgtgccaaagtttaccaccactctgtattcttaaccatgtcactgtacttttgaagaaataaagacaaagttcaaaagttaaaaacagctgcctgcaaagtaggagctccccaagcaaggccagacctctgagggccttccacattgggtagatggttactctgggtttcctctgagttcctattccaacccatggaaaattgtcttccacaaaatcagtctctggtgccaaaaaggggaccgctgctttagagcctatctttcatcatgctctagtggcagcaaagaggtgactgatactagaattcttagcagctgtttgagatttggggcagattaccgcagctcagcctcagtttccagtctgtcttaagtggacataacaggatcgctgccatgcttactgtgatgattacatttagtaatatccctgaacatactgagcactccacaaatgcttctgaacctgaatgtcttacagtaatgtgaaaggaaattgagccagagctctggacagggatcaagcttgcgagaatgtgctcactaagtgctttggactctactgaaattctaacaggagtcagaatatttttcaattacttttgagatggagttttgcttcgtcgcccaggctggagtacagtggcacaaccttggctcactgcaacctccacctcctgggttcaagcaattcccctgcctcagcctcccacatagctgggattacaggcatgtaccatcatgcctggctaatttttgtatttttagtagagacaaggttttgtcatgttggccaggctggtctcaaactcctgacctcaaatgatttgcctgcctcagcctcccaaagtgctgggattacagatgtgaaccaccatgcacggcctcaattagtttttaaaatcaattaaacttttcataaaggtagtaaattaatgtggtcaaaaaatctccaagcataagagaatggaagggagatgtcccttccttctcattcctatcctacccttaagtaggtagccactgctactattctcttatgaggctttgtagtgattttagtgcatatacaatctaatatgaatatgtattctcccaccccaccctgctttttaaagagaggatgtgatctaatttgtgcttcaggaacacgatggctgcatcaggtgagagcaggggctggaggaaactatactgttggccagctggtggctgatgaggaccaaaccagggcaggggccatggctgaggaaatggcagaggggagagatgttatggagataaaattaaaaagccttgtggattaatgagctgtgagaagaggaggataaatggtaatgactgggtgttggagaccaaggatgctgataagatttgaagagtcctggaacagaggaggaagcaggattgctaagaactgacttgatgataatgcttttgcctttcattctcaaaataagcttgttgaaatacctattagagacaggaaagctcagagagtttaagtaacttcatctgggacctggctaatagatggcagggttgactatttgaactttgtctgaatttcacagtgtatgagaaaatgacacttaccccactatctgggaaaatgggaagggcagggattgttctccattcacagatggacatttgatttgggctccaggacaggagagagttcctgaagggtcacctgggcttggtgatggcagcccctcagccagaaggaagggagttttgctgcctggtgttctggcccttatctttattccaaggggctggacctcctggacgtggatgtgggagttagcagtcttcatagtcagagggagcccaaggtctcccctctgggggactggcaggcctgtggttgagcccgcatggaaggtctgtaaatatatcctgcagataacatgattctttctcgtaaaggcagttggtcaaacgtgggcccaaggatgatttaatttcacatttttatacttctttcaatggcctaaatttacagatcaactaaaattccgttgtcagaacacagatcctttcttggtttggaaaatgtgaccaggacagctctaaggaaatatgacattaatgaggcctgtggaagaaagaagagggggatggctgtgcatgggggattaggttggagacacaagataaaaagcaaggtttcagccgggcgcagtggttcatgcctgtaaacccagcactttgggaggccaagcaaggcgtgtgggtcacctgaggtcaggcattcaagaccagcctggccaacatggtgaatcccccgcttctacaaaaatacaaaaattagctgggcatgatggtgggtgcctgtaatcccagctactcgggaggctgaggcaggagatttgcttgaacctgggaagcagaggttgcagtgagctgagatcgcgccattgctctccagcctgggcaacagaggagactctgtctcaaaaaaataaataaacaaaaataaaaaagaagcagcagcagtaaggttttaattcccgattgccaggagggttcttgcctttatcctgggcaggacagagaagggcaccggtgtctctggaggagcttcctagttttatagtggctgctgaggcagttgctccatcttggggtggagaatggctgtttgaacaaatctggttcctggtccttcagaaaagaggctccttctctcctgtaattcagggcttggaagtgatctcatgccagtaagccaggtcaccagcatctgtgcagctctgtgtggcctgggcggaattttcacattgactgtttcatttgaccttgtagacaggctagggttcatcactgctcagatgaggaagccagggcccagaaaggttaagcaacttgcctcaagccactcagctcaaaaatagcagagcctagatattctaacccaggtgtcattaatgttcccatctcatgcttcggaataagtggtcggaaagtacatttggccttccaggtttggggaggaaggctgcagctgatctaacggttggctctgcttagtccttgaatgtctctcaggtttttctcatgtttttccaagcctggtcttccagcaggacgtaggagatggagtgtctcccggggaaggagatgatggctcagtgtggagcacccccatgcccctcacagtcctgagcccttgccgagccacctgcgagcccctcccggcccagggcacactctcttgtggcagcagacattgtactgtgtttctaagatgctctggccacttcccctgtttcttcattaccctttgggaaggaggccactgaaagcgtctggaaatccgggttctatagacatttcacagaggccccagtcaggccccctctgctttctttggcaggtccgcaccccacgcaccttcctggttgctcactcagtcggtgggcctttcagctgcacttctgtggggaagacacactcctgtctgaggaagcagcagcccctctgtagagatggtgctgggagtgggaggtgggaaggatgcatctcggtgtgagatcccggaaggaggcattcacttgctccttgtttccaatgatgtttctctctgggaagaacgaggggcatgggatgaagtggcatatcagggccaagtggccagaacagggctggtgccctggacagtgagctgaggagagaacccacttcagattcactttctcctgggcaggaaccgtgagcacaggcaagctcctgggctgaatgtgcgggaacctgtcttggcttggctccgcagccattccctgtccccccaggggccaccgcaggctgcccagcctgccctggggggtaggtggacagacattccaggcaggaccgtgacaagaagtaaatgtaggtgatttgtccttgttctgttccagcttgtacattagcataccttgacatgagttatttgtcttgatttctttaaattcctaagtggattataatttttttcttggtattatttgacagcagtcatttttcaaggtttcactacgttcttcaaatacttagaatttttggaacaaatttaggaaaagactgccatcttcaggttggacggtgcagtgcaggacccggtgtgtctgagggcacctcgcagatgctgaggactagcagatttgtagggctttttcttccttttccacaaagattgaactgccttcatcagttcaatacatctagattcaatacatctagaatgtattgtcagtccttttaaaaaaaagagaaaaaagccccagtgaccactgttggaagttgtactgttgtggtttgtttcatctacagtgatggacaacctcctaggctgtccccactccacttttgggaacagactttgcatgccttagaggaaggtaggaagcaggtatctggagagggtactgtgtgcctgagggaaatgcggacgccagaccccacaaggcttccccacactgccactaccctagcaccgatggtaacatcagaacagaatcgccttaatgagtctgaaactttccctgtcttcatttatgctttaagttttagtatgtccaggtttttgttatcagagggaccgtattgatttcacattatttcgtccaaagtaaagaaacatcatgattcttccggaaagtaataacaacagcaaattacgtgctatgtacagtgttatgtgttttccttgcattatctcatttaatattcttgacactccagtacagtaggtactattattattcctgcattatagttctactaagtatacatatttccactatggctgtggaaactgcagcagagagagagggctataatcacttgccctggatgactcagttaggaagtggtgctactgctcagattcaaacccagatcccatctgacaccacagtccaggtgttcatcactcctcactgcaggctccctaagcagcaaagaacagcagggaccaggaaacaaagtgacccatagagcagctttgaaggaagacgaaagtcctttattaaccccccccgggtatctcagaagccctttgcaagtgaatggttgactttcgagggttgcattcacctttattattatttgcaactgctatgaagaataactggagggattatagcaaaacaaagagaaaatggacatttctccaagtcaaaatagaaatccacatattaagatggcatcaggtactgcgtggcatccttgatccaggtagggttttactggtgcaacatctttttggtgaaccctacctgcagacaagcgtcccagctcctgtccagctgtcctgagcgtttgagctgtaggaaagctttgcagtctgacccgagctcctttaaagcccaaggaacttgtggctaacacagagtaaacatcctgaagtaatgttttttgcttccttttatggttctttcccttcctcagaaaaactccataatctttcaagatagtttttgattggtggtttatttaataaaataattgtataagccagattgaagcacgtggcccataggaaaagcagtattctgctccttcatggctcctcaccttccagttctactttttggggaccattgcttgcagccttttcagccatttctttgtattaatatatttacctccacatttctaaataacatgcttatattgtatatctcattctattaattttaggcatcatctgttgacttcttaacatagaagactacgatttagttctctaaatttagtatatgcccccctccgtcttcctttcagtccccctatgtgcttttctctaaatttagtatatgcccccctccgtcttcctttcagtcaccctatgtgcttatatcacattaaaaaaaattagcattcagttaattttacaaacccatataaattttgcacacagcgtggttaatgttatatattggaaccatttccttaattgtaaaacgtttttttctggggtgtatggttgtcttcttaaaaaattgttcagttttacatagctacaccaattcaccctcaaagtttcgaggagaactcatactcttctccagatggtgagatataaatcaggtccgctctcttggtgacatccttccaggagtcctcagctccacggatccactctggactggttgctgacctggctggtttctttacctttcttctatgttaggccccatctctttttaaaacgtattccatccttttgtaggaacataccctcctatagctccctgggaacaagttgcaaggaaggtcagttttctgataccttaaatatctgaaagagtattctactttcatgtgtaatggataatttgatgttcattatggtttttgccttggacttgtgaaactttattcatgttttctaggtgatttccacatattttctccttgctaatgaacaatatgtttaatgctggagaataaggtcattcttataaaaagagcaggtaaatgctaatttagttcatgtgatatgtagaagtggtgttgactgtctttattatccccatcttctctgtaggaatttatgagaacatatatttatttgggaaagatagaattctaagtatcgaggtaataagcttgctctgtacagtcactctgtaggttctatgaagatgagcactttgttgttagctcatggattcctggtgtctagcacagtgcctggcatgtatgatggatgataggtgtgctggttcattctattaaaatctgtaaaacaggcagagtgagtaccttttccatcgttgaccttgagatgttgataatcagttgtgcctctactgagtgcctaggggactcttttggagaagtcaaaattagcctccgttttggatattgaggaaatcgagtcttgggccttgcatatgtgagtcattgacattcgccctttttctgctcatatcttgatcccaaatgccagttttctttcccaaatgccagttttctcttatgagtatttgttttgtgccccatagaatagaattgccctttttttgttttatgtgccaccttcacttttggggaaactaccactgctggagaagaaacgagatttatttgggaaggagagaagcaaataaataatccaccttggcccacttcccttataaggagaactggcaagactggaaatagagccttcaccaaagggtttttagaattcatttcattaaaacttgaacccaacatacagatttcttcctttcagccttctggatttggggacagagggattcctgacctacccaggttgaatgaaggggagagggtggtctgtttgtttcaatgctgtggtctccagggcaccttctgtagtactttgtattcttagaaacagagtcaccacctcttggcagcagtgaagccactcagatgccaatggtcagagtttggtttcaagtcaccagccttgtagagacagtgcccagtttcctttggcaaagacagcctgccccttctctattcatttcagccttgaacacagaggtaaattcctcaaaatagaaacctttgtggactctatctgatgcatttgtgaatcatgtttgtcactaattctaatttaacttcatagaagttttaaaacgctgtttagtttttttgctgttgttcctttcccaaatcaactttcaaaaaacgttggtttaacggtgttagaaaggcttagacattttcttttgggggacagtgtgattaatgtttgcagcaaacgcaagggctgtggtgttgacagatccaagttttattaactccaggactattcctggatgtgtgacctcaggcaagtcagttcatctctaagcttctatttcctcatctgtaaaatgatttaaattaaatccacctccagcagcgtcatgaggcaaagattacctgagatcacatctataaacaacacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaaaagcaggaaagttattttgcttctacctcaggatctagtgaatgtcacatgataataaactataacaatggtcatcttagctataatttattgaacatgaacacttttttttttttttgagacggagtatctctctgatgctcaggctggagtgcagtggtgtgatcttggctcactgcagcctccgtctcctgggttcaagcaattctcctgcctcagcctcccgagtagctgggattacaggtgtgtgccaccacacccggctaatttttgtatttttagtagagatggggtttctccgtgttggccaggctggtctcgaactcctgacctcaagtgatccaccctcctcagcctcccaagtgctgggattacaggtgtgagccaccaatcctggcccctatcaaacatttcttatatggcaggtcctatgccaagcaccttctgagcattagctcctttaatattcacatatgttgcaaatattacaggtattatatccccattgcacatatgagaagtcttgaggtttcaggtttgtgtctggctccaaggctttcgtgctttacactcagcaccttgcttttcagctgtaccttcatggtccccattggtatgtggtagattttacccccattcaccttcttgacctgtagatgtcagggccgtggttcccatttccagcagtgcagtgcagggacattttgatgttaagcacaaagacttcaagtttcccagcttctcaacttcaccccagctctgacctggcccaggggcagctagcgaggcagaacagctaggagtgaggagcctaaagggagactgggattcagctcagtgagtccctaaggcttgtatctcatgccttccataaactcactccttgcagaaggcgctagaatggacagaagcggtgccttctggaactggggcggtctgagagctagctgtaagcagaggttgttaatcagggttggatggacggatacatagccagttgtctaggtaataaacaatgccttttgccctgtactccccattccattttgtgtttctgattgcctttataccaacgtctgtgcccacacctttgcccatgttattcttttttacttttgcccactgagactagaaagactagaagcttcttagcagctgtgactgtgtctcatacatttccatgggctgttgtttataattggaaaaagtgatgtggcaacatttgaaaaaatgtataaaaagctcaaagatgttccctcctacccttataatctcacctcttcccacccccataatctcacttccctaacacaatggcttttacttttaacctttttaaaaataatttcttccttctgaggcagaccctgttgttttatagtatctcccagcttctgtcttacctgccaggtggctagtccatgcagctgcatccatgtcagagcttgatagggttctctctttcacctcacctgataccttttaggatttttgaagctttggaaaagataccactctgatgttgaacaggagagggacctggccctctccaaaagatactggcctcagttgcactgccccttatatgcaacactggcatcagatggagtgtccagcctcctgtcttttggcatggtggccagagatccaaatgtgggtagcaggttatagatttaaaccagtattccttcaggatatatttcatagggttttgtgaccaactgagtttgagaaactctagattatatgtttaaaaatgtttctttatggaagtgcctttttaagagacaaggtcttactgtgttgcccaggctggagtgcaacagcatgatcatagctccattacaccttcgatcttccaggctcaagtgatcctcctgctttagcctcccaggtagctggaactacaggcatgcaccaccacacctggtgattttttttttttttctggtagagatgtctcactgtgttgtccaggctggtctcaaactcttgggcttgaatgagtttccctccttggccttccaaagtgctgatattaaaggcatgagccaccatggccagtcaatggcactgcttttaatacgctagtatttactgtgaatctctaagagaggtcttattaaaagaataatagctagattttattgactgcttattcttgttagatctaggatccctgatgaagtctgtggagtgtcttatttaaaccctgtaacaatccagtgaagtgaatgccatcactgtccccattttagagacttgagaggcacttgcgcagtatcatagctagtttgccttgggcagtgttttgtgcttgagtaggatgagtctagacccacacaatctttttttttttaaagcaggtcccagtgattaagttccatggactgtacattcttaacccatgtataatactcagctttgcccaagccttctgttagttgggacttcctgtggaatagattagtactcagggacagtagttggagaattgccagttttaacttggaatgtgagcagacttggactgctagataaagaaggcggatggagtttctcagtgaaccctatttggttctgaggcccatggagcctctgcatccccaggtttcttggtctgtgtcacattaagttggtattaatgcctattcagtgggagaggcatgcccgaagagtctggagtataacgtctagaccagtggtctcaaatttggctgtgtattggaattcactgaagaagctttaaaaattatgatgtttggcctctctcagggattccagtttaatccagattatgcccaggcctttgtgatgtttaaatgatccttgggtattctgatgtagcctgggttgagaaccattggtttggacacactcctttgtggtccagttaccatgtcttatcccaaagcaaggggaagaaaagggttcactttgtgagtgaaatgacttaatgtggtttagagttttttgtttgttttttcatgaatgagtgacctgtgttctttttcatcagccatgtatggccttgtagatcttctctgtgatctgtaccccagtcctaactttgcactgacagtgacatattgagcagcccttatgtagaagttttggattggttactaaggggactggtgacaaagaggctcagcactcttattcctgctggaagaaggaagtgggtaccattgctcagaccactgtatctacgctgtcccaggagagttgggacaagaagtgcattctgggttatgacatgagctaactgcacacagatttcttattgggctccaaagagtatcactttcattttcagttgggtcaggtgaaattgggtaatacaattgtttcttggtttggtagctgggtaacttaagctgttgttattaatgtgtccgcaaaaaagccttttttagatatttcggaaaatatatgcccttgtcagtaaaaagcaatgattgtctcaaccctaagctataatcgcttttctaaacatactcatcatttcaaaagcattgatcctggactggaaggcctaattccagaattttggtactactgctctttatccagttcaagatggatgagttccaggttgatcaaagagtttgtaatgggaatgtttctgttggtttcttacagtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggtgagtaagacattgctgtgatttccgtggtttttgtctgaatggtcacatctcttacatgagcacagtgcagcacagctggctttggatttacactgagtgcaccttcatgtgcttctgcacaattgccaagggagcacggactcacacctgtgaactgtcctcatgccggccttatgcatccacatggtgcacctgggtgacattctctgtccctgccaaagggcacaagggacaagcagcctctttggacttcacttaaattcccggagctgggatgaaaataaagttacatgcttcaagattttgtaagcatcagagaggaaacagaattgctttgcccagtgtatacttcatttgtgctttaaaatgacgggcaaagtcccctggctgctgcagctttgctgatgttccagagcctctgagaggagctttgccaccctttggcactagtcagccttgggccaggggaatgctaatgggtcagaatgggcataagtataatgtgtgtgtgctaagggattggggcaccagataacctgctagcgctgcgagtttatgattcctcagcctttacacacatttttttttaaaactgttttaagtgtttgtgccccttagcatggcattaaaggccctaagcgacctggttccagggtagcttcctcttgtgtcctgccaaacccctgttgccccacctgtccagtctatgctctgccttctgtttgtctagatggactttctgctcctttctccctgtaccactgggccagctccttctcctccatgagacaatagctccactataatagaaccttccccatttgagcagaccattgatttctcttttaatcccattgcatttggtaatcacttcccatgctgtgtcatgattgtttggaggtgtcccccttcctctgggctctgcctcagggggccttattcatatagtggcttccttttttattgaatgcttgctttgtgctaggagctgtgctgaatgctttacgtgcatttcatttcatcctccacgttttaggtggaatttgcctcagctccacctaggaaaaaaggctcgtagatcaccagagacaggcttgtaggttgggtacctggagcttgacatcagatctgtgtgactttaatgcctctgctctgtttcctcgttgcataatcccttgtggaccctgaccacaggatctgtcaacctaagcctctacgtatctctataccaagcaagaaccttacacaacaaagcccaacagatgtgagaacaaatggatgaattaaagaaaaatttatgttttagattccttggaaggaaatttgcatattaaattagtttgtttcgtttcttttagccttccatgataactagatttcattttttgtgcttccattattgaaatttggttagtagtccaggcacagtggctcacgcctgtaattccagcactttgggaggctgaggcaggggtattacatgagctcaggagtttaagaccagcctgggccaaatagtgaaaccctgtctacgaaaaatacaaaattagtcaggcgtggtggtgcacacctgtagtctgagctactcaggaggctgaggtgggaggatagcttgagcccaggaggtcgaagctgcactgagctatgattgtgcccctgcactccagcctgagtaacagagcaagaccctgttccaaaaaaaaagaaatttggatagtagatgtagccttctacttatattaatggatgttggatctgtaatacacatggacaacctgaaaaagcgatcacagtcacattttccttttctgaattggtggctgccttctagtaatttggatggtggttggagatcagttatatggtaacagggtagctttcaaaatgtggcctgcgaacccctagggagttccttgatatcattttaatgggttgacaaggtcaaaactatttttgttataatacaaagacatgatttgccttttccattctgcttatattcacactgatggtacaagagcagtgggatagaactgctttagtatgaatcagagcagtggctttgctgctaaaattcatgcagttgaaaaaaaaagtccttcatgaattttattacaacctagagtacacattgaaagtgaacacataagttttatcacatcaaggaaaacaaatgacattatttgttgccaaagataaaatttgggctttcaaatgaaaattagaatactgggaaatttgtgcctaccttagtgaacttctcagtacttaaagacttttctgatgagatccacgatgatattgacaaaatgtaatttgatattgtgttagagcaatggattttaatgtaacagagttggaaaaattcattgatatggtttcagactccatattccagcctaccattaagaaactactactgcttgttgacttttgatatagtatcaaaggaaaatgaccactgttatctgaggagtctgtcacataatgtaaagcagcactacctgtctcactaattttttaaaaatacaggcatgtttaatttttttaaaaagatgtatatcaacatgtaattagcttattatttcttaaaatgaatgaatattttaaaatttgctcagttttaatttccagtacagaaaatatagatataacctgtagtaagcaaaaggtctttgaggtcctcaataatttatttggtcctgtttgcagtatcgtacatgatcaccaaactgctgctagaatgctcacacctgttacggcaaattcaaaacccaggaaaggcgtctcctgggaatttacttgaggtcagggtcaggctgtctggtacatcaataatttatttacgagtgtaaaggggtcctgtgatcaaaaagtttgagagccactattttaaaggatgtaaaaaggggttgtttatccaagtgaatgaaaagctaattcggaattatagaatgttatgaagagaaaccattttcagtaatttcaaattcaacagtagtgtttttaaataaggtttctgataattagcatattgtttgaatataaagtagcatagagtgcgcttagaaagtcttttttggttttgcctccaaaattgcccttattttacccagtggatgattttaataaatgttttccatggtggggcccttcagtcatgaatcctcaaataacaaagtctagattgcagatgtttagagtatggtagctgttgggagatgtgcaaatttagaaacagttactccgagatcagatacttgtttattaagatttgcagaattaaaatggagaacttccatgaatatgatagaaaacatcactccttcagtagagttgttaggaatatttaacctttataaagaaattcagtcataactatgttaaaataaaggagggaaggcaatttaaattcggtttgcaatttgaaatgtcattggcttcctctaatgactcagtaagaatgaattacatttagaatatctatccttggatatcagtaggtgcttccagtgggtgtttccgaagtaggtttaacactcccttcgaaatatcttttagcaatatgcttagcagatgtgcttatttttgttacaacagagactctatacccagtccttttcttctctctttttcaaatggcctaaagtctctaggctgtcagtatcagcctgactcttacctgtttatttgatcgttcctgaatttggttttcagaatatctgctacgtccaacctgggctcggtcaggctagaccacgtgaggggtttgctatggaagaatactatgtgttacctaaagtacctgcatttaagccccagatgcaggcacctcagttctgccagttgacacttggaggcgaatgggatggtgatgagccaagtagtagtcactccactgattttagggtggaagattctactggcatcccaggccccagagcataaatgaataacagagtcaaggatgccagcatgagtacccctctaccatataagctttacagtgtctcatgccttcatggtgtgggaccccttaaagcccgtatgaatggctgtttatctgttaagatctttctaaagagccttattgaggtataatttatatactataaagatcactcatgttaaatgtacaatttaggcctggcgtggtggctcacacctgtaatcctagcactttgggaggccgagatgggcagatcatgaggtcaggagatcaagaccatcctggctaacacggtgaaaccccatccctactaaaaatacaaaaaattagccgggtgtggtggcgggcccctctagtcccagctacttgggaggctgaggcaggagaatggcgtgaacctgggaggcggaggttgcagtgagccaaagatcacgccactgcactctagcctgggcgacagagtgagactccttctcaaaaaaaaaaaaaaaaagaaagaaagaaaagtacaatttaattatttttagaaaaatttacagagttgcataatcatactaaaatccagcgttggaatttgtctgtcaccccgcgaggatctcctgtgcccatttgtagttagttcttatttccacccccagccccaggcaactgtggatctactttctgtctggatcaatttgcctgttctagacatttcatatgaatgaaatcattcagtgtattgtttttcacagctggcttcttttacttttgttgtatttgaggtgcatcctttttattgtagaattagtgtcccatccaatgtatataccacattttgctttgttcattcactggttgataggcatgtggatcatttccacttcaggctattatgaataatggtgctatcgagtctttgtagacaagtctgtgtggacataccgtttcatctttcttggggagctacctaggagtggaattgctgggtcctacggtaactctatgtttaacattttaagatactgctaaacttcttttttatgtggttgtaccattttacattctcaccagtaagatcttaggggttcttctccttcagccattatgtctgcaagtattggggtacagattacaggggacatcttagatgaggggctggtaagcaaaggcactgagacagggtgtgtgtaacgtatgcttcaggtgcattgaggtgtgttgcagctgaatcttcactggtaatggaaagataggtgagtagaaaaatttggaaagagaaggaatccagaatttagttgtgacagcagtagggagcagtcggtgttttaacaatttttcagtcaacagagtaatgggattctttttactgagtgttacagagactctgcattttgccttttctagttttattatattttccttttcatgacagcctcttactcatttcctttctatttcttttgccctctttttatttactcctatgtgttttaattctacagcgtatttaattacaaagagagaaaaggtgattttgcaggaatggaagggaagggaagaggttcctctctttttcagcagtacctgaacctgacgcttaactggtaccttctttaagccaggcactgtgccagggctaagcacatacttgatattatttaatccttgtgagatacatgtgatgagtcccacttcacacatgaagaaatcaaaccatacaaaggcaaagtgacttctgtgacatcatattgctagtaaatgccacatctgctagactccagaatccatgctctttgtgtaaacctgtgcatggcctcttcagggagcacggttctgtcactagaaaccatcccaacatagcttcacttaaatggaagctaatggtgattgctgaaggatagcagccttggtagtttctctttgaagtcctgtcattatgagatgctctggtgtgtttacatgggagctaaggtgtattttcatatatatgttctgtatattattatgttctgattttttttaaaaagcctttcttgctgggaaaagactggcctttctgggtctagccaattcttagagtaggaacatgattctgtctaacagaggatagtccaggagcctgcttttcatatgcaaaccaaccagtccagaaccagacctcctctatgtggtccaggcaccccaggatacagtgttcctctgccctaatcattccctggaatggtaccagacaactagggaccacctctgaagcttagagccagctggagttattcgaactagtcaatccttaattggtcattctgtttcccctgccctgcccatggaaagcccaggaaaggctctggtctaagctggcctcttgtcttctgcctcctgaccaccctagtatctttccatgtggcccttgatggcctgccatgcttcctgtcttggggacctttgagtgtaataaatttttttcctgaacttctcctgtgctctgtggccgcacctgactgaccatcacataaaagaatacaaaacgtaaggtgaataaactattaccaggaaattcaggttggagtctaagtcttaactagacaagttagtgagatcctgcaactaccattaggagaaagcagtgttgtttttatattatgattatgaaggtataacattctagacagttgggaatatataatttttaattcagtcctaaatgcatcatgaatataacctaatgtgatacatatttatgtagttttgatcaaggaatacgtgaaatctgacactccacttttataccttatgaaatatcatgttagctatatgtcagtatacttcaaattatctgtttttttttttttgagacagtgttgctctgctgcccaggctgaagtgcagtggtgtgatttacacacatggttatgtgtgtaaataaccatgttgctttctaaaatagttgtagcagttactctctcaggccatgcatgaatagaccaggcatcttcatcagccttgactggtgcaatttaaaacaaaacaaaaaacaatcttctattgtcacttgttatttgagttcttctacatctgcttttattttttcttcctactcaaaagtcttcgattcttcctcattctctgtagaaacaatgattactattaaggttgaaataccatatttcttcaattctgagacatggacttgttcccatttcaacagttctaaaattggaatgcttctgtcagttgatatccaaagcactttgccacattttctttatatccagtctattattgaatactatgcagccataaaaaggaatgagatcatgtcctttgcagggacatggatgaagctggaagccatcatcgttagcaaactaacacaggaacagaaaaccaaacaccacgtgttttcactcataagtgggagttgaacaatgagaacacagggacacagggaggggaacatcacataccagggcctgttgcggggtggggggcgaggggagggaacttagaggacaggtcaataggtgccacagaccaccatggcacacgtatacctatataacaaaccagcacgttctgcacatgtatcccagaaattgaagcaaaattaaacaaaaaagcatcttctccacccctaggcagaggagtaggttgtgactggttattatcacctgaccctggccagcatagaagacatcttgccattccctggacaccttagttgagttatttgcactttatagtaccatagcagttgaattttagcttaaatttaaatccctaattaaaccatctcggaaaattacgcattgatgtggcattgaaattgttattatggttcaagaggagttttggaaccagattttttataaatgaggcaagtacttgtactggcagctagtcatacttcttttttccttacaaaacatgatcaggtgctgtgtaggctctaggaaagagggatgtccacccacaaatggatgaagctgtgcttcattgcagcattgagattcaggcagatggattgccagtgacgtggcagacagtgcaattaatgtaacaaaatgtcaacagccttgggaattgatcatagattgaattcccagagctagaagacatgagtatgattcagtcatgcatcccgaaggacaaaaacccaagtgtagctcacagctgactgtcaaaagcagttaatttctagctatatgaagtttacagaaggaaataaaattacagatttaaccaaataagacatgcaattgagactaatacctttggaggggcctcagaattctatttcctgtcctaataatgttcaagggtgtcaagattggaaacactgctctaaagaaagctgtatgcttttaacattctattcataaacattataacccaaaactattcataataataattagtacagtaaaggcttagtcttaaactttgattggaataataaagaagaaagcaatatgaaagtgaaatcttacggatttgtatcatgttgccaggttataacaaatttttaaatatacatttaatatttctgctttcactctaatcattatcaaattagtcatatcttagaaaccaggatatatgatgttatcctatacttatttaaaattgttttgtattttaaaattcttgggattatgatcattcagtgtaaacaatactgtctacatagttacttaatttgctttttttttttttttttgagatggagtctcgctctgtctcacaggctggagtgcagtggcacagtctcggctcactgcaacctctgcctgtcgggttcaagcgattctcctgcctcagcctcccgagtagctgggattacaggcacctgccactgtgcccagctaatttttgtatttttggtagagatggggtttcgccatgttggccaggctggtcttgaactcctgacctcaggtgatccacccgccttggcctcccaaagtgctgggattacaggcgtgagccaccatgcctggccaatttactttcttaacctattatttttaaaggaagaaaaagcaagcctacttttactaaccatagcagatgtgagaagattttataaaacaaaaaaaggggaagcaagttacctggaaagaggacagccattagaagatgcttttgtcttggtagaaatgaaatcacatttgttcaacaaaatgacagtcactctacataaaactgggttttatttaaagagaagaaactgggcgcacaataacccagcagaacagaccccacccccattggagtctcagcttgtttctaattgtattctgcatgatttagattggaattgtagacctgagtctgtcatttggaaccaaacgtcctgttgctattcatggaagagggagttaacaatacgaaatcgtttgctttccacatgttttgaactgctatcaggaaggaggggcctttcagctcaataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaattttaagtagactgtggttacatgagtcttttttttttttttttaattatctcttgataggccctgctattgtaagcacaggaagagagaaatcaatacatttgtatatctgcccattttggtttgttttcgtaagaaaaatatctggagcttgtgagcactttctgtggtgactgctgcttgggattgctccttcctggttcccgaaccctggatgccaaacttctttgtaggcctttctaagggagcgtaccctgtctgtggcctgtgttcagtgctgcaatgtatataatagattttcaaggctttttttttttaagttacctggaaagttattttatttcaatcagtaaatggtcctaaagaaattgctgtgcattgggcactctgccacattgccaactcacattaccacctgagagtttgttgaggaatcatccgcaagcaattcgtaggaggaaaaggagacctcaagagactcacttgaaagcttttctgggccatctcgttgctagaaagtcattcaacaaacatttgccaatgtcgtctttgcttctggaaaactgggaagcagatgtgattgagagttctgatttgcaggctcagggtctggtgagggatggcagacatgtgggcaggtgaacaacagcaccgaggggtgggagctgtagtggaagtgggcagaagttgctgtggaagcacagaggtggaaccctttttgcctgagaacatttcggaagggctcacaaagacatggcatttaaacagaatcttgatagaatttggtcagtgcaaggggagtgagaaggagttttcagggcagtggatactcatgtacagacaaggagtcctgggaggtggcgagaggtccccatggccactggggcttaccgaactcagagaatagggagagatgtgggtggaaaccctggtcacaggggcattcacttcaaaagaccatacctgaatcctctgaaagcctaaaacgtagtaggaatgaaatcatggatttcacaggataggatagcttggaaaatgagcacaagagcttacattgcttttcctcccatcctcttctatcaaaccacagatacttctcttttttttaaacctttgactctgaagtcttcagggcttccgggcagaatctcttgcattgggagttgccttgacctggaggaattcattccaacagctattcctaaaagactttctgtcctgggtcctttgtctctgtgattgctaagaaagcccaggtcaggggtctgtcccttccttctggggccatttaattccactcccttctgtggctacagactgagatgctaagccacgatcccacctgagctgctgccacaattagcttgattcatgctgtcacctttaccatttcacctcaagaaaaacctgagaaggaaagaattgatgtgccatagtcggggtggctgcatattttcagacccagttttgcaaggcgtagttggattaactggacacttcagggatctcagtcagttgcttaaaactgaacctaggcccttggtggtgtgagagaccccctctccatgtgcaggtaaagatccacggtacctcctaccccccagtccaccccatgttaatttactttttaaattaaaaaagtgatgcaggtttgttatgaatagtttgagcagttgaaaagaatatagaataaaaagtgagatcctccttgcacacatacatgcctgtggtcagccagatcccaaaatttggaatgtatccttttagacttatacgtatgtatctacaaccattatacgtatacatatacatcacttgtttttactaaaaagggattatgctccaagtgtttcctgcaacttcattttccctacctaaagtgtcttggacatatgatgccttttacagcaatgagaatttgagggtaagtctcagtttttattctctgtggtaaaggtttcttgataagtagagttgtcagatttatcaggttgcccagttaaatttgcatttcaaataaacagtgaatacttttttggtgtacatgtcctatacagtatttggtatatatgttcatatgtactgaaaaagtatttgctgttcatttgagatgtgagttaactgggttccccgttttatctggcagctctgcacttgttagttcacttacgtatcattggcttggggttgttattgttgttctatgaaaaacttttcatgcacaaaaccttgaaaccataaaaaggtcctgtttcctgggaaaggtggtgtctgggccagtgttcacacacctgatgaatgagaaaggtttggggccagctcagctgggcacccagaattcattacttgcctctattggaaagaactggcccgtgtagctgctttgtagttggagctgagacctgactctttcatcctagccactatgtgaagttgccactagtggtcacctgaagttgtgtgggtgatattaattgaatttttgaaaaactaaatgctggtatttgtaggaatttgcagtgcagacgggcagcctttcaaccagtgcatagcataattagagcaagcttttaagattctttgaagtgccaaatgtttatgaaattcaaataggggtgccaatctgcacaataaaggggcccttggtggtgtttttaaaaatcttctattttgtagatgtaaatatatgccataattagcgggaagtaacttgaagagccacggctgagtttattcctattattcttatttaaaacagctgtggcaggcaggctacagctgctgtctcatcattgggttgggcagggcataagggccgaagtgaacacactcaaagactcttttctgagggcagctcgttcactccccctacatgctggcttccttgctggggagctgtctcacggttggcccagcttccccacccaccccaagcctctgaatgtcaatgggactggcttcaagggtcttagccagaaggcacttgcctgcaaatgagagggcgaggagccttttagagcagccagctttctccagacctcccccttctctctgcccatggcagtgctgcctctaggggcactgttgccccacagccccaggcccagtgcagagcgattgtcctttggtgcctgtgggagcagctgcaatgccgcactgcgtgccctgcctggccgagccttaccatgtggcaggcctggacggctgcccgccacagggcccagctcccagcaccgcctgccaaggagccagatgctaccattggaaaaaattgcttcacaatttgaaatcttggttctttgatcattgctcggagaggatgaagaagagaggttcaaagtagtgttttaaaatgccagcgtctcgttgcagccatcagtgcctattagactgtctctggttggggacagtcctcttgatgttttcatttttgcaaccaggtcattctccccagctcttccaagccctctggataggaagggaaggtccacagcctgctcctgaccctgtgcccctgctgtccccctgcctcgcgccttagaggttatctgcttgcctttgttccagcaggcttttccccaataaagcttgtaacaaagttgttgtcatccgccaaatgctgccaccgcgtgagctgctcactcccattcttcactgggcaggagtagccttcacttcctgatccttctgcccccacagccaggtctccagaggacggaggttttgcagggatgatccactctgtcccctggcctagcacccgcctccaaggacttcagatcccacatacttgggtgaggcttcattcttccttacccttgaaatgggaagggtcagtctttggagagtgttgcatttttcatatttactgccaaaaggcaaaaacatgaaatttaaaccaaacagatccaggatggctgggcatggtggcccacgcgtataatcccagcactttgggaggccgaggcaggtggatcacttgatgtcaggagttcaagaccaacctggccaacatagtgaaaccccatctctactaaaaaatacaaaaattagtgtggtggcgcacatctgtaatcccagctacttgggaggctgaggcagtagaatctcttgaacccagaaggtcgaggttgcagtgagccaacattgtgccactgcactccagcctgggcagcagagtgagactctgtctcagaaaaaagaacagatccatgaataaatgggcttactgagtaagaggtaatagaggagaaacgaatccagactcttatctggggactaaactgtttcagttgtggaagtaatgagtataagagaaggatgatttgggaaagaatttggaaacttttgatggggtgtatttttgttttctgttgctgtccgcttcctctgcccatcattgaaaccggcttctgcttcgactttttgttgtttttcaggacttgcccacaaatagaccctaaagtctttaattcactcaacacacgtgttaatgatggccttttttttagtcccagaaagaattctataacatgtctaatcatgccttttgagaaatttatacctgtttgagctgttatactcaatacgtaagacccgtcataaacacaaatcagaaaaagtcctaatttttctgtttggaaaaagccagtgttgcatctgtgccacacacccgacaaacgtgggttggggccaagactggctccatggtgacagtctttatcgtgtttattgattacagactcttgtctcgttgaggaaaggtgtcagtgtctctagatgtgatttgaggctctgtcttcatctctattgtggtcaatatttcaaattgacaagtgaacaggagtgatgataggtattgttaatgactgtgaattttatagtacattatagattacaggtgaattttatatgcattatctcctcatattaccaccgtggcctttggaaacacatcatcttccctgtggataaagatgagaaaagcgagacccaaaaagtgattccaaatctctcacttctgctgcctgtgctgtcagtccagtgtctgagatgagatgacaaatgagaagcagcattcacagacgcctggaccagtgtcggactggatgggatgagtggaggactgaactttgtagagtttaacaaaagtaaatgtaaaacttgaatcttgggaagcaaacagaacctgaagaactatgtgggtgaggaggaggagaggaatggtgaagttaaggaggaaaggagagaaaactgcagaattgtgttacagaagtgttcttcggtctgtggtacccgaagttctggatggaagttacagaggagctcatttcaacttaacagatgtaataggcagcatcatggatccccagacatgcctcctctgtagccatggaatctgtggataatggtacattacatggcaaaggggaattaaaagttgttaatcagcagatagaatatcttggattatctaagtgggcctagcatggtcccaaggtcccttaaagcagaagagggagacaaaaaaagacatccagagagacgacagctggcaatgtgagaaggattcggctggtgtttctggctttgaaaatggagcaaggggctccgggacaaggaatgtgggtggtctcagaagctggaagaggcaaggaaacagaaccctcttcagagcctctgtctagtaaggagttgcgtcccttctagttccttgatcttagccagcctggagctgaattaaatttctgacctacaggaatataaaataattagtttgtcttgttttaaggcactaaatgtgtgataatttgtagcagagaaaattaatataacagaaaaaagcattaacagttaaggctgtctggcaatattattattatttataaatagagatggggtcttgctgtgttgcccaggctggtctcaaactcctgggcgtaagtggccagcgtgcctggcccagcagcattattgaagtgattttcctgtgtctgaaagtatttagctttaaggcagtgcaggtcaggatgctgtggaaaggatttctgcttttggaggtaggagagagttgacctctgaactaagtttcagcttagcgtttagggtctctgtttctagagcaaacagggagaagatttcttagaaggactcatttccctggacttaccttccccagccatatttctaagtgttgttttttaacactgcagaacctggcctatgaccagcctttttggctagcttgtgcccagaagatgggatatggtttgactttggaatttattggaaagataagttttactagttttcaactgtttcttggatttttgtttttatttacttttagaaaatatcctgtggttaggtaaaagctgattaggcagaaatagtttgtatctctgatagtggtacatttttaaaaactcattttcttgccttcagaactacatgaaataggtttgctttccacctggagtgattttcagttgggaggggggacgtgtcagtagggtagataatgaactctgcaaatcccagacttctttgttgttgacttaatgctagcattctttctttgatattaccttcacttcatgggagttcagtgactgcatttctttctggaatagccataacactatcagctgacagataattatatatatataaaattatatatatcttgataattatatatatatcttgataattatattttacatcaatacttcctcctagaaaattcctgaagagcatctgtgatatggttggatagctacataattattttccatgttcaagggtaattacaaagcagttgtaatggcaaattggttatttactgttagttgggaagccttttaaaatctaatctcttaaatttacactaataattaaatagagaattttctcagactgtttctccctacctcttatctaaatgaaggataaaatgcacgtagactctatgaccgagtaattacactcctaggaacgtccaacagaaacacatccatatgtccctcaaaagcatattcaagaacgttcatagtagcactcttcttaataggtccatttggaagcctcgcaaatgtccctaagtaatagggtggatagatcgtggcatttttcattcaatggaatattctacagtaatgaggatgaatgaactatatacaacaacatggttgagtctcacaaataaaatgctgagtaaacaaaactaaacactgtaaaccctgttgcacttgcttaaagttcagaaaccagacaaaactaatgtgtgatgtttcaggatcatggttacgctggcaaggtgtatagatgattgtgcctggaaggaaggatatttgggggagagagggacttccatttcttcatctgggtgctggctcacttgatgaaaattaatcaagctgtaaacttccagtttgtgtacttttctgaatgtatattttaattttatgtaaaactgttaactttgacagctttaaaacatgtaatttgttgggatggtttctgagggtaggttgggtattctttaataactttgttttgaataattctatcattgtaactacagatcatccattccaaatggaagctatattaaagttgtttggggagttctaagagataatggtaaaccaatggtgaggtggtaggaatggtctgccgcagctgcaagcagtaaggactttgcttggctgtagggaatttacaaacaatggcaaaaccatctaaaaaatcaattttctttttattatcaccatattaactgacaaaacctcctttgttggcctgagtcctaaataattggtgaagttagtgttgaatttttttaattactttttttttgagacagcatctagttctgttacccaggctggagtgcagtggtacaaatcatggctcattgcagcctcaaactcctgggctctaggaagcttcctattttagcctcccaggtagctgggactacaggcacatgccaccatgtccggctaattaaaaaaaaaaaattatttgtagagatggcatctccctatgttgcccaggctggtctcgaactcctgggctcaagcaatcctcctgcctcaacctctgaaagtgctgggattataggtgtgagctgaatttttattttttatatatgtatgtatacaacatatgttgaatttttattttatatatagaacatctatatgcttcaaattagcaagcacattatccattatattacttctccttcagtaacacatgtggactcagcctagtactcatttcaggtgcagtctgagtccacagtccccatggtgctccttgttccagtggttaaacagatttgtcaatgagcaacaatagtagaatgattatgaagatgaggaaacagaactttttttccattccttcattctctgtttctgctttgggaatttttacgtttacaattttaaataactgaagtagagtgctggttattgttgaaagtcattttgtcaaataaaggaaggcggtcttaaaaatgcgtcagatctgctaggtgtgccactgctgtgggacagctgctttcaccagcgttacttaagcatggaacctcgtacagacagaaccgtaacagttgtgaacatattcagcaattttactaacatcatgatgaataataccattctaaacttagttaacattttaaaattatatatattgacagattattttttctgttttaaggttgacagtttttaaaaacaatctatttactctcccagtgacccacctgcccccatacacaattgcttatttcactgtgttcccttccatagtccagtctgtacaccaaaatcactagactgctttcccccatgcttagaaatagggtcttgctacgttgcctaggctggtctcaaactcctgggcttaagcgagcctcctgcctcagcctcctgagtaattgggactacaggtattctaccacacccagcttgctagactgcatttgattatttactagtctttcagaacaacttgattaatcaaaatcaactagtacaatgttagcttacagtgtattcatagcacatggagactctttttcaaagctaggaatttaaagttgaaagaaagaaaaataatttctaatgcaccttttctgctcaacacaaacttattgcagcatcattgggaagcatcatagatattcatcagtagagcgtgtattaaattatggtgtatctgtgccatagaatagtgtgcagccactagaaagtgtggctgttcattatttcaaatggctgtactttatagtactgaaattccatgttagtactatatgagttctaagtggcataggtatatatatatgtttaacgcaaggttttagaaaagttaatataatgtgctactgtttgtgtgataaaggaggaatgtatatgcttgaatacctaagtgctgaatatctctgaaaggacacttgagaaatggataacattggttacctttagggaggttggcaaattttggggttcatgcccattttacagttttatttttcccccgtctttaccacatgcatgttttcacttttttaaaaaatgttgggctgcgccaggcatggtggcttaggcctgtaatcccagcactttgggaggccgaggtgggcggatcacctgaggatgggagttcgagaccagcctgaccaacgtggagaaacctcgtctctaccaaaaatacaaaaaaaattatccgggcatggtggcgcctgcctgtaatcccagttacttgggaggctgaggcaggagagtcgctcaaacccaggaggcagaggttgcggtgagccaagatcgtgccattgcactccagtctgcaacaagagcaaaactccatctcaaaaaaaaaaaaaaaaaatctggaacgttttggcacaggctacatcataataataacagcattaatcctgccaccataaagcacctgaactgcttttcacagcgaagtattctaaggtgtcagcaaagcgaggcagtggcagttcttgaaggtaacactgccatgttgaaagctcgatgggaattccagtgttcagagcccctgtgtgcctgaggtgtatggtagcccctctgccctggagactggagctcagttagacccaggggcctcttcagccttgggagttcagatgctgatctcatttagggaaagacatgcatgatttcctgctgagctgctcttttgtggagccaaatgttaaacctttgaatgtgagaaaaatgcacacctgggtatttttgtttgtttatgatttataccccataaaatccaaaatgcagaatgtgaggaaagctcactacatttatgggtaacataaaaccggataagtacaagttaaagcagattggaaaccagtaaaaggagctgtaccctgactgttagtagctattagaagcacctgagacaagttaattattgtagttgaactctgaatttagctttgaatttcttggcacataaggtgaaaaggggaatgtggagtacatggttctcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatccgcccgcctcggcctcccaaagtgcggttctctttatttgtagacagaaagtaggaagttttgcctaaggagttggacattttcctaataaccaattcaaaaaggaaatttaaatgtagatacttattttaaagtatatgatgactcaggtcttagtggttagtgcctgtcaaggtataaaaattagccagtcagaatctgccaaatctggagcaatacggtgcctcacacccgtaatctcagcacttagagtggctgaggtgggcagataacttgaggccaggagtttgagaccagcctgggcaccaaggcaaaaccctgttactactagaaatacagaaattagttgggcgtggtggcacatgcctgtaatctcagctactcaggaggctgaggcgggagaatccactgaacctgggaggtggaggttgcagtgagcctcgcaccagtgattccagcctagacgacagggccagaccctgtctcaaaaaaaaaaaaaaaaaaaaaaaaaagtgccaaaccgcacaaaatataaaatctcatttgagtgtcagatccacgtacctctgcttcaacaaccaccacggcagtccacatttatcatctctcgcttggactgctataatggcctcctagtatatatatatatacatactttctgctctcttccggagtcttctccgagccatggtcagaggtgccttttggaaggcagagctggttgtgccctgtcactgttccaggcctgtctgctcactgtgtcctttggtctcaggatatttcacctctccagctctcctgccatcctctctctcttgctttctctttagcgcttctttctggctctgtgccctcttctctcttatggaatgcttctcttgcctaagcctcgtcttctttcttgggatctgagttgcatcatcattagaagtgtccctgaccctgggggcccactcctcaccgtttgtgctcgtgtccccccgtacctctctccctggtgcttagttccgtgtggtatgttcctcacttaattgtaagcctcacgagagcaggccctggctcagcttttgctttttttatccgcagctctgagcattgtgccggatgcggagcagggggttggtagatacttgagggaaggcagctattactctgtggctgtctttggtctgttttgtgctgctacaacagaatgccacagcctgggtaatttataaagaacaaaaattcatttctcacatttctagaggctgggatgtccaagatcgaatctgtagcatctggtggaaggcacatgaagggccagagagagccagcttactcctgaaagccctacttatagcagcgttaacccatatgcaagggcagaggctcaacacctaaacccatcccaaaaggcctcacctccaacactgttgcactggggtttaagcttccaatgcatgaatttggtgggggcacattcagaccactgcaatgatcaaacgctgcagcagccagtttccccagtggacattgcatcctgctgaagacatttctctctgaagcacagtgctaatcataccacttccttggcacgcaggctttcaagggagtatccatttcctacaaaatacaatctaaactgtcttcttcgcccccataacctgtgcccaagttgcatttccaaactcccagtctgaggtccttaatccatgcccagaagctagaatgcagcactccaggccttggcctgcactgtacccccagccttccctgcatgtgccagtctaaatcattcctcaactgagaccacctgtggaaagtcataccttccattgctgcaactctaagtatctctgacatggtacttattttctatctgaatgatagttattttatgtatcttccatatcagttgtaggcaaaacccgtacattgtctagcatgaacctttcatagtaggtgcttaataaaaatgtgttaaatgaatggcaacttaagtcattatttaacatctttgtaagccagtctttaataggaaccatttcccctccagatattctaatttttaagaaagtttctgtttgtacatatatgacaaatggctagtcagctgcagtctcttgttttttttaaaaaatatctctaaagatgagtgaacatgaatccaattaatatcctgctttctgtgcatatttcaaagaccttgtggatcttttattgcaagggtatagtagtattctgatactgaatgcaagaaagtaaaacaaaattgatacttgtagcatgtcatttcaagagaggactgcccaaattagcaaactctttaaaaaacgacagatgggtattgaacttgtttctagatgagcatcaccttcccaagccagccctcttcattcagccaagcagaggtcttaccctgaaagttactgctcggtgccatgactcctgggatgagagaataacccacacctccatttcctttccaacaggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagaggtaagttggcctctgtatactggaaacttcattcaagggcagactgttgccttcctttaaaccttccttggggcagagagttgtatttttggatgtctgcttcttaccttctgtattagtccattctcacactgctatgaagaactacctgaaaatgggtagtttatgaagaaaagatgtttcattgactcacagttccacaggcttaacaggaagcatgatttggggggtgtcaggaaacttagaatcatggtggctgaaggtgaaggggaagcaaggcacgtcttctcatggtggcaggagaaaggtgggtgggaaccaccacacacttttaaaccatcagatctggtgagaactcccacagtatcacaggaacagcctgggggccacctgccaccaggcccctcctctgacatgtggggattacgattcgagttgagatttgggtggggatacaaccaaaccatatcaccctccttctttctcccacttctttttcctgttaacttctaaaaagccaaagtgatttggaagcacctgaaaggaagcaaataggatgtcccgtgccagtcctctgactgtgtctgaagtcagctgtgccctgctcagccagtgctgtgcacctttgcttgaggccttgtggggtagtgtggtatgaaagctgggtcgagataggccctgccactcagaatgatgccctccctacacccaacccctaggtccaagggcactcccaggcattgtagatagacgtcaaggtggtactcagctgattggcacctgccctctgaaaccatgataccttgagtttgatattgttgcttttgccatttccactgccttcgcttttaattgttttagatagagtttattatatattaggatccaatctctttttacggcttttatgtttcataccttcctccctttaaaaagatgtatatttgtttgatcagggtgagttgctttgttgaataatgtttgttgttggcattccttaaaggttgtattttttagtgtcttctatccatcacccaattaattgatccatgttcagtgagcagtttttatttgcagtggccccagacctttcaggttcaagagcccaccttagctgtacaaagactttgtgctgaggagggagagagggagaaggatatatttcttaagaccctgggctaagcaatgaggatttgggatgctgcaggccctcgtagcacaagccccctgagcaatggacaggccttatgagaatgttgttgaggaaaggttatgctggcagaagaggatccaggggagttgactcagatggacaatttaagcttaggggtcatgagctttcccacaatggtggcagtgggaatcctgtaagatgttttgaatggaacttagaaactaactggatattaatgaggaggaagagtcaaaagtcacactcacattttatgcttggaaggatggtactgccactaatagagataaggaaataaggtgttcaagaggaaataggcaatgattatagatgcaagactagaacttggatgacaggtaaagactggaaatataaattgggaatcctgagcattaaggattgggaatggagacctagctgcagagagggaatagaaagggcacaggaataaggattaaatttggggagcagccactagccctaggataagtagagggagacataaacagaagaacagaggacaaaaatgagtggggagggcgggaattggctcaacataatgtctaggaagcccaggaggtgagaaggtggctgtatcatgaaacatggctgggacgcctggaaccagatgacctcctcgcctctaagaaggaggaagcaaagttacctgtgtgtgattgggagtgtggaagatgagtgttaggcaatgttagtgaatagctaagttgtcagggatgttctctgtagttgaaattccctgcctggacaggtgcatttgagaaaagatgaaccagacagcttactcaatttcccaaatgtcaaattactggtgtcctcagacgatacacccaaagctctatgcaaattcagggagcagggaaaggttgctcttgactgataaaatcacaggaatttttatggagaaggtggtgtgcatggtaggtggggttttacctttaagccttttatctgtttagaatgtgtgtctgcatttggtgtgaagtagtagtccacttatattttcttccagataggcgtttgtatcaaaaccacttatgaaatgattcattctttcccagttaaacagatctgtcccctttaaattaccatatattctgagagctgttcctggagtcccactgttctattccacccactatttgtgtctacgtatcccagtaccatgtggatttgattacagtggctttatagtatatactgatatttgatgaggcgagtcaggctcactattctttttcatatattttctaagctagtaaccaacatttattcttccaaataattcaatcacttaaacatataaagaaaaacaaaaaccttgtttgagcaatctaattgtaattgcatcaaacttagatgttcttttggaaaaattttatattaaatatttctaatcaagaatgtatttgcattctcatttcattttatgtatttcaataagattttatcattttcattatacaggtttgtctctttcttgttaaatatatttctaaatattatataatatgttgtaatttcctgtttctagattcgaattaatagagaaaagctcttgattttgcatatctgtcttcaatatggccatcttagcaaattctcatacttaactttagtttttcccccagattcctggggtacccttgtatagttaactgatgttagttgaaaaagttttggtgttttgccctttaggattatatttactgtaggcttttattaatggtctttattactaatttaagtgttttctttctattcctattttacttaggatttttattagttacagctgcaatacgttatcaaatgcttttcagcaactgttgctatatgatttttcttccaagttgttgacataacaagttaatacatttcctcaatgtgtatgaaacaccatagcatttctgaaacagtcttactttggatttattgttgcattctatttgctgatattttacacagaattttcacattacatttcataagtaatattcgtctatacttttttcttttcctttttttttttttttgagatggggtctcactctgtcacccacactggaatgcagtggcatgatcttggctcactgcagcctcagcctcactgggctcaagcaatcctcccacctcagcctcctgagtatctgggactacaggcctgtgccaccatgcctggctaattttttgtattgttttgtagaaatgtggtttcgctggtctgaaactcctgggctcaagcgatctgcctacctcagcctaccaaagtgctaggattaaaggtgtgagctgtcacacccaactatatacctttttcaataacctgtttgccaaatttcagtcttgaatgtacactagtttcataaaaagaataacactggaaataactattctttaaagattacataaaacttactcctgtgaaactatttggtctttatatgttttttagcatgtacttttaattaattatttttaattgatagataaaaattttatacatttatggtgtataacatgatgttgtgaaatatgcatacacagtagaatggctgaatcgagctaattaacatgtattacctcacatagcttaccaatttttgtggtgagaacacttaaatattctcttagcagttttcgaggatacagcgccttggtattaactgtagtcaccatgttgtacagtagatctcttgagcttacttctcctaactgagattttatatcacttgtggcctccacctttttcagtggtaaatagctaaacttgttagttgtggtcatttccacaatgactgatctatttgttgacattttccccttctttttgactcagtgttagcaagttgtatttttctgggaaagcatctctatctgctgtgttttctttgctttgccgtgtgtgtgtgtgtgtgtgtgtgtgtgtgtgtgtgtgtctgctttagggttatgtgaaataatctcttatgtatcttctaatttgtactgtaattgtggttttgccacttttcttttttctcctttttacttgtatgaagagtttattttgtctgtctaaaggaccagtttttaattctgtctgcattttaaatttctatttcattgatttgagcttttatctttattaattcccttttcctggcttcctttgatttctttgtggtttgggtttttttttttaaggatgtgtgttttattctgtaaatttttacctttaatgatgaagacatatgaggctacttcattaagtttccttcaagtgcagcttcatcatggctgatacgttttgatgtaaaatatctcccttttcattgctctttagtttataattttcttaattccttttgatccaaggttatctaggaagccttgtttcttatttctgagttattgaaactgcatatatactagtattttcttagtttcttcctttcataaacaggtgacattcaggggctcatgatccgtgagaaataatcagttttttctaaagtagagagattagctatattggttgttaacctatgaggctttatcacaataaagagattttctttgaagaactgtagctagctggggcctgctcttacagatctcctccaggtaaagcatcataattaggcagttttatttttttctgacctttgctaaaaggatctgtcaacgcttcttaaagctctcatctttccaactaattttttaaaaaacttccagaaaaataatggattctatgtatagcaataaatttggagatagtttttttttaattaagtagattacgtaagtagtatagcatatagaagatgattcatgttgaaaaactaaaatgcttttatgggcagtaatatctgtttcatgtgttttggagtcaaaagtgtaaaaatactgaaatccttttttcctcacagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtaatggttttgtctctttcctctgtgggcagatgctgccatgaggcttgacagaagtgaggaaggtgggcctgggaggcgctgggcctgcgccgagggaactgaccaggttgttggattgggttcctagtggtcagtcagcagttgaatttgcatcatccatagggaaaacttgggcttgattctgtagaagagaaggggttttatctggctggggtttctaaggttcgcagaactggaattcagttgggtaataaaaagtgatgtgtttttatctctggctgcagagtagaaaggcctggagaacttttaaacatccggctgtatcctagatcaattaaatcaggatctgtgagaacaggacccaggcatgtgtatttttttaagttccgcaggtaatttcaacattagccaagttttagtctcagcagcaacatggtatgcaaatcaggcaaaagctgagttggtatgtttgtacttcagacataccttgacatgttccatgatggacttccaaggccttctaagaagttacatgcattaaggcaggaaaatataagctctcagtaccagaagaaatataaattagaatagaatgcatggaatgcagtgaccaggaggaggaaaatgttcttcataggctaaaaaatctggctaggctgagtacagtggcttatgcctctaatctcaacactttgggaggccaaggtgggaggatcccctgagcccaggagttcaagaccagcctgggtgacatagtgacaccctatctcaaaacaaacagacaaaacaaacttaatgggcagctaaaggaaagggaaaatagtgttcaaggtccatgatgggaaaactcaccagtgcccctggatggttctatgtgggttttcccctaatacttaactttaaaacaaatttcttctgggagctttatttggggacttcagaagttgttaggaacaatgtcatcctcaaaatagaaaatactcagtaatgggtttcataaggctcatttaaaaaagtaacattacttgattaaagggaaaatgccaaaacaaaacttgagggaaacaatcttagcaaaagaggggcaacaaggctatactgtggccaaatactcctctgaaagcctactttattcctttttgttactaggattaagaatccatacagcaggaattctttacttggtgtttttggttccattgggacagtggctttcaatcagcagtgttctgtttttttgttttgttttgttttgtttttgttttttagaaaggctgtttcccagtttcccaaaactctaatttataccttttacctatttctgtggtgtaaatatgcccttcatgggcaatttcaagctaccgatagctattcagctaatgaaattccttaatatttaacaataatttttatgagccagtaggagccagcttctatacaccattgtataaaaaaaaataagtaacatttaaaaataaaaaccctgtgcatattagattcatccaggaaggtttaaaacatctaaggcctaggccccaccctggatgaataaaatgagtccctggagatggggcccagcatcctggtttttattttttaagctctgcatgtagttgaagtgtgcaaccaggtagagacccactgctgtaagagattgggaaatgagccgcaaggactctcagagtttatagacacatgattggcatacaactagcaaacagataattttgcatataattttcgtttgttccaagaagagaatcttaatgggttctcagatgtgcccatgtccttctaaaatttagaagccagcattcaggggaagtttggaatacatgctctttaataacattgatcagtattcctttctttaatggccctttggtgaaaatagagcaattcaaggtttgcaggactggcatatagcaggtgcttgacatataggtgcttcctgttgctatctaagaatagatgcatcactttagcagtcagacgagtagaaggtaagtgtgacatctactgaggatcttaagtggcctcaggaattaaccaaaactctgaatgaatggcttccctgcctctcttgggggggagtcttagctgtttattaaaaatcaattctgattctgtttctgcatgctaaggatgcatgttctcagtccgtaaaactctacctcagagagcacagctaagataaatgtggcctggaaaagtgttaaagcccctgttacccacagaacctgactacagttgtgcactgcatagcagtgtgaagggcggaccacgtgtatggtagtgctcccataagatgataatggaggtgaaaaattcctgtcacctagtgatgatgcaactattatataatacagcataattatttttaaaaataaatttaggttagcctaagtgtacagtacaaaagtttacagtagtatacagtgatgccctaggccttcccattcactcgtcacttactcagtgactcacctagagcaaatttcaggcctgtaagctccacgcatggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacactctatgctgttggttcgcatgacaaaaccacctgattacacattaggaggtgtcctcattgttaagcaactcatcactgtatatcattaatgctgccttgcaaaatatgacttcaaccaatacagccatccagataacttagcaggttagattaatttcaaaatgtgtcattaagcaactaaataaattcctttaatatggagaattaatacctatcaatcaatatatattagaattaatagtttagttttagaaaaactgaaattaagccagcactcttggattttgaaaataaaatcatctaattgatgaacaggagaaattgtacctcatataaaatgacatagtatttgcagataacttatacaaatcatctcttatactttaaatcatctctagattacttataataccaaatacaatgtaaatgctatgtaaatagttgttatactatatttctaaaatttttattatttttattatgtcttttttcgtccccaaatattttccaatctgatattgattggatctgccagtgtggaatcgcagattgggagggccaactgtattcttatttaatagaaagcttgcaagaagtttgaataggttgtagaggtgccaggtgctgtgctagaccctttgtaaatgttatgtaattctcactttcagactatgaggtcatttttctcattttatggataaagaatgtcaggccaccccgaggtcacagagccagtgatggaaataaatttgagataccatctcacaccagttagaatggcgatcattaaaaagtcaggaaacaacaggtcctggagaggatgtggagaaataggaacacttttacactgttgttgggactataaactagttccaaccattgtggaagtcagtgtggcgattcctcagggatctagaactagaaatacaatttgacccagccatcccattactgggtatatacccaaaggattataaatcatgctgctataaagacacatgcacacgtatgtttattagagcactattcacactagcaaagacttggaaccaacccaaatgtccaacagtgatagactggattaagaaaatgtggcacatatacatcatggaatactatgcagccataaaaaatgatgagttcatgtcctttgtagggacgtggatgaagctggaaaccatcattctcagcaaactattgcaaggacaaaaaaaccaaacaccgcatgttctcactcataggtgggaattgaacaatgagaacacatggacacaggaaggggaacatcacacaccggggcctgttgtggggtgggagtagagggggaagggatagcattaggagataatacctaatgttaaatgatgagttaatgggtgcagcacaccaacatggcacatgtatacatatgtaacaaacctgcacgttgtgcacatgtaccctaaaacttaaagtataataaaaaataaataaataaataaagctaaacttaaaaaaaaaaaagaatggatagaaaagaccttgcaaggtatcttatggtcatgaaatcaaaagacttgagtttaagactttatggccttggtcacttagtcttcagacatcagtttcaccttgatttataaacagaatgctcaagtctgcactttctacctcagaggttatcattgaaatattttaattcagctaagctgtgagagatggtactgccttctgggatacaatgcaaataaaacccagcacttgtcacgtagtaattcatggtccttcaggatgaaagaggcaggtaaataaaccattgcaagcaaatgatggctgtagtgtactcgtgaaacaggtacctctgaaatgcagagtgatgaggtagggattctcagggatgttgcctcgatggataaggagacatctttctgattactaagaataggggtatcccatgggtacatacttaggtaccaggggctggggtgctatggtgaattaggcaggtgggccgccatcctgggttctgatgcaggaggcaggcatgcatcaagtcatcacaaaataaatgaaaactgtagctcttgctacctggcagagggacgcagggcattcgtagaacaggggaatttgacctagttcaggcggaagctgaggaaggcttcctgaggaagaaacagttgagagctctctgcgtggtgaatatgcaaccatgaccaaacgaacctctcagctccttccctgtcaaagagcacccactcctagaggtcgtatgatatcatatgagacaatctgtgtaaagcatttgatactgagtagatggatagtaaacactcaatatttgttggctattctgatgtgaattttcattcattcagcaattatttatttatttatttatttatttatttatttttgaggtagagtcttgctctgttgcccaggctaaagtgcagtggtgcaatcttggctcgctgcaacctctgcctcccgggctcaagtgattctcctgcctcagcctcctgagtagctgggattacaggctcccgccactgtgcccagctaatttttgtgtttttagtagagacggggtttcacagtgttggccaggcgggtctcgaactcctgaccttgtgatccacctgcattggcctcccgaagtgctgggattacaggcgtgagccaccacgcccggcccagcaaatatttattaaatgacttgtgtgccatgtcctcaagctagttgctgggaaacagggcccctgttccttaggaacttatattccactgggtgagatggatattagaaaaaaaattgtacacgccagtatgtgtttaccaactgtatagcatgctgtgatgggaaaatgagatgtactgcaagactattctttaagtagggactggaagcttggataccttaagagcaagggaaactaaacaggggaaacagcctgatacttagagggaaattaggcctataacaaactggaagaggctctcaagttcaaaatgttttcattcaaacaatgctttggcgtaatcaaacacaaaagtaacagagtcactgacgcgtttcatgtttttgcttgattagatttgctcttagaaagttccttctgagaatagcatggggaattgagaccagagtgaggacagaaaggagtcagggtctgtgtggtgtggagggagctgcaatgatttgggctggagaactcaaaatacgagggataattagagggattcaagagactggaggggaagcatgagtatttcacaatacattttgaaagataaagcccatgtctatggaaagaatgtcattccacaggattctacctatcccactgttccttgattcagcagatacttttctgggtctaggcactactggttaacatagtggtgagggaggcactcctgcagcttctctgtccttggctattgtgaaacaagatttagcagaagtttaagactaggatgggaaaaagagtggattttaaatgttctcatcacaaagaagtacgtgaagtgcttggtatgttagcctgatgtaatcgtcccacaaggtatatacatctatcatcacattgtagcccataaatatatgtactgcaagactttattcttttaggtagggactggaattattacttgtcaatttaaaaattcagataaaaaataagacaatttcttagagtaaatgattgccttgcgggacagaattaaagagaattctttgttgtaaagaaatcagccccctaaaaaacaaaaacacaaatgtgctaatttttgtggtcctttcttgggcatagattatgagtgaccctatctagaaggtatttcttacttatgataaccacgtttagatgggcttcaggtcatagttgtagtgttctgaatctgtgttagaggacacagagtgaggctgagcaaatctctcttggacttaagacttgttcttctccaattaagtcatagtcgtcatacacagatggaatatgttttcatccttttggtattatatactttttttttatcttaacaggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaccttttttatctgcagaagtgtatgttgttaggaatgaaatgtgctttatgtattgtgagtgatgatatgaaagacagagtaaaggaggtcacagctttcatctttttgaaggtgtccaccaagcttgataattggaactttaggtgttacatctaacagcgtttcttaaacaatacccacaagtcaatcaatccacttgcctatctcactctttagtgcatcattaaaattgacataagttttgcagaatggcttgtctgtcgatcccagacttaccctgagaagccaggtcccatgggctttagcacaccagcccaaccattgagtgttttttgttgctgttatcccaacttgttgggcacatgccaggaatgagggatagagcagaggatggggtacagagataaatgcagcatggctgtttcctacacagtacttaaattctcaggagtgggattgcacattgagctataactcctcccgacccctgtcctcagcatcaccatggggttcatgattcaggtgtatgcagcacaggtgcctaacaaaactttggattccccaagcgtttactgtatgctgggcactgtgccaagtgtgttggtacaatgtatatgtacattgtactttaaaattctcactatagttccagtgacatcattcccccaaactgaggcccagaaaggaaaggatagcttattaaaagtcatgactagtatgtggtggagccttaaagaaggtcactctgacagttcagcctggactcttggcccctgcatcttggctcactgcactgtggaagcagctcaagactagaggagaaatctggcttgggggcaaagaactttcttaaacgatgattatcttggacttctgacaatgagactcaaatgtaccttgggatccttcatttgtgtgaactagatctcagagggtcttgcttctccttatttccttgaagtctgaggcaaagcacgctctggaggggagcatgaacagagaaataacttgcctgcccctttgaaaagggatgattttcagcaagccaccatttgagaggaatgccatggtccagtgaattgctcagagcagagggaaggaaatgatttagcattttgttgaagtcctatgccaagcatcttcaccatttactttaacccaaatactcttgaaacgtggaatcatttctaatttttcaataaggaaatcgaagccttagagatggtagaggcccttgttaaggtcatacaagctggtaagtggcaagaatttagaggtgacagcacctccttgcagttctggtgcggccactcatgacacctttctacctcctcctctaaaacaaggtactttaatacctcaaaaacatcctttgttagtgcctagggttccagtcaccttgagttcagcaaagagagtgacccgctaggtaaaccaacatcattgagtaaagagactagaggagcaaagaggaaggttctggtgtgatcaaggaacaagcaactttgctggaaacccctagtcatttcttcctgccttattgcttcagggtacaaatatgttccagggtactattgaattcttcctgccttattgcttcagggtgctaatataaatagctacgacttattggaagccatatagttataaagtagctacgacttattggaagccatatagttataaagtaatcagtgtgagcaactgataaaattccaataatgtgtaagcctctgaggtgttagtgggtaaaattgccttcaaagcctcccttgtcctgtttgatgccccataatgccccatacacctgattttaagtaggttatcacaagtagcagataagctgctgattacctgactgcatcttttcggcaaatattttcccacttgcttaggtttccaagaagctcagatttttaatttgtgccctgtgctattaataagcaactaactaaaatataaaggcacagaatgattgaaagtaaagaatgaaaaatatatactatcaaaacaccaaaataaatctgatgtagctctattaacctcaaactagtatagctcgaggcaaaaattactactagagttaatgaagattacttcaagaagacacaggtttcagttgaccaggaagaataaagatgttaaacttgtaggcacctaataacatagcttcaaattacataaagcaaaatttgacaaatgaccatagtgggagtttttaaaaataaactcagttacttacagataaagcagaccccaaaagtgtaagaatttgaacagcatgatttaatgtgccgttctaatacaaaatacaaagtaatgaaccccgaaattggagactacattattttcaagtgcatacagaattgttaagaaaattgatcatgtccaaggccaaaggccaggaaactatggcccatgggccaaatcttccctgttgcctatttttgtaagtgaagttttattggaacacagccatttcgttacttattgtctgtggctgcttccacatgacaatggcacagtgggtttgttgcaaaaagatcctatagctcacaaaacctaaaatagttactatctgtacctttacagaaaaaaattgccaaatcccatcttaagccaaaaagcagggttctacatccagtagtcctaaaaagatactcatgattccctttcttcaatgtatagacactggcaaatggttaaagatccctttaataccctcatgtggcatcctagtatcattcttaagtgccccagcctctcctttgattggtggtctgtgggtctgagaataggcttagatcttgaaaggatgagtgaggaatggtgattatatatgtgtgtgtgtgtgtgtgtgtgtgtgtgtgtgtgtgtgtgcgctgcagcagctgacagctgacatctcacctgatcttaatattttattattagaacagttaaactgcccatctaccttatccctatcttgccatctccacagatccctgtggggttgcatccttggttgccatttcctgctacctgttatggtaataactaccttgcctctgacagctaagtgctgtcatctggcctctgctgttccagactcctatcatccattcacacaagggaaacctctcaactctgttcttcaaaccactacagagtttcccaacagcacagcccactcactagtgcattcactctggttttagtgaaggaaatgtctttggcacataggtagtgggtgtcctggtcataaattacaaatccatctcaggagcattgccactttgaactttctgagccctgcctctgttctgcagggcagttctagcatctccgcctcatttactgtagaccatcatttcctccagacttcaaggagctatccagcagcacgttagtatcagcttcaggtttctgctgggatgttaaatcctgaattgtaaaactatcccacatactgataaaccatccctaatctagtctagtctcatgtcctcaagattcattcccaggcatgttctcccaattcctgctgagaagagtagccaaatcctgcagctgtcttgatgatccttctcttcctgaagcaaggacccaacttccccagttggaccttgctgaggctttaccctagtaattggtctagaagcaatgacaggaggtggggcaggccttggaggaggcaagcacttcatcttggggggcattcatttcagttgaggccttgacatggtctccaagcaaggaagcctgttatccatctgcaggagggagtggactgctgacccagagggttcagaagtatatgaggttcagagttctcagcatttctatccagatgttcccaccccatgtttagggtcccactccttaactattagactattagtgcctgactttaacaggatacttgtgagggctgtcaattcagtattatttgtaacttctagcttggtttttagcacagtctgccctccagctgcatgggctgaggatcactttaaatgccagggagtcctttgacaccatgccctaagttgagcctgatgctgccttccatccttgcactgattgcacttagcaacaaccaacctattccaccatccttataattaacaccacccccatctctctatcattctagagattacgtaagtgagtgtatccccttcctgatgggcccaataccaatttaccacaggtgggagtcttagctatcgtggtgctacaacataccaggggagacgaactgtcgtagtttaggttcccccaagaagcagaccctgaaaaaggactcaagtgcaaagtttatttaggcgaattaatagaaaatatcactttgtgtaataaaaggtgacattcatgaaggtgaaataattttaaattggtatgcacttaatacaattgccataaggatatgaaagaaaaatgagagagcaacaaaagaaagtacaactcaaaatcgtacatctctcagtaattaatgaagcaagcagacaaataccaggaaatatgtagaaattttgaagtactgaaaatacatatatgtttgtgtgtattgtgtgtatactatatccccaaattgtcaaattaatatttttccaatcacatatggaaaaatatgaaaacctgtacttgcaaattaagcaagtctcaatgtatttcaaaggattgctacaaaacacacagtattctctgaccacaatggatttcagatagaaatcagtataaaaggcatctttaggaaagctccatgtatttgagaattaataaacatttctaattagtcatgggaaaaagtcatggaaattaaaactgtcaaatcctattaaaatatgtggaatgcagctagagcagtatttagagagcatataggcagacctgcttagaaatgtgcatattagaaaagagagactaaaaatgagtcattcaatacacaaagttaaacaataacaaaatggaaaccaaaaaaaaaaaaaaaggaactactaaaggtaagagcaaccttggaaatagaaaacacaatagagatgaacaaagtcagcaactggttcttcaaaaatactcataaaatatataaaaccctggcaagactgaaagaaccaaaacgataagaatgaaaatatgagcattcctacaggtcatataaagattaatacaagtatttaaaaaggtaataaaagtatactatataaactttatgccaataaatttgtaagtatagataacagggtgaattctttaaatactataacttaggaaaattgtctcatgaagatgtagaaaaactgaatagtcttaaaatcattaaagataacagtacttcccagtatttccacacagaaaaacccaggcctagatggtttataagctctatcaaactttaaaggaacaaaattatggaatcttacataaaatactccagtgcatagaacaaaggaggcaattttggtcttagtttaggtcttctagaaagtggagcctgaggcaaggattaagatgctaatatttgaccaggcgcagtcgctcatgcctgtaatcccagcacgttgggaggccgaggtggacagatcacttgaggtcaggagtttgagaccagcctggccaacatggtgaaaccccatctctactaaatatacaaaaattagctgggcatggtgggcacctgcctgtaatcccagctacttgggaggctgaggcaggagaatcacttgaagccgggaggcagaggttgcaatgagctggtatcatgccactgcactccagcctgaatgacagagtgagactccatctcgaaaaagatgctaatattttatttgggaaatgcaaattcagcacagtatgaatgagagaaaagtagaaataaagcaagggaaatccaatgaaatgtgatatgatgcattactatattgactaccacttcatagtaagtcaaaagggacatgttaggttactcagtatgtgagattcttggaatgtggatgtttttggaaaggttgcaaggaggaacaatatcttggagtagtcagtggaagagagaaaagggggtaatcttcctgtcaggtaagctcccatctcccagttctcattgagtaacattcacccaacaaggatattactgccatttcatctgtgttgcatcatgccgacttagcagctgttcaggaattgagatccatgtactatgatgtggtgttttattaaagttcaaaagtgaaggggaaacctggcatgtgtggggtgcccaccaagggaaggaaagagggaggcagttaagggaatctgagaaggtacacaaagtgtgtttctaagtatgctttcccatttatttgataaggctaaaataccaacaagaagacaatatgaaaaaggaagaatataggctaatctcatgcataatagaaactgacaaaatattagcaatttaagagtaacgatgtatataaagcataatgaaggcaaaatggggttcattttaagaatgcaaggttaatttaacttagaaaatcaacccatgtaattcatattaaaagatgagagaaaaatcatagatcatctgagtagatgaagacacatacacctgataaaatccaatgtctgctgtggaattaatatttgtgtccttcctttcccaaattcatatgttgaatctctaattcccaatgtgatgatatttggaggtggagtctctgggaggtaattaaggttagatgagtcatggggttagggactccatgataggattagtgcccttataagaagaaaaggctagagtcctccctttctgttcaccatatgaggagatggcgagaaggaggccattttcaaactcagaaaatggtgctcacaagatacagaatctgtcagcaccttgatcctgaacctctcagcctttagaattgtgagaaacaaatgttgtttatgtccattcatgatttttaaaaacttagcaaattaggactagaagaaacctttctgaactgataagagtatctactaaaaaaaaaatcagcttacaataaaaacatttcttttgatgttgcgaatgagacaagaatgcctacattaagacatctactcaacataccaaggttctagacagtgtagtaaggcaagaaaaataaataaatgaagattgaaattcaatctgtcattatgctaatatgataaacttctatatgtagaaaatccaaatgttaaaatggggcagggtgggagtagtgatgaagttaaaatgtagattttttttcagtttttcctttgtttctatatgttttatgatcaaagataagttgtcacctttttaaaataataacttttagtaacaatacagtggttttttcctaaacctcatggtaaccacagagcaaaaacctacaatagattgactaaaaataaaaaacaacaaattaaaacatactacaatagaaaataaccacacaggacaacagtaagaaaggaagagaggagttacaaaacaactagaaaacaagtaacaaaatggcagtagtaagtccttccctatcaataataacattaaatgtaaatggattaaattctccaagtaaaagacatacagaggctgaataaataaacaatatccaactatgtgctgcctataaaaaacctacttcacctacaaagacacacatagactgaaataggggatggaaaaagatattccatgcaaatagagaccaaaaaattgcaagattagctatacttagataaaatagactacaagttaaagactgtaaaaagagccaaggtattacataacgataaaggggtcagctcagcaagacaatattacagttataaatatctatgcacccaatactggagcacccaagtgtatgaagcaaacactaatagatttaaagaaagagactgcaaaataataattgtgggagacttcaacttccgactctcagtaacggacaaatcattgaagaaagaaacattggagttaaactacacactagaccaaataggcctaactgacatttacagaacatttcacccaattgctgcagaatatacattcttctcttcagagcattgtccagaatagatcatatcttaggccacaaaacaagtctcaacaaattcaaaaaagttgaaattatattaaatatattttctgatcgtaatggaatgaaactagaaaccaaaaacaagaggaaactggaaaccatacaaacacatggaaattaaacaacatactcatgaacaatcaatgggtcaatgacaaaattaagaaagtggtttaaaaatttattgaaacaaaaatggaaatacaacataccaaaatctatgggatacagcaaaagcaagactaagaggaagtttataataataaatgcatacatcaaaaaatagattccaaataaacagcctaacgatgtacctcaaggaactagaaaagcaagaacaaaccaaacccaaaattattagcaggaaagagataataaagaccagaacagaaacaaatgaaattgagactaaaaaaaatacaaaaaatcaatgaaatttaaaattggctatttgaaaagataaataaattgacaaacttttagctacactaagaaaaaaatatagaaggcccaaatcaaattagaaatgaaaatgaagacataagtacaggcagcacagaaatgcaaagaatcagagactattatgaacaactatacaccaacaaattggaaaacagaagaataaatttctggacacatgcaatcttccaagattaaaccacaaagaaatggaagacctgaacaaaccaataatgagtaatgagatcaaagccatgataaaaagttttccaccaaagaaaagcccagaatctgatggcttcactgttgaattccagcaaatatatgaagaagaagtaataccaattctgttccaactattcaaaaaaattgaagagtgaggaccaaactaattctacaaggccagcattactctgataaccaaaaccagacaaggacacaacaaaaagaaagatacaggccaatatccctgatgaacacagatgcaaaaatccttaacagaatactagcaaactgaattcaacagctcattaaaaagataatttaccatcatccagtgggtttcatcccagcgatgcaaggctggttcaacatacacaaatcaataatataatacatcacatcaaaaccaaggtcaaaatccgtatgatcgtttcaatagatgctgaaaaagcatttgataaaattcaatatccttttatgacaaaaaactttccacaaactgggtgcagaaggaacatacctcaaaacaataaaggctgtatatgacaaacccacagatagcattataccaaatgggaaaaaatcgaaagtctttcctctaagatctggaacaagacaaggatgcccactttcgccacttttattcaacataacactggaagtcctagccagagcaattagtcaagagaaagaaagagaaaaattggaaagaaaaatatcaaattatctttgtttgcaaatgacataatcttataatttgaaaaacctgacgactccaccaaaaatgggtaaaattgataaatgaatttagtaaagttgcaggatacaaaattagcacacaaaaattagtagtatttatatatgctggcagtgaacaatctgaaaaggaaatcaagaaagcaatcccatttacaatagctaccaaaaatatacaagatctataaataaattaaaccaaagaagtgaaggatctccataaggaaaataataaaacactgatgaaagaaattgaagagaacacacaaaaattgaaaaaatattccatgctcatggattgaaagaaataatattgttaaaatgtcaatactacccaaagctacttacagattcaatgcaatccctttcacaatgaattttctaattacgttcttcacagaaatagaaaagaacaatgttaaaatgtatatggaaccacaaaagacccaaataaccaaagcaatccagagcaaaacaaaactggaggcatcacatcactctggcttcacaatatactacaaagccacagtaaccaacatagcatgatactcatatacaaacagacacatagaccaatggaactgaatggagaacctagaatcaattcacgcatttacagccaacacatttttgacaaggtgacaagaatatacaatggggaaaggacaatctcttcaataaatagtgctgggaaaactggataaccatatgcagaagaataaaactagacccctatctctcaccatatgaaaaaaaccaaaaatggattagacttaaatgtggccaggcgcagtggctcacacctataatcccagcactttgggaggctgaggcgggtggattacttgaggtcaggagttcgagcccggcctggccaacatggtgaaaccccatctctcctaaaatacaaacagttagtggctgtggggttgtgcaccagttactcagtaggctgaggcaggagaatcgcttgaacccaggagacagaggttgcagtgagacgagattgtgccactgtactccagcctgggcgacagagtgagactccatctcaaaataaataaataaataaatacatacatacatacataaaaacatacatacatacatacatacatacttagtgtaagtcctgaaactgtgaaactgctagaagaaaacactggagaagtgctgtaggacattggcctgtgcaaagattttttgagtaagacctcaaaagcacaggcaccaaaagcaaaaattagacaaatacaattatgtcaaactaaaaagcttctgcacagcaaaggaaacaatcaataaagatacaacccacagaataagtgaaaatatttgcaaactatccatctgacaagggatcaatagctagaatacataaggaattcaaacaattcaatagcaaaaaaaaataacccaataaaaatggacaaaagatctgaatagacatttctgaagacatacaaatggtttacaggtatatgaaaaaatgctcaacatcaccaatcatccgagaaatggaaatcaaaaccacagtgagatttcaccctagttaagatggctattatttaaaaaatagggaatattggatgttggcaagggtgtggggaaaaagggaacacttgtacactgttgatggggacgtaagttagtacagccactatggaaagcagtgtggacgttcctcaaaaaactaaaaataggactaccatttgatccagcaatcctactactgggtatatatccaaaagaaagtaaatcaatatattgaaaagataactgcaatcccatgtttattgcagaactactcacaatagccaaagtatggaaccaacctaagtatccatcaatggatgattggacaaagaaaacgtgttatatatacacaatggaatattattcagccataaaaaagaatgaaatcctgtcatttgcagcaacatggtcattgtgttaagtgaaacaagtttggcacagaaagacaaataccacatgttatcactcatatgtgggagctaataaagtggatctcatgaagatggagagtagattggtggttcctagaggccaggaagtgtggaggggagggggatataaagagaggttgattaatgggtaccaaaatacagttaggtagaagaaataagacctgttcaatcgatcagtagggtgactatagttaataatatatctgttgcatatttgacaataactagaagataataattcagatgttcccagcataaaagataaatatgtaactaaaagagaataattcaaatgttcccagcataaagaaaaatgttcaaggtgatggatatcccaattaccctgattttaccattacatgaaagtatcagtataccagatataacccccaaatatatactattatgtattaataagaaagactacataaggtaggattctattcaaatgaaattctaaaaaagaataaaatcatatgaaaaaagaaacatgagtacatttataatctataacccaacacattttatatgtagaattacttgcaaaagtgctccagggactcatagaagaacgttacacccctccattggtccactcaaaaaagaaagaaattataaacattacaaatgttcagcaatgattaactttaaaaataaattatgatttatttatatagtagaccatgatatgagtacaagggactctggaatatgtggacccaatatctttcagccatagagaagagccctttggctgtgattttgtggttgttgttgactttttcttcagctgtattgaagtataatttacaatacagtacaattcatatattttaattgtataatttaatgactttgggtaattgtatacagtcatgtaaatgtcaccacaataaagatacagaacacatccatcacttgctaaaagcctctcatacccctttgcaacctgcccttcacctggcttagtagcctcaggtatatgctgatctgcttcccttccctgtaatattgccttttctaaaatttcatataaatttagtcatacagaatgtagtcttttgtatttgattcctttcacttagcataatgtgtttgaaattcatctataatgttttgtgtatcaatagttcattcccttttactgctgagtagtatcccacagtatagatgtaccacaatggatctattcaccagctgatggacatttgggttgttttcaaattttggctacaatgaataatgctgctatgtgcatttgcatacttgtctttgtgagaacatgtgtttccatttctctaggagaagggattgttgggttactggtaaggatatcttccactttattggaccagtacctgtcggtggcctgttgggaatggggctgcacagcaggtgtgcggcaggaaagggaatgaagcttcatctctctttacagccacctgccatcagtcgcattactgcctgagctctgccttctgtcagatcagcaaaggcattagattctcataggagcatgaaccctattgtgaactacacatgcgagggatccaggttgtgtgttccttatgagaatctaatgcctgatcatctgtcattgtttcacatcacccccagatgggatcatctagttgcaggagaacaagctcagtgctcccactgattctacattatggtgagatgtataattatttcattatatattacaatgtaataataatagaaataaagtacacaataaatttaatgagcttgaatcatcctaaaaccattcccttcccccactgtccatggaaaaattgtcttccatgaaactggtccctggtgccaaaaaggttgggaccactcctttataggaccttgtcactctgttttccggcctgactgtaccactttgcattgccttcagcaatgtgtaaatgtgtgagagttcctcacatttttattttttggggtttttttttgttttttgtttttttttgagacagtgtcttgctctgtcacccaggctggagtacagtggcatgatctaaactcactgcagactggcctcccagggttcaagcgatcctcccacctcagccccctgagtagctggaactatagatatgctccaggctaatttttgtattttgtgtaaagacagggttttgccatgttgcccaggccagtcttgaactcctgggctcaagtgattggcccatctcagcctcccaaagtgctgggattacaggtgtgagccacaatacctggtgattttcattttttttaaatttggccactctagtggacatttaatagtattttattattattttaatttgcacttccttgaatgacttgtgatgttcagcatctttttatgtgtttgttggctattcatttatcttcttttataaagtgattgttcaaatcatttgcccattacttactatgtatgtctttttattactgagttttaagggttctttatataatctggatagaaggcttttttaatagctgttttgccaatgttttctcccaatctgtggcttgtctttgttttctcaactcgttatctgaggaggaaaagctttaaatcttgatgaagtctgttttatctttttttcttatgtgatttgtgctttttgtgccctgtttaagaaataattacaggccgaggagggaggattgcttgagtccagaagtttgagaccagcctgggtaacataatgaaaccttgtctctacaaaaaaacaaaaacaaaaaaacaaaactaaaattagccaagtgtggtggcgcatgcctgtagtccaaactactcaggacgctgaggcaagaggatggcttaagcccaggtgattgagtctgcagtgagctgagatcacgccactgcactccagcctgggcaacagagtgagactctgttacaaaacaaggcaaggcagggcagggcagggcagggcagggcagggcagggcaaggcagggcaaggcagggcagggcagggcaaggcaaggcagaaggaaggaaattcttttatgctgtcttctaaaagtttaatagctttagctccttcatttaggtctacaatcaattcaaatatttgtatatgatatgaaataagagttgaggctatatacatatatatgatacatacatgtatatgatgtatatataaatgagtgtatatatataatggatatatatatatatccagttgttctaacaccattttttgaaaagactatcttttccccattaaattactttggcaccattgttgaaaatcaattgaccatataagtattggtgcattttaaagcttttattttgttccattgatctcatatggtctatctttatgccagtaacacactgttgtgattactgtatcttaatgataagtcttgaattcaggtagtttaagtccttccaaacttgttttcctttcttaagagtattcttgctattctaggtcctttgccttctcgaacaaattttagaatatacttgtcaattattttttaaattaagttttaaacataaatacttttaattgcctggcattttaatgtccaacttgagaccttgtaaagaaaattgtggtacaatacacataacataaaatttaccatcttgaccatttttaagtggcattaagtacattcacattgtgcaaccatcaccaccatccatccacagaaatctttttatcttgcaaaactaaaactttataaacattaaacaataactttccattctaccagcccctggcaaccagcattctactttctgtctctgagtttgattactctaagtgcctcataaaagtacaattatgcagtatttgtccttttgtgactagttcactcaacataatatcttcaaggtccatccatgttgtcggaattttctttcttttttaagtaaatattccattgtattccacatatgtatgtatatatgtgtttgagacagggtcttgctctgtcacccaggctggagtgcagtggcacaatcacagctcactgcagcctcaacctcctgtgctccggtgatctcccacctcagcctcctagtagctaggaccataggtgtgcaccaccatgctcagctaattgttgtactttttctagagatggggtttcaccatgttgcccaggctggtcttgaactcctgggctcgagtgatcctcccacctcagcctcccaaagtgctgggtttacaggcatgaaccactgcacccggccccattgtatttatatactataatttaattatccatcagtagacacttgggttgcttctgtcattttctttcttaaaaagtattttggagactatcataaataaaaatgttttaaaactccattttgaattgttcattgcaaatatatagaaattcacttgactttggcatattgaccttgtatcctttaaccttggtaaactcacatattgttctagtagctttttttaaaccattatatgaccttgtcatctgcaaatttagacagtttacttttccctttccaatatgtatgccttttattgctttttttaaaatctttttaaaaatattgaactgactgggaccttcgtacaaaattcagtgttagtagtgaaagtgggtattcatgccgtccttgtttctaatcttaggaggaaagaattcatttcttcacaattaagtatgatctaaatagtggattttatagcatgagaacagttataatagtagctttaaaatccttggtggataattccaacatctgggtcatcttggagtgaatctccgctatcttttcccttgagaatgggtcccacttttccagttcttcatatgtcgaataagtttggattgtacacattataaacgttaagttgtggaggccctacattctgataagagaacaccttttctctaataggttttgtttattttgttttagcaggcatttttttgtgattgaactctaacttcaaactctgtttctcaggtggcaggtccagtctcttttagactcttttgtctctggctgagatgcttttgtttttgctgtgtgtgtccgtggtttgggatcagccacagacaggagcagaaagaatttgggaattccctctttggctctttctcttccagaactctttcttctctcttttggcagttatagttgccctgaactcaaccttccattttcatagtccaaaaagatggctgtttttccaccagcaccacacctggtttgcacaatggctgcacctgcctccaagctaaaaacagcaaaaatgggcgctcacttcctgtaacatcttttctttattgcgtggacttcccaccagaatctgcctgctctgtccactttccattgttttcaggtagctgcattttgtattatgtccacctagaaaaaccacatccagtcattcctggaagcagaagtctggtatgatgtgttaaggacaaatattaagatgcctctctccctcttttttttttttttttttgcagtatttagatgcttttttgttgttgcaggttttcagctccggcatgggcttccctattctgctgtgaaattaatatgacatctagtggcttggtaaagaagatctggactgattttaatggacacatctggatttggggcttcttaggtgtggaggtggagacaggggccagtggttaccattacgtttcaatggttggtttttaagaaatatttgttggaaaacaaaaactgacacacataaagaccttgaattcaatctactccttaatagttaggaaagaaagaagaagggagggaaagaaaatggaaaagaaaataggaaagaagggtaagaaaagagaaaaggggctggatgttgtggctcatgcctgtaatcccagcactttggaaggctgaggtgagaggatcacttgagcccaggagtttgagacaagcctgggcaacacaggaagatgaccccatccctaaaaacagttttaaaaattagctggcatggtggtgtgcatctgtagtcccagctactcgggaggctcaggtgggaggatcacctgagcccgggagttcaaggctgtagtgagccgtgatcacgccactggactccagcctgggtgacaagaaatgagaggaagagaagacagaaggcaggaggagaaggagagctgggatgatgtgggcaaagggcgttcagggaagaggaagcaaagctaagggcctagaaatatgaaataacctgacagatccagaaacaggaattggtgggaaatatggcttataaagtggtctgggcctgcgcgagagctctcatggcgtggggtggaatccacattctgtacaatgggcacggggcagcccttcgagggcatcaccatcaagggagtgccctggatcctccgtgctcatgtccactccttgcctctcccctcctctgcagtgcaaggaaactcagccctgttgccggtcttctccaggtgctgaatcagctgcctttcgctgagtggccagtggaaggttctggtaggaaacagggtgggaagaagggagaagttagggtctcatcccgtctctctccatctcaggtggcatatccagcagtggctctttttccttcatagctccagctcctgccagagggaccctcacaggttctggctcctgccagtgatctggctgggggatctgggaacagcaccttaccccttcactccttcatcctaagaatggcagtgactttgtattcctgagaatcttgggatttctcttcccagcacctccaccaattccctgcatcagattccctttgttgtaactacttggagtggtgtctatcttcctagttagcccctgaataatatcggggggacactggccccccactgctctggtttccacacagagggctttttctctaaatcctcctggcgtcttgctctgctccttaatcctcccgatggaagtgtgctgagttagctaactagtgggtgacagcagtcggcccacactctcatttgcgtggatctctcctggtggaactggggagtgcattttagcatgctcatcattgccaagctctgtcctccagagtagtctgttctgtaatgcaggtgatattttaatctccatctgtctgactccctgagtctgaattggttcccaaggctgggacaaggagtcctgtttttttgtttgtttgtttttttgtttttttctttctcaaactccaatagcaaggaagtggaaaaaagattagacttttggcccggcgcggtggctcacgcctataatcccagcactttgggaggccaaggcaggcggatcacgaggtcaggagatcgagaccatcctagctaacacggtgaaaccctgtctctactaaaaatacaaaaaaattagccgggcgtggtggtgggcgcctgtggtcccagctacttgggaggctgaggcaggagaatggcgtgaacctgggaggtggagcttgcagtgagccgagattgcgccactgcactccaacctggtgacagagcaagactctgtctcaaaaaaaaaaaaaattagactttcagtaccactacattatagccaagagaaactgattcccctcagcctggcatattagggagaaccttacctgcaactcctctccccacatattctcctaaacttagactcttcaggaaccactgagactctgtcatagccctgacgtgcaatgtcaggagcagggaataatgaggccagcttcagagtgtgggagatagtggcacaggccccaccctcacaaatgtccacagcttagcttaatactctgttcgctgtcttgaaactctcactgtttttaagaagttgtcccacattttcattttttcgccagacccctccgactatgtggcttttcctggtactccctccctcttgggcgcccaagctccttggattgttaaggctggcggtgctgcccaaagcatcccccccaggacttctcgatatggacagcagagggcagcaaactgccatttgagggctcctcacccaggacgacccaggggtttgaacctggctttatccacgtggggtgagaggggtgggaggagggtggtattagttgtttgcgtgtttttaataattgaaaaccagaaacccgacactctgagcaccacttcaggtgatgtgctgtgtggcattttctgcccttgtggagtccaaccatccattctgaaacagagcagttcctttgaccttgacagtacagtaagttaacgttgtccttaggttctcggaactacaacttaaagggaaaccaattttactacaggctaatggctataaactagagttgagttcctacagtatatttcaggtcacaaaaacatcagcaaacttctaggtaaagactcaaaacacttctaatactaaacactgaaataaatgtgagctatacatgcatttgatgaataaaaacaagatcattatttacttagtaattccagttcagggtaatgagtgctcgaagcccctcctggcagctcagggcacaaggtgggacccagccctggataggatgccattccctcacagggcgcactcacccacacccacgctcgctccgactgggaccatgtagacacaccagttctcctaatgtgcacatcgctgggatgtgggaggaagtggtagtgcctggagaaaacctatgcagacatggagagagagtacagactccacacagagtgtggccccagaaggcatggattttttttttcttatccatgttctaatgaaatggtgtaggctgggcaacgcagtgagacccccatctccacaaaaaatttaaaaattagctgggcatggtggtgtgtacctgtgatcccagctactcaggaggccgaggtggaaggatctcttgagcccaggaggttgagccagcattgtgtcactgcactccagcctgggtgacagagcaagaccctgtctcagaaaaacaaaaacaaaaacatgacattatttgaggacctgctgtgcaagctagtggccagcatgtgcagtgccgcatgtcccacgctgctcctgataatatctagatcaactacaaagagtcttccagggggtcttccctgcatggggtcttccatatatcacctctaatccttacggtaccttaacaaagtctgtatttttatctgcatttccctgatgaggaaactggactcaaaaatgtacttgatgtaacttgtcctaggtcatacaactgtgaagtagaaaaagctggattcaaatccaggttttacctagtccacctagtgtctaaaaggtatgctccttctacaagtccaatgtgcctctgtgatgcataaaagggacaatgacattttgtcttgcctttactttgtagggtgaagttcttgtctgaaataacaatccctagggcggtgccccagccctctccaaggcacagtggacacctgtaaacagaaaagctctcatgcaccaaatgcctgtgatctgggattgcatctgtcatcaggcaaaacaatgagagaaaaatgtattaaaatctttttgttgttgttgttataataatccaacggcccatgctactctctcctaaagcctcaagttctcaggaaaagctcatcattgatttgagcctaatgaaaaccgtctttggtgagcatgcttccacattcccaaccagcttgtaacagttctatagaaatgtgttaaattcagaagctacttagaaggcttcctagcctcctaaggcatccccaaagcatgtcaatatcagaataagacagagctgacatttttcctattagaaatgttgtagtcctggaatcgcaaactcaaatgcacaccagggtcaggcaaaacttacaaatgcacgaagcagatctgctgtaacaggcagtatgtgcctcactgatgggcattcacaatgaaaacaaaagtgccgtgtgacttagcccatctgaggggtgaggttcattgagcccattatcttttgctttgccttagtggctagggaatgcatggctgaacgactatgggtagtgacagtatgggaaggagcgctgtgtagtggctaaggctgagggctctagaattacccagcaggttcaaattcaggttctattattgagtagctgtgcatctttgggcaatttactccagttctctgagactccatttctttatctgtgaaatggtttaccatgcagtgttgtgaaaagtgaatgggaaggtggatgccaagtgttgacaggactcacacatggaggctgtcatgctattctcctcctccaaagtcgatctggagtttggaaagcaggtattctgctccagcaaaagatgctgccttgtttcatgtttaaataccttctcctgtgtcatgctttacataagcccttcagctgttttcagaagataattacacattttaagttcaacaacaatgagtaaaatggccttcctttgttccctttgccttctctttagccctttgggctgaggagagtatcttgcctggagttgctggtaggaagagaagaccctcctttatcccaggatgaaactgcacatggactttcttgaatttcactgagataaacaccagagaagcaagtcctgttgcaaccccccaaagcaacctctgtgaacctgggaaggggcacctgccagattcccacagtgtcagagtccccaagaatgggacctcctgcagaagccccccaaggacaaagctgaacccttccctgctgagctgggcttcagccaagaggccttttagcaaaggattacagttccagctgggatcaactgactccctgagggatgagaggcaagtttgtctgggaaagggtctgagttggcaagatctgggatgctggaggggctcctggaagggaggaaaatttccctcctccaatgctccaaacacctggtttggacgaaactctgctcttcaacacaacctgtgtacctctttttctctacacctaacaaggaaagaaaatcaatgtggtcatacttctggccatcccaaactctgaatccaaactgggggtctcccacaagactctatttctgtggccaggacgcccaatcctgtctgaaacttcttagcatacaaagtacaatgcacctattttaaaacttggagccaggtttcaaaggtgttttgtgtattgttttacaattaaactatgaagatcatctatatttcgtggatgtagatacaggtgtttgtgaacaggggtggtaaggcagatttatcaaagtgattatcacattgaaatgttagaagctgcctccaatcctttttggaatgagactgggtatgaaaatcaataggtaaatgcaaatttaattaaaatatgtgtcgatcagtatcaactggctctaagacaagagctttgaaaggggatttatgcagaaaaagccaagttgtaggaacatagggagccaaggcattggtttctagatttggaggggagatatgtaaagtactggggttgggccttgaatgtattcactctcaaactatcatcatgagtccctgtcggtaggtggtctggggcaggctggagagcctgatgaggtcaagtccatggtgggaagagggactgaatttcccctgaagagagcctgctattcttagcacagaatgggagaacttgagcacttcacccttgactcttcccttcctgctctttctccttcagcctcttttccttctgcctccccacaccctctttgaagctccaaagtggagtaagtggcattccatatataccttttcttcctcagaactttgccaacaggatgaggagccaccttcaagtggaaacttgaagtccttttcttctatctcttcctttaatcatggcccctccctcccacctctaattgaatcatcctttctctctttaataaatattttcagaattcctatgccatgagtactcttttaagcttggacctgtccacagaagagccaaacctgagagtccttggtgattggcaggcacaggtgaagtcccttttcttccctaatgaggagtcttgacctccttaacattttccttcccttattactgacgtcactttaggactcaccagtcacatctcttccataccaccctggggcctgcatattttcttaaaccacagaagggaattgacatttactgacacttaattatattgaacacttactatgtgcagcctccctggagggcattgctgtccctacttctcatggtacagcatgccgggaaacatatattaaaagaaaaagcagtaattaaaacagaaatgggagaaggggcccaggctcccagcttttggctcagttgctcttgtggcatgagagaaagtgtaggcttggggctgagttcgctgggagtctgtggcttgtcatggctgcgttgtcagcctttgcttgtggagttcctccagaaagccctccacctgaagcccaggctgcagcacctctacactccaccctctatgattcgatccaacatggaatgatgatcccgagtaatttataagctgactccactgacatgggctccagcaagtcctggcgggtgtttggtggtgcagggggagcggcccttgctggttggcacagaaacggaacacctgcaggccccagaactgtccccagcccgctctctcctgcaatcttgcactggatctcacgttccagctcagatgtgagggagatcagacataaaattccaggggctgaaaattcctcgcataaggacatcccccccatcctcccttctaatttccagtgaagcagaaattttaactcctcagggcaacttttcaaagctgagtaacttcagattacacactcaagtcctgttatttgttaacagcatttgaatgagtaacttgctcccattgctttgaaaatatttcttttaaatggagaagcaggagcaattagagatgaaaagtacctgtacagtgccttccaagatgccagaggctgttccgaactggcattccaaagtgggtaaaaataactttctttaggaaaacatagaaggagggtgacttacagggggaaggagcaaagggcatgtccgagctgtaggaaagaccactctgtgcttgtgtgtcaaggacctgtcctctgatggccagtttcagatgcagacaagtgtttcttgctacatttggattttccaggctgctagagaaacaggcctaggcttttgggatagaacagggatgtcgactaaatatatatatatttttatatatatatttatatatatataaataaatatataaatatatatatacatgtgtatatatatacacacatatatacgtatatatatatacgtatacatatacatatatatatatatatgtatatatactaatattctgaaaacatggggccttttcccaccctgctgtcttttatggaagggtcatcttcccacagcacacccagcaatccccacccacttccctagtgctaagctaagctatagaaactctggaaaaaatagatgtttctacttctcaaaagaagatatatatgtggccaagaagagtatgaaaaactgctcaatatcactaatcattagagagatgcaaatcaaaaccacaatgagatactatctcataccagtcagaatggctattattaaaaagtcaaaaactaacagatgctggtgaggctgcagagaaaaggaaatccctataccctgctggtgggaatgtaattagttcattagaaaaattagttcagccactgtggaaagcagtctggagatttctcaaagaatgtacaacagaacaaccatttgacccagcaattccattactgggtatatacccaaaggaatataaatcatgctaccccaaaaacacatgcacacatatgttcatcacagcactatccacaacagtaaagacatggaatcaatctaaatgcctatcagtggtggacttgataaagaaaatgtggtacatattaaccatggaatattatgcatccataaaaaaggatgagatcatgtcttttgcagcaacatggatggagctggaggtcattatcctaaacacattacagtgaacagaaaaccaaatatcacatattctcccttattagtgggagttaaacattgagtacccatggacacaaaaaaacgaaaaacagacaccggggcctacttgagagtggaggatggaaggagggtgaaggtggaaaaactacctatcaagtattatggtgattactgggtgatgaaataatctgtacattaaatccccatgatgccaatttacccatgtaacaaacctccacatgtacccttgagcctaaaataaaagttggaaaaacccccaaaacaagtaggtagttttgatgatgcctccaggatggacacttccgagcaccctgtagtctcttgcaccccagatggggactgcaaagctgtcaataagagggaagatgctccctgcagtcaaaaaatgaggccagagacctggaagattattgaacactgggaactccaccaggctctgagctcagctcaaagagggtgtattatatagatcagtggttctccaaatgggttgcacaagaaaatcacctggggagctttaaaaatcctgatgtcgggccacacaatatctactccaaccccaccccagccaaggtctatactcaagaaaccagaatctctggaggtagaaccctaggagcagtcatcgtcacagttctcaggtgattctaatgtgcagccaagtttgagaactagttgcgaatagttgagaactagatgcaaaatggttgagatgattcagagactctgggacccactcagggaacagatgaatgtataaatgaatgattatttcttgcttggattacagcaaaagacttttggctggtcttattgcttactccccaccccctttgttttgtctcagtccggcaaccagaatgaatttttttctttttgagacagagtctcactctgtcaccgaggctataatgcagtgtgatcatggctcaccacagcctcgacctcctggggctcaaatgatcctcccacctcagcctcccaagtagctggggctacaggcgtgagccatcatgcctggctaatttttgtatttctttttttttttttttgtagagatggggttttgccatattatagaattatcttttcaagaatataagttggagtgtgtccctgttcacctcaataccctctatggctttcccactaattcagaataagagctggcatcttcataatgacctacaaggccctgtatgatttacctttgaagactgccccatgcccacctgccctccctctgatattatcttttactaccaccccccttcccaccctttgtgcccacggttccagcaatactggcatccttgcagttccctgcaggtattaggtgcactgctgccccagggcttttgcacttgctataattctgctctttccctatatagtcacctggcttgtcccttacttttttcgggtctttgttcaaatattaacctgctcgccttacattcatgctcctccatgcctactctgcttatcaggaggtttatttttgtgtatttatcctctttctccctatctaagtggatactggagtctgtacagcatttttagaccacttacagcttgtgaaaagttgggaatccaaattcctgatttctctctttaatttctgcctgcaagccggccaacactttctaaactcatctcttaactttaattccttgtcaaatgcagccaatggcaacatattatctaaactcttcccctagactaggggtcagcaaatagccaacagaccaaatccagagtgctacctgtttttgtaaataaagttttgtttgaacacaaccatgttcatttgtttacatattgtctatggctgttttcatgctacaatggtagttgagtagttgcaaaggagtctgtccaataaagctgaaaatattcattatctggctttttatggaaaagttggctggcctctgtgttaaatgtataaactcagttggctcatggtctgctttccaagttatcgccagccgtacttcattaaattttttgccactgcatatcatggatttccatctatccagcctaactggtaagctaatgccacatctcttagatttttttaaactattgcaatatttcactcctgctgttagtcaggataattgacagcagctgctacaatcaaaatctcaggggttttgatctccaggtaaccggatgacagtttgtttactgctcatgcaaagtcagaagtcaggtgggcaaccatcctccatcttgtagctgtagtgtcttggaagatgtgacctccaaggtcactgtagcaagttaagagggcgatggaggaagaatataattctcaactgcctttctttttattggccagaactagttataaggcccagatctaaatagaagagggactgggaaatttagaagagaacttgaatgtttgattagttctagtcagtctctgaaacattgatcattaacctccaaacaagatgggatcttaactcattcctgtaagagcctcttggaggatctacataggatggccttccacagctcttccagagggcctggaggtctttcttcatatacagctaaagcagggagtttcttttcacttgagagctgctagtgcagaagaaaaaataattgaatgaaagaataagggtgtgagtgaagaaagcaggttggtgaagaaaagacctgtgggaaggaaagggatacttgaagtcaagaaaggtagccattgggaggcctaggcgggcagatcatctgaggtcaggagttcgagaccagcctggccaacatggtgaaaccctgtctctactgtaaatacgaaaattcaccaggtgtggtggcaggcgcctgtaatcccagctactcgggaggctgaggcaggagaatcacttgaactggggaggcggaggttgcagtgaactaagatcacgccatcacactccagcctgggggtcaagagcgagacttcgtctaaaaaaaaaaaaaaaagaagaagaagggtagaggagggtagccaaatgagaccaaaggtctgcagaagcctgtgaactaccctgcttttcagagcacaggcaccatttaaatccaagctatcattatgactacaaagctatttacttattttaatactgtattatttaatacagtgaatcaagcattttatgacttgaagtaacttcagaaataaaggttggctttccctgtcattgaagacaggttgagagttcatttctgcttaacagatcaaggtagtaaattacattttctatcagaaagaaatgtttagagagctctaggaggagcgctgggtctttggcctgagcaacaggaatttgggctcagtgcccagatctctctctctctctctctctttctttcctttttttcttttttcttttttaccctgttcatgacccttagaagtcacagaaaccttcctggaacctcagtttctctctttgaaacaatcaccacttgcctcccttggcaagttgtatgatgaataatgacacagtgttagcaaagtttctttgaggtctttggatgaaagacaacctataaactttgctgaagatttactgttttattaaaggaatagctgcatatagtactccactaataaatgttgacaaaggtaaacattcttcactcatcctagcaagagcaggttattcatctattgcaagtacaatgagggagggtgtgttccaaggtcataaaaatttctattaatattgtccagaaacatattttggatctatatctacattgtcacctggagttaaactaatggagtcagtcatctagacttacataatattggataatgaacaaaacaagcatgtggcttagctttgtcccttgacttgggtatgtaaagagtaacatggattgctactcaaaaaattaaaaccagaattctggtaaaacaagaaaaagcttcaagatgaatatggagccttgtactaggattgactttgcagagtatcttgacaaattagacaggaagacatatgttggccacataggaaggttctagagagatttcagatctgccattaattactaatatccaggtttctcatcaacttagtgaatttacagaggcttgaaagcacccacatctgtggtacctgggaattgtaggtaaattctctggttatgtggaaaaagctaaggaatatgagtctaggaaactggtagctctgtcattaactgtgcaatcttgaacaaactattttctgggcctcagataccttatctgtaaaatgaaagcattgaactaacaataaaactaactatttactgagcatatactaagtactaagctctttgttatatactatatgtactttatcttatttaattctctgaggtaggtgatattactttcatttaacagatgaaactgcggctcagagagtttgcaaagtattttatgcatagtcatttatttgataaatatttgctaagcatcttctatatatcttatgtcaagaggtaagggtagacatttagctctcatcctcaatgaactcacaataggagtcatcactagaagatggaagcctgagtatgtgagcttagcaggtctaagctcttagccttttcattgtactggatcagaatacaaacacgctgatgtttcttccatctaaatgaacaagtggcttctctcaatcccactttgcccatcagcttccaccccatttagatgcttctcattgtagcactcctataatgagttgtctgtactgcttgtctccaatgcctgtcctcctattttctcttaaactcaccccactcaggcttttgccccaaccaggcacccaagtcttatcatggacatcaatgatcttcacatgctaaatctaatgggcagctcccactcctcatcttacttgagtatcagtggcatttgacacagttgatcccccttctccttgctatattttctcttcacttggcttctaggacttcccctttctcttagtttctttcctatctccttggctgctctttatcagttttatttgctggtgtttcctcttctcacagattctgagtgttgtaatattccaggactcagaccttggcgctcttctttgtctacacttactcccctggtgataacaccccgtttagaactctttaataccatctttatgcagatgactcccaaacttgtatctttggcccaaacctctctctcagatttcaaatgtaagaaaccactgccacttgccatctccacttgaacataatagacacccagcatcagcatgttcaaatgtgaacccgccatcttttctctgaaacctgttctgcttgcagccttctccatctcagatgattgcaactttaccttctagttcctcaaacccaaatccttgcgtcattcttcactgctctcttgcttacatactccatagccaatccattaggaaacccgtttggctttatcttcaaaatgtatttaaagactgatcaattctcaccactcccactgctatcaccctggtccaagccatcattaactcttagctgggcatctaccctgtgctgggctttgtgccagatgccaggaatgtagataaacaggacacagtccctgcccacagagagtacacagtctagtgagaagacagatataaaacttgataatcatgatgcattatgataagtgctgtggtagagtcgtggaagtttagaagagggtatgtcatctttatatccctttcagctcagatgttaaagctgctcgccttagtcctatatctttaaactaagctgacccacaatgtactagacaccttaaagctaattaaaacaagttgtgggttccattcacaaatactggacccgttcatttacaatacttcagtacctgtctttctacttttatttttgccttcccttccttatatcatgctcatccatgaacttagaggtacaactcagaattctccagcattgacgttcagtgtgtgtttcccaggatgtggcctgcattcacccttcttctcctggcaacttttaataaattgcccactggacccgctccagccccagggactcagacccagtggcctgactggtgctcagtctgtggaagatgacaatagcaatataccttgatgacatctcaaattcccatggaatcaaccagattggtgcttaattaagaacaattggccttggcaccctcagtatgagaaatatctaggtatccatctgttccatttgattttcactgcttccccttaatccaagctctctcctttccttcattctctcccctgacaattaatttgtacatggttttccatacacatctttttaaagtactgcctcagctacatcattctttaggcaaaagtcttctggggttctttattgcctaccaaataaaatccaaattcattaccaatcaaagccctccatacttggactcaaactttccccatcttatctcccagcatacttgtatatagccatgacctacctactcatggagcccataacctgcacacgctttcccaccttctgcttgtgctctctccactgccaggcatggtcttctccccttcattcactgagacaatatcttcaaggcccaagctaactttctcctccatctttcccactgtggcccacaaatctctgcctactctgaagttatagccctttggcctatattcactagcaatgaatcatgtccgtccctcttcataacatctattgcaatgcagtccttattgttttatttgtctactcttacactgctattgatccttttgtcagctatgtcttctcccttggactatgtcatgaacctgtgcaatgggaaagcacagactttcgagtgagatatgggttttatgccagctgtcttattgattagatatgtgactttgagcaagccactcatcatgcagcctcagcttcctcatctataaaatggggataataactgtctcataagactgtcgtgaaaattagataagacagcatgtgtgaaattgcttaagggtgcatggtacatagtgttttttccctttttgtgtcccgcatggagctttatacatagcatggcttgaaaatctattgatttaattttgaaacaatatgtctataattaccttgaattatgaacaattagagaacacccatttctgccatacacattagtgccataaaacacctggaaataatgggtacattgcatccttttaaatgcataactagatttgcaaaaggaaaagaaaaaaggaaggaaatgctccatgtccacaaatggagtgtgagctgacataaggagttgcaaggagtatctgatacttcggctgtccttgagggcaaggttgtccgtttggggtttcattgctcattcaggaacaagacatcaaactgagaagcctgcataagccaataccttttaaaggcacatttggggaaattctgcttagctgtaaagagctctgggtaggaaaaaatgttttccttctgagaaatcatagcaagcatccaatcgtaactaaaggattatacccacagcaggtataataccatagggtttgagtttaaaaaaattttttgggggacagggtctcactccattgcccaggctggagtgcagtggcatgataaatgctcactgcaacctcctcctcctgggctcaagcaatcctcctacctcaggctcccgaatagctgggactacaagcatgtgccaccatgcctggctaatttttgcattttttctagagacagggttttgccatgttgcccaggctggtgttgagctcctggactcaagagatctgcgcaccttggcctcccaaggtgttgggattacaggagtgagccaccacacccagcgaggttctaatttatactacttgagtgtgggggaggtcatccccaataattcaacataagaaacaacttgagctgataacaaggttggcagaagcaaatgcaaaaacctttttgaagagatactcttaacccaagctgcacagaaattccataaacctcaccgaacatcaatccacatatgaaacacagaaacaatctcacaggaaacagcagacataaaaaaataagcaaagcagcaaccacaaaagcagcagaattacacccccaagttagcaatatttactgcagtggctggacccgggtccgtcttcaaggagcattcaatcagactgggaaacaattcattaacagtctaaggcaataaagacaaaacccaatttaagaatggcctgggatccacaaggtaattagaatatgctgttcagcaatcagcatgtcattttccttagaaaacaatgttttacccagtagatcacaaaagcttttggaattcacaagtcagaacctgttgaggacactgaggcacagtttccggcacaaatttgtgctccataatcactggctaaat

SEQ ID NO: 15 - DNA, 150395 bp, Artificial Sequence
  Synthetic BAC sequence
cctcttcagccttgggagttcagatgctgatctcatttagggaaagacatgcatgatttcctgctgagctgctcttttgtggagccaaatgttaaacctttgaatgtgagaaaaatgcacacctgggtatttttgtttgtttatgatttataccccataaaatccaaaatgcagaatgtgaggaaagctcactacatttatgggtaacataaaaccggataagtacaagttaaagcagattggaaaccagtaaaaggagctgtaccctgactgttagtagctattagaagcacctgagacaagttaattattgtagttgaactctgaatttagctttgaatttcttggcacataaggtgaaaaggggaatgtggagtacatggttctcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatccgcccgcctcggcctcccaaagtgcggttctctttatttgtagacagaaagtaggaagttttgcctaaggagttggacattttcctaataaccaattcaaaaaggaaatttaaatgtagatacttattttaaagtatatgatgactcaggtcttagtggttagtgcctgtcaaggtataaaaattagccagtcagaatctgccaaatctggagcaatacggtgcctcacacccgtaatctcagcacttagagtggctgaggtgggcagataacttgaggccaggagtttgagaccagcctgggcaccaaggcaaaaccctgttactactagaaatacagaaattagttgggcgtggtggcacatgcctgtaatctcagctactcaggaggctgaggcgggagaatccactgaacctgggaggtggaggttgcagtgagcctcgcaccagtgattccagcctagacgacagggccagaccctgtctcaaaaaaaaaaaaaaaaaaaaaaaaaagtgccaaaccgcacaaaatataaaatctcatttgagtgtcagatccacgtacctctgcttcaacaaccaccacggcagtccacatttatcatctctcgcttggactgctataatggcctcctagtatatatatatatacatactttctgctctcttccggagtcttctccgagccatggtcagaggtgccttttggaaggcagagctggttgtgccctgtcactgttccaggcctgtctgctcactgtgtcctttggtctcaggatatttcacctctccagctctcctgccatcctctctctcttgctttctctttagcgcttctttctggctctgtgccctcttctctcttatggaatgcttctcttgcctaagcctcgtcttctttcttgggatctgagttgcatcatcattagaagtgtccctgaccctgggggcccactcctcaccgtttgtgctcgtgtccccccgtacctctctccctggtgcttagttccgtgtggtatgttcctcacttaattgtaagcctcacgagagcaggccctggctcagcttttgctttttttatccgcagctctgagcattgtgccggatgcggagcagggggttggtagatacttgagggaaggcagctattactctgtggctgtctttggtctgttttgtgctgctacaacagaatgccacagcctgggtaatttataaagaacaaaaattcatttctcacatttctagaggctgggatgtccaagatcgaatctgtagcatctggtggaaggcacatgaagggccagagagagccagcttactcctgaaagccctacttatagcagcgttaacccatatgcaagggcagaggctcaacacctaaacccatcccaaaaggcctcacctccaacactgttgcactggggtttaagcttccaatgcatgaatttggtgggggcacattcagaccactgcaatgatcaaacgctgcagcagccagtttccccagtggacattgcatcctgctgaagacatttctctctgaagcacagtgctaatcataccacttccttggcacgcaggctttcaagggagtatccatttcctacaaaatacaatctaaactgtcttcttcgcccccataacctgtgcccaagttgcatttccaaactcccagtctgaggtccttaatccatgcccagaagctagaatgcagcactccaggccttggcctgcactgtacccccagccttccctgcatgtgccagtctaaatcattcctcaactgagaccacctgtggaaagtcataccttccattgctgcaactctaagtatctctgacatggtacttattttctatctgaatgatagttattttatgtatcttccatatcagttgtaggcaaaacccgtacattgtctagcatgaacctttcatagtaggtgcttaataaaaatgtgttaaatgaatggcaacttaagtcattatttaacatctttgtaagccagtctttaataggaaccatttcccctccagatattctaatttttaagaaagtttctgtttgtacatatatgacaaatggctagtcagctgcagtctcttgttttttttaaaaaatatctctaaagatgagtgaacatgaatccaattaatatcctgctttctgtgcatatttcaaagaccttgtggatcttttattgcaagggtatagtagtattctgatactgaatgcaagaaagtaaaacaaaattgatacttgtagcatgtcatttcaagagaggactgcccaaattagcaaactctttaaaaaacgacagatgggtattgaacttgtttctagatgagcatcaccttcccaagccagccctcttcattcagccaagcagaggtcttaccctgaaagttactgctcggtgccatgactcctgggatgagagaataacccacacctccatttcctttccaacaggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagaggtaagttggcctctgtatactggaaacttcattcaagggcagactgttgccttcctttaaaccttccttggggcagagagttgtatttttggatgtctgcttcttaccttctgtattagtccattctcacactgctatgaagaactacctgaaaatgggtagtttatgaagaaaagatgtttcattgactcacagttccacaggcttaacaggaagcatgatttggggggtgtcaggaaacttagaatcatggtggctgaaggtgaaggggaagcaaggcacgtcttctcatggtggcaggagaaaggtgggtgggaaccaccacacacttttaaaccatcagatctggtgagaactcccacagtatcacaggaacagcctgggggccacctgccaccaggcccctcctctgacatgtggggattacgattcgagttgagatttgggtggggatacaaccaaaccatatcaccctccttctttctcccacttctttttcctgttaacttctaaaaagccaaagtgatttggaagcacctgaaaggaagcaaataggatgtcccgtgccagtcctctgactgtgtctgaagtcagctgtgccctgctcagccagtgctgtgcacctttgcttgaggccttgtggggtagtgtggtatgaaagctgggtcgagataggccctgccactcagaatgatgccctccctacacccaacccctaggtccaagggcactcccaggcattgtagatagacgtcaaggtggtactcagctgattggcacctgccctctgaaaccatgataccttgagtttgatattgttgcttttgccatttccactgccttcgcttttaattgttttagatagagtttattatatattaggatccaatctctttttacggcttttatgtttcataccttcctccctttaaaaagatgtatatttgtttgatcagggtgagttgctttgttgaataatgtttgttgttggcattccttaaaggttgtattttttagtgtcttctatccatcacccaattaattgatccatgttcagtgagcagtttttatttgcagtggccccagacctttcaggttcaagagcccaccttagctgtacaaagactttgtgctgaggagggagagagggagaaggatatatttcttaagaccctgggctaagcaatgaggatttgggatgctgcaggccctcgtagcacaagccccctgagcaatggacaggccttatgagaatgttgttgaggaaaggttatgctggcagaagaggatccaggggagttgactcagatggacaatttaagcttaggggtcatgagctttcccacaatggtggcagtgggaatcctgtaagatgttttgaatggaacttagaaactaactggatattaatgaggaggaagagtcaaaagtcacactcacattttatgcttggaaggatggtactgccactaatagagataaggaaataaggtgttcaagaggaaataggcaatgattatagatgcaagactagaacttggatgacaggtaaagactggaaatataaattgggaatcctgagcattaaggattgggaatggagacctagctgcagagagggaatagaaagggcacaggaataaggattaaatttggggagcagccactagccctaggataagtagagggagacataaacagaagaacagaggacaaaaatgagtggggagggcgggaattggctcaacataatgtctaggaagcccaggaggtgagaaggtggctgtatcatgaaacatggctgggacgcctggaaccagatgacctcctcgcctctaagaaggaggaagcaaagttacctgtgtgtgattgggagtgtggaagatgagtgttaggcaatgttagtgaatagctaagttgtcagggatgttctctgtagttgaaattccctgcctggacaggtgcatttgagaaaagatgaaccagacagcttactcaatttcccaaatgtcaaattactggtgtcctcagacgatacacccaaagctctatgcaaattcagggagcagggaaaggttgctcttgactgataaaatcacaggaatttttatggagaaggtggtgtgcatggtaggtggggttttacctttaagccttttatctgtttagaatgtgtgtctgcatttggtgtgaagtagtagtccacttatattttcttccagataggcgtttgtatcaaaaccacttatgaaatgattcattctttcccagttaaacagatctgtcccctttaaattaccatatattctgagagctgttcctggagtcccactgttctattccacccactatttgtgtctacgtatcccagtaccatgtggatttgattacagtggctttatagtatatactgatatttgatgaggcgagtcaggctcactattctttttcatatattttctaagctagtaaccaacatttattcttccaaataattcaatcacttaaacatataaagaaaaacaaaaaccttgtttgagcaatctaattgtaattgcatcaaacttagatgttcttttggaaaaattttatattaaatatttctaatcaagaatgtatttgcattctcatttcattttatgtatttcaataagattttatcattttcattatacaggtttgtctctttcttgttaaatatatttctaaatattatataatatgttgtaatttcctgtttctagattcgaattaatagagaaaagctcttgattttgcatatctgtcttcaatatggccatcttagcaaattctcatacttaactttagtttttcccccagattcctggggtacccttgtatagttaactgatgttagttgaaaaagttttggtgttttgccctttaggattatatttactgtaggcttttattaatggtctttattactaatttaagtgttttctttctattcctattttacttaggatttttattagttacagctgcaatacgttatcaaatgcttttcagcaactgttgctatatgatttttcttccaagttgttgacataacaagttaatacatttcctcaatgtgtatgaaacaccatagcatttctgaaacagtcttactttggatttattgttgcattctatttgctgatattttacacagaattttcacattacatttcataagtaatattcgtctatacttttttcttttcctttttttttttttttgagatggggtctcactctgtcacccacactggaatgcagtggcatgatcttggctcactgcagcctcagcctcactgggctcaagcaatcctcccacctcagcctcctgagtatctgggactacaggcctgtgccaccatgcctggctaattttttgtattgttttgtagaaatgtggtttcgctggtctgaaactcctgggctcaagcgatctgcctacctcagcctaccaaagtgctaggattaaaggtgtgagctgtcacacccaactatatacctttttcaataacctgtttgccaaatttcagtcttgaatgtacactagtttcataaaaagaataacactggaaataactattctttaaagattacataaaacttactcctgtgaaactatttggtctttatatgttttttagcatgtacttttaattaattatttttaattgatagataaaaattttatacatttatggtgtataacatgatgttgtgaaatatgcatacacagtagaatggctgaatcgagctaattaacatgtattacctcacatagcttaccaatttttgtggtgagaacacttaaatattctcttagcagttttcgaggatacagcgccttggtattaactgtagtcaccatgttgtacagtagatctcttgagcttacttctcctaactgagattttatatcacttgtggcctccacctttttcagtggtaaatagctaaacttgttagttgtggtcatttccacaatgactgatctatttgttgacattttccccttctttttgactcagtgttagcaagttgtatttttctgggaaagcatctctatctgctgtgttttctttgctttgccgtgtgtgtgtgtgtgtgtgtgtgtgtgtgtgtgtgtgtctgctttagggttatgtgaaataatctcttatgtatcttctaatttgtactgtaattgtggttttgccacttttcttttttctcctttttacttgtatgaagagtttattttgtctgtctaaaggaccagtttttaattctgtctgcattttaaatttctatttcattgatttgagcttttatctttattaattcccttttcctggcttcctttgatttctttgtggtttgggtttttttttttaaggatgtgtgttttattctgtaaatttttacctttaatgatgaagacatatgaggctacttcattaagtttccttcaagtgcagcttcatcatggctgatacgttttgatgtaaaatatctcccttttcattgctctttagtttataattttcttaattccttttgatccaaggttatctaggaagccttgtttcttatttctgagttattgaaactgcatatatactagtattttcttagtttcttcctttcataaacaggtgacattcaggggctcatgatccgtgagaaataatcagttttttctaaagtagagagattagctatattggttgttaacctatgaggctttatcacaataaagagattttctttgaagaactgtagctagctggggcctgctcttacagatctcctccaggtaaagcatcataattaggcagttttatttttttctgacctttgctaaaaggatctgtcaacgcttcttaaagctctcatctttccaactaattttttaaaaaacttccagaaaaataatggattctatgtatagcaataaatttggagatagtttttttttaattaagtagattacgtaagtagtatagcatatagaagatgattcatgttgaaaaactaaaatgcttttatgggcagtaatatctgtttcatgtgttttggagtcaaaagtgtaaaaatactgaaatccttttttcctcacagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtaatggttttgtctctttcctctgtgggcagatgctgccatgaggcttgacagaagtgaggaaggtgggcctgggaggcgctgggcctgcgccgagggaactgaccaggttgttggattgggttcctagtggtcagtcagcagttgaatttgcatcatccatagggaaaacttgggcttgattctgtagaagagaaggggttttatctggctggggtttctaaggttcgcagaactggaattcagttgggtaataaaaagtgatgtgtttttatctctggctgcagagtagaaaggcctggagaacttttaaacatccggctgtatcctagatcaattaaatcaggatctgtgagaacaggacccaggcatgtgtatttttttaagttccgcaggtaatttcaacattagccaagttttagtctcagcagcaacatggtatgcaaatcaggcaaaagctgagttggtatgtttgtacttcagacataccttgacatgttccatgatggacttccaaggccttctaagaagttacatgcattaaggcaggaaaatataagctctcagtaccagaagaaatataaattagaatagaatgcatggaatgcagtgaccaggaggaggaaaatgttcttcataggctaaaaaatctggctaggctgagtacagtggcttatgcctctaatctcaacactttgggaggccaaggtgggaggatcccctgagcccaggagttcaagaccagcctgggtgacatagtgacaccctatctcaaaacaaacagacaaaacaaacttaatgggcagctaaaggaaagggaaaatagtgttcaaggtccatgatgggaaaactcaccagtgcccctggatggttctatgtgggttttcccctaatacttaactttaaaacaaatttcttctgggagctttatttggggacttcagaagttgttaggaacaatgtcatcctcaaaatagaaaatactcagtaatgggtttcataaggctcatttaaaaaagtaacattacttgattaaagggaaaatgccaaaacaaaacttgagggaaacaatcttagcaaaagaggggcaacaaggctatactgtggccaaatactcctctgaaagcctactttattcctttttgttactaggattaagaatccatacagcaggaattctttacttggtgtttttggttccattgggacagtggctttcaatcagcagtgttctgtttttttgttttgttttgttttgtttttgttttttagaaaggctgtttcccagtttcccaaaactctaatttataccttttacctatttctgtggtgtaaatatgcccttcatgggcaatttcaagctaccgatagctattcagctaatgaaattccttaatatttaacaataatttttatgagccagtaggagccagcttctatacaccattgtataaaaaaaaataagtaacatttaaaaataaaaaccctgtgcatattagattcatccaggaaggtttaaaacatctaaggcctaggccccaccctggatgaataaaatgagtccctggagatggggcccagcatcctggtttttattttttaagctctgcatgtagttgaagtgtgcaaccaggtagagacccactgctgtaagagattgggaaatgagccgcaaggactctcagagtttatagacacatgattggcatacaactagcaaacagataattttgcatataattttcgtttgttccaagaagagaatcttaatgggttctcagatgtgcccatgtccttctaaaatttagaagccagcattcaggggaagtttggaatacatgctctttaataacattgatcagtattcctttctttaatggccctttggtgaaaatagagcaattcaaggtttgcaggactggcatatagcaggtgcttgacatataggtgcttcctgttgctatctaagaatagatgcatcactttagcagtcagacgagtagaaggtaagtgtgacatctactgaggatcttaagtggcctcaggaattaaccaaaactctgaatgaatggcttccctgcctctcttgggggggagtcttagctgtttattaaaaatcaattctgattctgtttctgcatgctaaggatgcatgttctcagtccgtaaaactctacctcagagagcacagctaagataaatgtggcctggaaaagtgttaaagcccctgttacccacagaacctgactacagttgtgcactgcatagcagtgtgaagggcggaccacgtgtatggtagtgctcccataagatgataatggaggtgaaaaattcctgtcacctagtgatgatgcaactattatataatacagcataattatttttaaaaataaatttaggttagcctaagtgtacagtacaaaagtttacagtagtatacagtgatgccctaggccttcccattcactcgtcacttactcagtgactcacctagagcaaatttcaggcctgtaagctccacgcatggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacactctatgctgttggttcgcatgacaaaaccacctgattacacattaggaggtgtcctcattgttaagcaactcatcactgtatatcattaatgctgccttgcaaaatatgacttcaaccaatacagccatccagataacttagcaggttagattaatttcaaaatgtgtcattaagcaactaaataaattcctttaatatggagaattaatacctatcaatcaatatatattagaattaatagtttagttttagaaaaactgaaattaagccagcactcttggattttgaaaataaaatcatctaattgatgaacaggagaaattgtacctcatataaaatgacatagtatttgcagataacttatacaaatcatctcttatactttaaatcatctctagattacttataataccaaatacaatgtaaatgctatgtaaatagttgttatactatatttctaaaatttttattatttttattatgtcttttttcgtccccaaatattttccaatctgatattgattggatctgccagtgtggaatcgcagattgggagggccaactgtattcttatttaatagaaagcttgcaagaagtttgaataggttgtagaggtgccaggtgctgtgctagaccctttgtaaatgttatgtaattctcactttcagactatgaggtcatttttctcattttatggataaagaatgtcaggccaccccgaggtcacagagccagtgatggaaataaatttgagataccatctcacaccagttagaatggcgatcattaaaaagtcaggaaacaacaggtcctggagaggatgtggagaaataggaacacttttacactgttgttgggactataaactagttccaaccattgtggaagtcagtgtggcgattcctcagggatctagaactagaaatacaatttgacccagccatcccattactgggtatatacccaaaggattataaatcatgctgctataaagacacatgcacacgtatgtttattagagcactattcacactagcaaagacttggaaccaacccaaatgtccaacagtgatagactggattaagaaaatgtggcacatatacatcatggaatactatgcagccataaaaaatgatgagttcatgtcctttgtagggacgtggatgaagctggaaaccatcattctcagcaaactattgcaaggacaaaaaaaccaaacaccgcatgttctcactcataggtgggaattgaacaatgagaacacatggacacaggaaggggaacatcacacaccggggcctgttgtggggtgggagtagagggggaagggatagcattaggagataatacctaatgttaaatgatgagttaatgggtgcagcacaccaacatggcacatgtatacatatgtaacaaacctgcacgttgtgcacatgtaccctaaaacttaaagtataataaaaaataaataaataaataaagctaaacttaaaaaaaaaaaagaatggatagaaaagaccttgcaaggtatcttatggtcatgaaatcaaaagacttgagtttaagactttatggccttggtcacttagtcttcagacatcagtttcaccttgatttataaacagaatgctcaagtctgcactttctacctcagaggttatcattgaaatattttaattcagctaagctgtgagagatggtactgccttctgggatacaatgcaaataaaacccagcacttgtcacgtagtaattcatggtccttcaggatgaaagaggcaggtaaataaaccattgcaagcaaatgatggctgtagtgtactcgtgaaacaggtacctctgaaatgcagagtgatgaggtagggattctcagggatgttgcctcgatggataaggagacatctttctgattactaagaataggggtatcccatgggtacatacttaggtaccaggggctggggtgctatggtgaattaggcaggtgggccgccatcctgggttctgatgcaggaggcaggcatgcatcaagtcatcacaaaataaatgaaaactgtagctcttgctacctggcagagggacgcagggcattcgtagaacaggggaatttgacctagttcaggcggaagctgaggaaggcttcctgaggaagaaacagttgagagctctctgcgtggtgaatatgcaaccatgaccaaacgaacctctcagctccttccctgtcaaagagcacccactcctagaggtcgtatgatatcatatgagacaatctgtgtaaagcatttgatactgagtagatggatagtaaacactcaatatttgttggctattctgatgtgaattttcattcattcagcaattatttatttatttatttatttatttatttatttttgaggtagagtcttgctctgttgcccaggctaaagtgcagtggtgcaatcttggctcgctgcaacctctgcctcccgggctcaagtgattctcctgcctcagcctcctgagtagctgggattacaggctcccgccactgtgcccagctaatttttgtgtttttagtagagacggggtttcacagtgttggccaggcgggtctcgaactcctgaccttgtgatccacctgcattggcctcccgaagtgctgggattacaggcgtgagccaccacgcccggcccagcaaatatttattaaatgacttgtgtgccatgtcctcaagctagttgctgggaaacagggcccctgttccttaggaacttatattccactgggtgagatggatattagaaaaaaaattgtacacgccagtatgtgtttaccaactgtatagcatgctgtgatgggaaaatgagatgtactgcaagactattctttaagtagggactggaagcttggataccttaagagcaagggaaactaaacaggggaaacagcctgatacttagagggaaattaggcctataacaaactggaagaggctctcaagttcaaaatgttttcattcaaacaatgctttggcgtaatcaaacacaaaagtaacagagtcactgacgcgtttcatgtttttgcttgattagatttgctcttagaaagttccttctgagaatagcatggggaattgagaccagagtgaggacagaaaggagtcagggtctgtgtggtgtggagggagctgcaatgatttgggctggagaactcaaaatacgagggataattagagggattcaagagactggaggggaagcatgagtatttcacaatacattttgaaagataaagcccatgtctatggaaagaatgtcattccacaggattctacctatcccactgttccttgattcagcagatacttttctgggtctaggcactactggttaacatagtggtgagggaggcactcctgcagcttctctgtccttggctattgtgaaacaagatttagcagaagtttaagactaggatgggaaaaagagtggattttaaatgttctcatcacaaagaagtacgtgaagtgcttggtatgttagcctgatgtaatcgtcccacaaggtatatacatctatcatcacattgtagcccataaatatatgtactgcaagactttattcttttaggtagggactggaattattacttgtcaatttaaaaattcagataaaaaataagacaatttcttagagtaaatgattgccttgcgggacagaattaaagagaattctttgttgtaaagaaatcagccccctaaaaaacaaaaacacaaatgtgctaatttttgtggtcctttcttgggcatagattatgagtgaccctatctagaaggtatttcttacttatgataaccacgtttagatgggcttcaggtcatagttgtagtgttctgaatctgtgttagaggacacagagtgaggctgagcaaatctctcttggacttaagacttgttcttctccaattaagtcatagtcgtcatacacagatggaatatgttttcatccttttggtattatatactttttttttatcttaacaggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaccttttttatctgcagaagtgtatgttgttaggaatgaaatgtgctttatgtattgtgagtgatgatatgaaagacagagtaaaggaggtcacagctttcatctttttgaaggtgtccaccaagcttgataattggaactttaggtgttacatctaacagcgtttcttaaacaatacccacaagtcaatcaatccacttgcctatctcactctttagtgcatcattaaaattgacataagttttgcagaatggcttgtctgtcgatcccagacttaccctgagaagccaggtcccatgggctttagcacaccagcccaaccattgagtgttttttgttgctgttatcccaacttgttgggcacatgccaggaatgagggatagagcagaggatggggtacagagataaatgcagcatggctgtttcctacacagtacttaaattctcaggagtgggattgcacattgagctataactcctcccgacccctgtcctcagcatcaccatggggttcatgattcaggtgtatgcagcacaggtgcctaacaaaactttggattccccaagcgtttactgtatgctgggcactgtgccaagtgtgttggtacaatgtatatgtacattgtactttaaaattctcactatagttccagtgacatcattcccccaaactgaggcccagaaaggaaaggatagcttattaaaagtcatgactagtatgtggtggagccttaaagaaggtcactctgacagttcagcctggactcttggcccctgcatcttggctcactgcactgtggaagcagctcaagactagaggagaaatctggcttgggggcaaagaactttcttaaacgatgattatcttggacttctgacaatgagactcaaatgtaccttgggatccttcatttgtgtgaactagatctcagagggtcttgcttctccttatttccttgaagtctgaggcaaagcacgctctggaggggagcatgaacagagaaataacttgcctgcccctttgaaaagggatgattttcagcaagccaccatttgagaggaatgccatggtccagtgaattgctcagagcagagggaaggaaatgatttagcattttgttgaagtcctatgccaagcatcttcaccatttactttaacccaaatactcttgaaacgtggaatcatttctaatttttcaataaggaaatcgaagccttagagatggtagaggcccttgttaaggtcatacaagctggtaagtggcaagaatttagaggtgacagcacctccttgcagttctggtgcggccactcatgacacctttctacctcctcctctaaaacaaggtactttaatacctcaaaaacatcctttgttagtgcctagggttccagtcaccttgagttcagcaaagagagtgacccgctaggtaaaccaacatcattgagtaaagagactagaggagcaaagaggaaggttctggtgtgatcaaggaacaagcaactttgctggaaacccctagtcatttcttcctgccttattgcttcagggtacaaatatgttccagggtactattgaattcttcctgccttattgcttcagggtgctaatataaatagctacgacttattggaagccatatagttataaagtagctacgacttattggaagccatatagttataaagtaatcagtgtgagcaactgataaaattccaataatgtgtaagcctctgaggtgttagtgggtaaaattgccttcaaagcctcccttgtcctgtttgatgccccataatgccccatacacctgattttaagtaggttatcacaagtagcagataagctgctgattacctgactgcatcttttcggcaaatattttcccacttgcttaggtttccaagaagctcagatttttaatttgtgccctgtgctattaataagcaactaactaaaatataaaggcacagaatgattgaaagtaaagaatgaaaaatatatactatcaaaacaccaaaataaatctgatgtagctctattaacctcaaactagtatagctcgaggcaaaaattactactagagttaatgaagattacttcaagaagacacaggtttcagttgaccaggaagaataaagatgttaaacttgtaggcacctaataacatagcttcaaattacataaagcaaaatttgacaaatgaccatagtgggagtttttaaaaataaactcagttacttacagataaagcagaccccaaaagtgtaagaatttgaacagcatgatttaatgtgccgttctaatacaaaatacaaagtaatgaaccccgaaattggagactacattattttcaagtgcatacagaattgttaagaaaattgatcatgtccaaggccaaaggccaggaaactatggcccatgggccaaatcttccctgttgcctatttttgtaagtgaagttttattggaacacagccatttcgttacttattgtctgtggctgcttccacatgacaatggcacagtgggtttgttgcaaaaagatcctatagctcacaaaacctaaaatagttactatctgtacctttacagaaaaaaattgccaaatcccatcttaagccaaaaagcagggttctacatccagtagtcctaaaaagatactcatgattccctttcttcaatgtatagacactggcaaatggttaaagatccctttaataccctcatgtggcatcctagtatcattcttaagtgccccagcctctcctttgattggtggtctgtgggtctgagaataggcttagatcttgaaaggatgagtgaggaatggtgattatatatgtgtgtgtgtgtgtgtgtgtgtgtgtgtgtgtgtgtgtgcgctgcagcagctgacagctgacatctcacctgatcttaatattttattattagaacagttaaactgcccatctaccttatccctatcttgccatctccacagatccctgtggggttgcatccttggttgccatttcctgctacctgttatggtaataactaccttgcctctgacagctaagtgctgtcatctggcctctgctgttccagactcctatcatccattcacacaagggaaacctctcaactctgttcttcaaaccactacagagtttcccaacagcacagcccactcactagtgcattcactctggttttagtgaaggaaatgtctttggcacataggtagtgggtgtcctggtcataaattacaaatccatctcaggagcattgccactttgaactttctgagccctgcctctgttctgcagggcagttctagcatctccgcctcatttactgtagaccatcatttcctccagacttcaaggagctatccagcagcacgttagtatcagcttcaggtttctgctgggatgttaaatcctgaattgtaaaactatcccacatactgataaaccatccctaatctagtctagtctcatgtcctcaagattcattcccaggcatgttctcccaattcctgctgagaagagtagccaaatcctgcagctgtcttgatgatccttctcttcctgaagcaaggacccaacttccccagttggaccttgctgaggctttaccctagtaattggtctagaagcaatgacaggaggtggggcaggccttggaggaggcaagcacttcatcttggggggcattcatttcagttgaggccttgacatggtctccaagcaaggaagcctgttatccatctgcaggagggagtggactgctgacccagagggttcagaagtatatgaggttcagagttctcagcatttctatccagatgttcccaccccatgtttagggtcccactccttaactattagactattagtgcctgactttaacaggatacttgtgagggctgtcaattcagtattatttgtaacttctagcttggtttttagcacagtctgccctccagctgcatgggctgaggatcactttaaatgccagggagtcctttgacaccatgccctaagttgagcctgatgctgccttccatccttgcactgattgcacttagcaacaaccaacctattccaccatccttataattaacaccacccccatctctctatcattctagagattacgtaagtgagtgtatccccttcctgatgggcccaataccaatttaccacaggtgggagtcttagctatcgtggtgctacaacataccaggggagacgaactgtcgtagtttaggttcccccaagaagcagaccctgaaaaaggactcaagtgcaaagtttatttaggcgaattaatagaaaatatcactttgtgtaataaaaggtgacattcatgaaggtgaaataattttaaattggtatgcacttaatacaattgccataaggatatgaaagaaaaatgagagagcaacaaaagaaagtacaactcaaaatcgtacatctctcagtaattaatgaagcaagcagacaaataccaggaaatatgtagaaattttgaagtactgaaaatacatatatgtttgtgtgtattgtgtgtatactatatccccaaattgtcaaattaatatttttccaatcacatatggaaaaatatgaaaacctgtacttgcaaattaagcaagtctcaatgtatttcaaaggattgctacaaaacacacagtattctctgaccacaatggatttcagatagaaatcagtataaaaggcatctttaggaaagctccatgtatttgagaattaataaacatttctaattagtcatgggaaaaagtcatggaaattaaaactgtcaaatcctattaaaatatgtggaatgcagctagagcagtatttagagagcatataggcagacctgcttagaaatgtgcatattagaaaagagagactaaaaatgagtcattcaatacacaaagttaaacaataacaaaatggaaaccaaaaaaaaaaaaaaaggaactactaaaggtaagagcaaccttggaaatagaaaacacaatagagatgaacaaagtcagcaactggttcttcaaaaatactcataaaatatataaaaccctggcaagactgaaagaaccaaaacgataagaatgaaaatatgagcattcctacaggtcatataaagattaatacaagtatttaaaaaggtaataaaagtatactatataaactttatgccaataaatttgtaagtatagataacagggtgaattctttaaatactataacttaggaaaattgtctcatgaagatgtagaaaaactgaatagtcttaaaatcattaaagataacagtacttcccagtatttccacacagaaaaacccaggcctagatggtttataagctctatcaaactttaaaggaacaaaattatggaatcttacataaaatactccagtgcatagaacaaaggaggcaattttggtcttagtttaggtcttctagaaagtggagcctgaggcaaggattaagatgctaatatttgaccaggcgcagtcgctcatgcctgtaatcccagcacgttgggaggccgaggtggacagatcacttgaggtcaggagtttgagaccagcctggccaacatggtgaaaccccatctctactaaatatacaaaaattagctgggcatggtgggcacctgcctgtaatcccagctacttgggaggctgaggcaggagaatcacttgaagccgggaggcagaggttgcaatgagctggtatcatgccactgcactccagcctgaatgacagagtgagactccatctcgaaaaagatgctaatattttatttgggaaatgcaaattcagcacagtatgaatgagagaaaagtagaaataaagcaagggaaatccaatgaaatgtgatatgatgcattactatattgactaccacttcatagtaagtcaaaagggacatgttaggttactcagtatgtgagattcttggaatgtggatgtttttggaaaggttgcaaggaggaacaatatcttggagtagtcagtggaagagagaaaagggggtaatcttcctgtcaggtaagctcccatctcccagttctcattgagtaacattcacccaacaaggatattactgccatttcatctgtgttgcatcatgccgacttagcagctgttcaggaattgagatccatgtactatgatgtggtgttttattaaagttcaaaagtgaaggggaaacctggcatgtgtggggtgcccaccaagggaaggaaagagggaggcagttaagggaatctgagaaggtacacaaagtgtgtttctaagtatgctttcccatttatttgataaggctaaaataccaacaagaagacaatatgaaaaaggaagaatataggctaatctcatgcataatagaaactgacaaaatattagcaatttaagagtaacgatgtatataaagcataatgaaggcaaaatggggttcattttaagaatgcaaggttaatttaacttagaaaatcaacccatgtaattcatattaaaagatgagagaaaaatcatagatcatctgagtagatgaagacacatacacctgataaaatccaatgtctgctgtggaattaatatttgtgtccttcctttcccaaattcatatgttgaatctctaattcccaatgtgatgatatttggaggtggagtctctgggaggtaattaaggttagatgagtcatggggttagggactccatgataggattagtgcccttataagaagaaaaggctagagtcctccctttctgttcaccatatgaggagatggcgagaaggaggccattttcaaactcagaaaatggtgctcacaagatacagaatctgtcagcaccttgatcctgaacctctcagcctttagaattgtgagaaacaaatgttgtttatgtccattcatgatttttaaaaacttagcaaattaggactagaagaaacctttctgaactgataagagtatctactaaaaaaaaaatcagcttacaataaaaacatttcttttgatgttgcgaatgagacaagaatgcctacattaagacatctactcaacataccaaggttctagacagtgtagtaaggcaagaaaaataaataaatgaagattgaaattcaatctgtcattatgctaatatgataaacttctatatgtagaaaatccaaatgttaaaatggggcagggtgggagtagtgatgaagttaaaatgtagattttttttcagtttttcctttgtttctatatgttttatgatcaaagataagttgtcacctttttaaaataataacttttagtaacaatacagtggttttttcctaaacctcatggtaaccacagagcaaaaacctacaatagattgactaaaaataaaaaacaacaaattaaaacatactacaatagaaaataaccacacaggacaacagtaagaaaggaagagaggagttacaaaacaactagaaaacaagtaacaaaatggcagtagtaagtccttccctatcaataataacattaaatgtaaatggattaaattctccaagtaaaagacatacagaggctgaataaataaacaatatccaactatgtgctgcctataaaaaacctacttcacctacaaagacacacatagactgaaataggggatggaaaaagatattccatgcaaatagagaccaaaaaattgcaagattagctatacttagataaaatagactacaagttaaagactgtaaaaagagccaaggtattacataacgataaaggggtcagctcagcaagacaatattacagttataaatatctatgcacccaatactggagcacccaagtgtatgaagcaaacactaatagatttaaagaaagagactgcaaaataataattgtgggagacttcaacttccgactctcagtaacggacaaatcattgaagaaagaaacattggagttaaactacacactagaccaaataggcctaactgacatttacagaacatttcacccaattgctgcagaatatacattcttctcttcagagcattgtccagaatagatcatatcttaggccacaaaacaagtctcaacaaattcaaaaaagttgaaattatattaaatatattttctgatcgtaatggaatgaaactagaaaccaaaaacaagaggaaactggaaaccatacaaacacatggaaattaaacaacatactcatgaacaatcaatgggtcaatgacaaaattaagaaagtggtttaaaaatttattgaaacaaaaatggaaatacaacataccaaaatctatgggatacagcaaaagcaagactaagaggaagtttataataataaatgcatacatcaaaaaatagattccaaataaacagcctaacgatgtacctcaaggaactagaaaagcaagaacaaaccaaacccaaaattattagcaggaaagagataataaagaccagaacagaaacaaatgaaattgagactaaaaaaaatacaaaaaatcaatgaaatttaaaattggctatttgaaaagataaataaattgacaaacttttagctacactaagaaaaaaatatagaaggcccaaatcaaattagaaatgaaaatgaagacataagtacaggcagcacagaaatgcaaagaatcagagactattatgaacaactatacaccaacaaattggaaaacagaagaataaatttctggacacatgcaatcttccaagattaaaccacaaagaaatggaagacctgaacaaaccaataatgagtaatgagatcaaagccatgataaaaagttttccaccaaagaaaagcccagaatctgatggcttcactgttgaattccagcaaatatatgaagaagaagtaataccaattctgttccaactattcaaaaaaattgaagagtgaggaccaaactaattctacaaggccagcattactctgataaccaaaaccagacaaggacacaacaaaaagaaagatacaggccaatatccctgatgaacacagatgcaaaaatccttaacagaatactagcaaactgaattcaacagctcattaaaaagataatttaccatcatccagtgggtttcatcccagcgatgcaaggctggttcaacatacacaaatcaataatataatacatcacatcaaaaccaaggtcaaaatccgtatgatcgtttcaatagatgctgaaaaagcatttgataaaattcaatatccttttatgacaaaaaactttccacaaactgggtgcagaaggaacatacctcaaaacaataaaggctgtatatgacaaacccacagatagcattataccaaatgggaaaaaatcgaaagtctttcctctaagatctggaacaagacaaggatgcccactttcgccacttttattcaacataacactggaagtcctagccagagcaattagtcaagagaaagaaagagaaaaattggaaagaaaaatatcaaattatctttgtttgcaaatgacataatcttataatttgaaaaacctgacgactccaccaaaaatgggtaaaattgataaatgaatttagtaaagttgcaggatacaaaattagcacacaaaaattagtagtatttatatatgctggcagtgaacaatctgaaaaggaaatcaagaaagcaatcccatttacaatagctaccaaaaatatacaagatctataaataaattaaaccaaagaagtgaaggatctccataaggaaaataataaaacactgatgaaagaaattgaagagaacacacaaaaattgaaaaaatattccatgctcatggattgaaagaaataatattgttaaaatgtcaatactacccaaagctacttacagattcaatgcaatccctttcacaatgaattttctaattacgttcttcacagaaatagaaaagaacaatgttaaaatgtatatggaaccacaaaagacccaaataaccaaagcaatccagagcaaaacaaaactggaggcatcacatcactctggcttcacaatatactacaaagccacagtaaccaacatagcatgatactcatatacaaacagacacatagaccaatggaactgaatggagaacctagaatcaattcacgcatttacagccaacacatttttgacaaggtgacaagaatatacaatggggaaaggacaatctcttcaataaatagtgctgggaaaactggataaccatatgcagaagaataaaactagacccctatctctcaccatatgaaaaaaaccaaaaatggattagacttaaatgtggccaggcgcagtggctcacacctataatcccagcactttgggaggctgaggcgggtggattacttgaggtcaggagttcgagcccggcctggccaacatggtgaaaccccatctctcctaaaatacaaacagttagtggctgtggggttgtgcaccagttactcagtaggctgaggcaggagaatcgcttgaacccaggagacagaggttgcagtgagacgagattgtgccactgtactccagcctgggcgacagagtgagactccatctcaaaataaataaataaataaatacatacatacatacataaaaacatacatacatacatacatacatacttagtgtaagtcctgaaactgtgaaactgctagaagaaaacactggagaagtgctgtaggacattggcctgtgcaaagattttttgagtaagacctcaaaagcacaggcaccaaaagcaaaaattagacaaatacaattatgtcaaactaaaaagcttctgcacagcaaaggaaacaatcaataaagatacaacccacagaataagtgaaaatatttgcaaactatccatctgacaagggatcaatagctagaatacataaggaattcaaacaattcaatagcaaaaaaaaataacccaataaaaatggacaaaagatctgaatagacatttctgaagacatacaaatggtttacaggtatatgaaaaaatgctcaacatcaccaatcatccgagaaatggaaatcaaaaccacagtgagatttcaccctagttaagatggctattatttaaaaaatagggaatattggatgttggcaagggtgtggggaaaaagggaacacttgtacactgttgatggggacgtaagttagtacagccactatggaaagcagtgtggacgttcctcaaaaaactaaaaataggactaccatttgatccagcaatcctactactgggtatatatccaaaagaaagtaaatcaatatattgaaaagataactgcaatcccatgtttattgcagaactactcacaatagccaaagtatggaaccaacctaagtatccatcaatggatgattggacaaagaaaacgtgttatatatacacaatggaatattattcagccataaaaaagaatgaaatcctgtcatttgcagcaacatggtcattgtgttaagtgaaacaagtttggcacagaaagacaaataccacatgttatcactcatatgtgggagctaataaagtggatctcatgaagatggagagtagattggtggttcctagaggccaggaagtgtggaggggagggggatataaagagaggttgattaatgggtaccaaaatacagttaggtagaagaaataagacctgttcaatcgatcagtagggtgactatagttaataatatatctgttgcatatttgacaataactagaagataataattcagatgttcccagcataaaagataaatatgtaactaaaagagaataattcaaatgttcccagcataaagaaaaatgttcaaggtgatggatatcccaattaccctgattttaccattacatgaaagtatcagtataccagatataacccccaaatatatactattatgtattaataagaaagactacataaggtaggattctattcaaatgaaattctaaaaaagaataaaatcatatgaaaaaagaaacatgagtacatttataatctataacccaacacattttatatgtagaattacttgcaaaagtgctccagggactcatagaagaacgttacacccctccattggtccactcaaaaaagaaagaaattataaacattacaaatgttcagcaatgattaactttaaaaataaattatgatttatttatatagtagaccatgatatgagtacaagggactctggaatatgtggacccaatatctttcagccatagagaagagccctttggctgtgattttgtggttgttgttgactttttcttcagctgtattgaagtataatttacaatacagtacaattcatatattttaattgtataatttaatgactttgggtaattgtatacagtcatgtaaatgtcaccacaataaagatacagaacacatccatcacttgctaaaagcctctcatacccctttgcaacctgcccttcacctggcttagtagcctcaggtatatgctgatctgcttcccttccctgtaatattgccttttctaaaatttcatataaatttagtcatacagaatgtagtcttttgtatttgattcctttcacttagcataatgtgtttgaaattcatctataatgttttgtgtatcaatagttcattcccttttactgctgagtagtatcccacagtatagatgtaccacaatggatctattcaccagctgatggacatttgggttgttttcaaattttggctacaatgaataatgctgctatgtgcatttgcatacttgtctttgtgagaacatgtgtttccatttctctaggagaagggattgttgggttactggtaaggatatcttccactttattggaccagtacctgtcggtggcctgttgggaatggggctgcacagcaggtgtgcggcaggaaagggaatgaagcttcatctctctttacagccacctgccatcagtcgcattactgcctgagctctgccttctgtcagatcagcaaaggcattagattctcataggagcatgaaccctattgtgaactacacatgcgagggatccaggttgtgtgttccttatgagaatctaatgcctgatcatctgtcattgtttcacatcacccccagatgggatcatctagttgcaggagaacaagctcagtgctcccactgattctacattatggtgagatgtataattatttcattatatattacaatgtaataataatagaaataaagtacacaataaatttaatgagcttgaatcatcctaaaaccattcccttcccccactgtccatggaaaaattgtcttccatgaaactggtccctggtgccaaaaaggttgggaccactcctttataggaccttgtcactctgttttccggcctgactgtaccactttgcattgccttcagcaatgtgtaaatgtgtgagagttcctcacatttttattttttggggtttttttttgttttttgtttttttttgagacagtgtcttgctctgtcacccaggctggagtacagtggcatgatctaaactcactgcagactggcctcccagggttcaagcgatcctcccacctcagccccctgagtagctggaactatagatatgctccaggctaatttttgtattttgtgtaaagacagggttttgccatgttgcccaggccagtcttgaactcctgggctcaagtgattggcccatctcagcctcccaaagtgctgggattacaggtgtgagccacaatacctggtgattttcattttttttaaatttggccactctagtggacatttaatagtattttattattattttaatttgcacttccttgaatgacttgtgatgttcagcatctttttatgtgtttgttggctattcatttatcttcttttataaagtgattgttcaaatcatttgcccattacttactatgtatgtctttttattactgagttttaagggttctttatataatctggatagaaggcttttttaatagctgttttgccaatgttttctcccaatctgtggcttgtctttgttttctcaactcgttatctgaggaggaaaagctttaaatcttgatgaagtctgttttatctttttttcttatgtgatttgtgctttttgtgccctgtttaagaaataattacaggccgaggagggaggattgcttgagtccagaagtttgagaccagcctgggtaacataatgaaaccttgtctctacaaaaaaacaaaaacaaaaaaacaaaactaaaattagccaagtgtggtggcgcatgcctgtagtccaaactactcaggacgctgaggcaagaggatggcttaagcccaggtgattgagtctgcagtgagctgagatcacgccactgcactccagcctgggcaacagagtgagactctgttacaaaacaaggcaaggcagggcagggcagggcagggcagggcagggcagggcaaggcagggcaaggcagggcagggcagggcaaggcaaggcagaaggaaggaaattcttttatgctgtcttctaaaagtttaatagctttagctccttcatttaggtctacaatcaattcaaatatttgtatatgatatgaaataagagttgaggctatatacatatatatgatacatacatgtatatgatgtatatataaatgagtgtatatatataatggatatatatatatatccagttgttctaacaccattttttgaaaagactatcttttccccattaaattactttggcaccattgttgaaaatcaattgaccatataagtattggtgcattttaaagcttttattttgttccattgatctcatatggtctatctttatgccagtaacacactgttgtgattactgtatcttaatgataagtcttgaattcaggtagtttaagtccttccaaacttgttttcctttcttaagagtattcttgctattctaggtcctttgccttctcgaacaaattttagaatatacttgtcaattattttttaaattaagttttaaacataaatacttttaattgcctggcattttaatgtccaacttgagaccttgtaaagaaaattgtggtacaatacacataacataaaatttaccatcttgaccatttttaagtggcattaagtacattcacattgtgcaaccatcaccaccatccatccacagaaatctttttatcttgcaaaactaaaactttataaacattaaacaataactttccattctaccagcccctggcaaccagcattctactttctgtctctgagtttgattactctaagtgcctcataaaagtacaattatgcagtatttgtccttttgtgactagttcactcaacataatatcttcaaggtccatccatgttgtcggaattttctttcttttttaagtaaatattccattgtattccacatatgtatgtatatatgtgtttgagacagggtcttgctctgtcacccaggctggagtgcagtggcacaatcacagctcactgcagcctcaacctcctgtgctccggtgatctcccacctcagcctcctagtagctaggaccataggtgtgcaccaccatgctcagctaattgttgtactttttctagagatggggtttcaccatgttgcccaggctggtcttgaactcctgggctcgagtgatcctcccacctcagcctcccaaagtgctgggtttacaggcatgaaccactgcacccggccccattgtatttatatactataatttaattatccatcagtagacacttgggttgcttctgtcattttctttcttaaaaagtattttggagactatcataaataaaaatgttttaaaactccattttgaattgttcattgcaaatatatagaaattcacttgactttggcatattgaccttgtatcctttaaccttggtaaactcacatattgttctagtagctttttttaaaccattatatgaccttgtcatctgcaaatttagacagtttacttttccctttccaatatgtatgccttttattgctttttttaaaatctttttaaaaatattgaactgactgggaccttcgtacaaaattcagtgttagtagtgaaagtgggtattcatgccgtccttgtttctaatcttaggaggaaagaattcatttcttcacaattaagtatgatctaaatagtggattttatagcatgagaacagttataatagtagctttaaaatccttggtggataattccaacatctgggtcatcttggagtgaatctccgctatcttttcccttgagaatgggtcccacttttccagttcttcatatgtcgaataagtttggattgtacacattataaacgttaagttgtggaggccctacattctgataagagaacaccttttctctaataggttttgtttattttgttttagcaggcatttttttgtgattgaactctaacttcaaactctgtttctcaggtggcaggtccagtctcttttagactcttttgtctctggctgagatgcttttgtttttgctgtgtgtgtccgtggtttgggatcagccacagacaggagcagaaagaatttgggaattccctctttggctctttctcttccagaactctttcttctctcttttggcagttatagttgccctgaactcaaccttccattttcatagtccaaaaagatggctgtttttccaccagcaccacacctggtttgcacaatggctgcacctgcctccaagctaaaaacagcaaaaatgggcgctcacttcctgtaacatcttttctttattgcgtggacttcccaccagaatctgcctgctctgtccactttccattgttttcaggtagctgcattttgtattatgtccacctagaaaaaccacatccagtcattcctggaagcagaagtctggtatgatgtgttaaggacaaatattaagatgcctctctccctcttttttttttttttttttgcagtatttagatgcttttttgttgttgcaggttttcagctccggcatgggcttccctattctgctgtgaaattaatatgacatctagtggcttggtaaagaagatctggactgattttaatggacacatctggatttggggcttcttaggtgtggaggtggagacaggggccagtggttaccattacgtttcaatggttggtttttaagaaatatttgttggaaaacaaaaactgacacacataaagaccttgaattcaatctactccttaatagttaggaaagaaagaagaagggagggaaagaaaatggaaaagaaaataggaaagaagggtaagaaaagagaaaaggggctggatgttgtggctcatgcctgtaatcccagcactttggaaggctgaggtgagaggatcacttgagcccaggagtttgagacaagcctgggcaacacaggaagatgaccccatccctaaaaacagttttaaaaattagctggcatggtggtgtgcatctgtagtcccagctactcgggaggctcaggtgggaggatcacctgagcccgggagttcaaggctgtagtgagccgtgatcacgccactggactccagcctgggtgacaagaaatgagaggaagagaagacagaaggcaggaggagaaggagagctgggatgatgtgggcaaagggcgttcagggaagaggaagcaaagctaagggcctagaaatatgaaataacctgacagatccagaaacaggaattggtgggaaatatggcttataaagtggtctgggcctgcgcgagagctctcatggcgtggggtggaatccacattctgtacaatgggcacggggcagcccttcgagggcatcaccatcaagggagtgccctggatcctccgtgctcatgtccactccttgcctctcccctcctctgcagtgcaaggaaactcagccctgttgccggtcttctccaggtgctgaatcagctgcctttcgctgagtggccagtggaaggttctggtaggaaacagggtgggaagaagggagaagttagggtctcatcccgtctctctccatctcaggtggcatatccagcagtggctctttttccttcatagctccagctcctgccagagggaccctcacaggttctggctcctgccagtgatctggctgggggatctgggaacagcaccttaccccttcactccttcatcctaagaatggcagtgactttgtattcctgagaatcttgggatttctcttcccagcacctccaccaattccctgcatcagattccctttgttgtaactacttggagtggtgtctatcttcctagttagcccctgaataatatcggggggacactggccccccactgctctggtttccacacagagggctttttctctaaatcctcctggcgtcttgctctgctccttaatcctcccgatggaagtgtgctgagttagctaactagtgggtgacagcagtcggcccacactctcatttgcgtggatctctcctggtggaactggggagtgcattttagcatgctcatcattgccaagctctgtcctccagagtagtctgttctgtaatgcaggtgatattttaatctccatctgtctgactccctgagtctgaattggttcccaaggctgggacaaggagtcctgtttttttgtttgtttgtttttttgtttttttctttctcaaactccaatagcaaggaagtggaaaaaagattagacttttggcccggcgcggtggctcacgcctataatcccagcactttgggaggccaaggcaggcggatcacgaggtcaggagatcgagaccatcctagctaacacggtgaaaccctgtctctactaaaaatacaaaaaaattagccgggcgtggtggtgggcgcctgtggtcccagctacttgggaggctgaggcaggagaatggcgtgaacctgggaggtggagcttgcagtgagccgagattgcgccactgcactccaacctggtgacagagcaagactctgtctcaaaaaaaaaaaaaattagactttcagtaccactacattatagccaagagaaactgattcccctcagcctggcatattagggagaaccttacctgcaactcctctccccacatattctcctaaacttagactcttcaggaaccactgagactctgtcatagccctgacgtgcaatgtcaggagcagggaataatgaggccagcttcagagtgtgggagatagtggcacaggccccaccctcacaaatgtccacagcttagcttaatactctgttcgctgtcttgaaactctcactgtttttaagaagttgtcccacattttcattttttcgccagacccctccgactatgtggcttttcctggtactccctccctcttgggcgcccaagctccttggattgttaaggctggcggtgctgcccaaagcatcccccccaggacttctcgatatggacagcagagggcagcaaactgccatttgagggctcctcacccaggacgacccaggggtttgaacctggctttatccacgtggggtgagaggggtgggaggagggtggtattagttgtttgcgtgtttttaataattgaaaaccagaaacccgacactctgagcaccacttcaggtgatgtgctgtgtggcattttctgcccttgtggagtccaaccatccattctgaaacagagcagttcctttgaccttgacagtacagtaagttaacgttgtccttaggttctcggaactacaacttaaagggaaaccaattttactacaggctaatggctataaactagagttgagttcctacagtatatttcaggtcacaaaaacatcagcaaacttctaggtaaagactcaaaacacttctaatactaaacactgaaataaatgtgagctatacatgcatttgatgaataaaaacaagatcattatttacttagtaattccagttcagggtaatgagtgctcgaagcccctcctggcagctcagggcacaaggtgggacccagccctggataggatgccattccctcacagggcgcactcacccacacccacgctcgctccgactgggaccatgtagacacaccagttctcctaatgtgcacatcgctgggatgtgggaggaagtggtagtgcctggagaaaacctatgcagacatggagagagagtacagactccacacagagtgtggccccagaaggcatggattttttttttcttatccatgttctaatgaaatggtgtaggctgggcaacgcagtgagacccccatctccacaaaaaatttaaaaattagctgggcatggtggtgtgtacctgtgatcccagctactcaggaggccgaggtggaaggatctcttgagcccaggaggttgagccagcattgtgtcactgcactccagcctgggtgacagagcaagaccctgtctcagaaaaacaaaaacaaaaacatgacattatttgaggacctgctgtgcaagctagtggccagcatgtgcagtgccgcatgtcccacgctgctcctgataatatctagatcaactacaaagagtcttccagggggtcttccctgcatggggtcttccatatatcacctctaatccttacggtaccttaacaaagtctgtatttttatctgcatttccctgatgaggaaactggactcaaaaatgtacttgatgtaacttgtcctaggtcatacaactgtgaagtagaaaaagctggattcaaatccaggttttacctagtccacctagtgtctaaaaggtatgctccttctacaagtccaatgtgcctctgtgatgcataaaagggacaatgacattttgtcttgcctttactttgtagggtgaagttcttgtctgaaataacaatccctagggcggtgccccagccctctccaaggcacagtggacacctgtaaacagaaaagctctcatgcaccaaatgcctgtgatctgggattgcatctgtcatcaggcaaaacaatgagagaaaaatgtattaaaatctttttgttgttgttgttataataatccaacggcccatgctactctctcctaaagcctcaagttctcaggaaaagctcatcattgatttgagcctaatgaaaaccgtctttggtgagcatgcttccacattcccaaccagcttgtaacagttctatagaaatgtgttaaattcagaagctacttagaaggcttcctagcctcctaaggcatccccaaagcatgtcaatatcagaataagacagagctgacatttttcctattagaaatgttgtagtcctggaatcgcaaactcaaatgcacaccagggtcaggcaaaacttacaaatgcacgaagcagatctgctgtaacaggcagtatgtgcctcactgatgggcattcacaatgaaaacaaaagtgccgtgtgacttagcccatctgaggggtgaggttcattgagcccattatcttttgctttgccttagtggctagggaatgcatggctgaacgactatgggtagtgacagtatgggaaggagcgctgtgtagtggctaaggctgagggctctagaattacccagcaggttcaaattcaggttctattattgagtagctgtgcatctttgggcaatttactccagttctctgagactccatttctttatctgtgaaatggtttaccatgcagtgttgtgaaaagtgaatgggaaggtggatgccaagtgttgacaggactcacacatggaggctgtcatgctattctcctcctccaaagtcgatctggagtttggaaagcaggtattctgctccagcaaaagatgctgccttgtttcatgtttaaataccttctcctgtgtcatgctttacataagcccttcagctgttttcagaagataattacacattttaagttcaacaacaatgagtaaaatggccttcctttgttccctttgccttctctttagccctttgggctgaggagagtatcttgcctggagttgctggtaggaagagaagaccctcctttatcccaggatgaaactgcacatggactttcttgaatttcactgagataaacaccagagaagcaagtcctgttgcaaccccccaaagcaacctctgtgaacctgggaaggggcacctgccagattcccacagtgtcagagtccccaagaatgggacctcctgcagaagccccccaaggacaaagctgaacccttccctgctgagctgggcttcagccaagaggccttttagcaaaggattacagttccagctgggatcaactgactccctgagggatgagaggcaagtttgtctgggaaagggtctgagttggcaagatctgggatgctggaggggctcctggaagggaggaaaatttccctcctccaatgctccaaacacctggtttggacgaaactctgctcttcaacacaacctgtgtacctctttttctctacacctaacaaggaaagaaaatcaatgtggtcatacttctggccatcccaaactctgaatccaaactgggggtctcccacaagactctatttctgtggccaggacgcccaatcctgtctgaaacttcttagcatacaaagtacaatgcacctattttaaaacttggagccaggtttcaaaggtgttttgtgtattgttttacaattaaactatgaagatcatctatatttcgtggatgtagatacaggtgtttgtgaacaggggtggtaaggcagatttatcaaagtgattatcacattgaaatgttagaagctgcctccaatcctttttggaatgagactgggtatgaaaatcaataggtaaatgcaaatttaattaaaatatgtgtcgatcagtatcaactggctctaagacaagagctttgaaaggggatttatgcagaaaaagccaagttgtaggaacatagggagccaaggcattggtttctagatttggaggggagatatgtaaagtactggggttgggccttgaatgtattcactctcaaactatcatcatgagtccctgtcggtaggtggtctggggcaggctggagagcctgatgaggtcaagtccatggtgggaagagggactgaatttcccctgaagagagcctgctattcttagcacagaatgggagaacttgagcacttcacccttgactcttcccttcctgctctttctccttcagcctcttttccttctgcctccccacaccctctttgaagctccaaagtggagtaagtggcattccatatataccttttcttcctcagaactttgccaacaggatgaggagccaccttcaagtggaaacttgaagtccttttcttctatctcttcctttaatcatggcccctccctcccacctctaattgaatcatcctttctctctttaataaatattttcagaattcctatgccatgagtactcttttaagcttggacctgtccacagaagagccaaacctgagagtccttggtgattggcaggcacaggtgaagtcccttttcttccctaatgaggagtcttgacctccttaacattttccttcccttattactgacgtcactttaggactcaccagtcacatctcttccataccaccctggggcctgcatattttcttaaaccacagaagggaattgacatttactgacacttaattatattgaacacttactatgtgcagcctccctggagggcattgctgtccctacttctcatggtacagcatgccgggaaacatatattaaaagaaaaagcagtaattaaaacagaaatgggagaaggggcccaggctcccagcttttggctcagttgctcttgtggcatgagagaaagtgtaggcttggggctgagttcgctgggagtctgtggcttgtcatggctgcgttgtcagcctttgcttgtggagttcctccagaaagccctccacctgaagcccaggctgcagcacctctacactccaccctctatgattcgatccaacatggaatgatgatcccgagtaatttataagctgactccactgacatgggctccagcaagtcctggcgggtgtttggtggtgcagggggagcggcccttgctggttggcacagaaacggaacacctgcaggccccagaactgtccccagcccgctctctcctgcaatcttgcactggatctcacgttccagctcagatgtgagggagatcagacataaaattccaggggctgaaaattcctcgcataaggacatcccccccatcctcccttctaatttccagtgaagcagaaattttaactcctcagggcaacttttcaaagctgagtaacttcagattacacactcaagtcctgttatttgttaacagcatttgaatgagtaacttgctcccattgctttgaaaatatttcttttaaatggagaagcaggagcaattagagatgaaaagtacctgtacagtgccttccaagatgccagaggctgttccgaactggcattccaaagtgggtaaaaataactttctttaggaaaacatagaaggagggtgacttacagggggaaggagcaaagggcatgtccgagctgtaggaaagaccactctgtgcttgtgtgtcaaggacctgtcctctgatggccagtttcagatgcagacaagtgtttcttgctacatttggattttccaggctgctagagaaacaggcctaggcttttgggatagaacagggatgtcgactaaatatatatatatttttatatatatatttatatatatataaataaatatataaatatatatatacatgtgtatatatatacacacatatatacgtatatatatatacgtatacatatacatatatatatatatatgtatatatactaatattctgaaaacatggggccttttcccaccctgctgtcttttatggaagggtcatcttcccacagcacacccagcaatccccacccacttccctagtgctaagctaagctatagaaactctggaaaaaatagatgtttctacttctcaaaagaagatatatatgtggccaagaagagtatgaaaaactgctcaatatcactaatcattagagagatgcaaatcaaaaccacaatgagatactatctcataccagtcagaatggctattattaaaaagtcaaaaactaacagatgctggtgaggctgcagagaaaaggaaatccctataccctgctggtgggaatgtaattagttcattagaaaaattagttcagccactgtggaaagcagtctggagatttctcaaagaatgtacaacagaacaaccatttgacccagcaattccattactgggtatatacccaaaggaatataaatcatgctaccccaaaaacacatgcacacatatgttcatcacagcactatccacaacagtaaagacatggaatcaatctaaatgcctatcagtggtggacttgataaagaaaatgtggtacatattaaccatggaatattatgcatccataaaaaaggatgagatcatgtcttttgcagcaacatggatggagctggaggtcattatcctaaacacattacagtgaacagaaaaccaaatatcacatattctcccttattagtgggagttaaacattgagtacccatggacacaaaaaaacgaaaaacagacaccggggcctacttgagagtggaggatggaaggagggtgaaggtggaaaaactacctatcaagtattatggtgattactgggtgatgaaataatctgtacattaaatccccatgatgccaatttacccatgtaacaaacctccacatgtacccttgagcctaaaataaaagttggaaaaacccccaaaacaagtaggtagttttgatgatgcctccaggatggacacttccgagcaccctgtagtctcttgcaccccagatggggactgcaaagctgtcaataagagggaagatgctccctgcagtcaaaaaatgaggccagagacctggaagattattgaacactgggaactccaccaggctctgagctcagctcaaagagggtgtattatatagatcagtggttctccaaatgggttgcacaagaaaatcacctggggagctttaaaaatcctgatgtcgggccacacaatatctactccaaccccaccccagccaaggtctatactcaagaaaccagaatctctggaggtagaaccctaggagcagtcatcgtcacagttctcaggtgattctaatgtgcagccaagtttgagaactagttgcgaatagttgagaactagatgcaaaatggttgagatgattcagagactctgggacccactcagggaacagatgaatgtataaatgaatgattatttcttgcttggattacagcaaaagacttttggctggtcttattgcttactccccaccccctttgttttgtctcagtccggcaaccagaatgaatttttttctttttgagacagagtctcactctgtcaccgaggctataatgcagtgtgatcatggctcaccacagcctcgacctcctggggctcaaatgatcctcccacctcagcctcccaagtagctggggctacaggcgtgagccatcatgcctggctaatttttgtatttctttttttttttttttgtagagatggggttttgccatattatagaattatcttttcaagaatataagttggagtgtgtccctgttcacctcaataccctctatggctttcccactaattcagaataagagctggcatcttcataatgacctacaaggccctgtatgatttacctttgaagactgccccatgcccacctgccctccctctgatattatcttttactaccaccccccttcccaccctttgtgcccacggttccagcaatactggcatccttgcagttccctgcaggtattaggtgcactgctgccccagggcttttgcacttgctataattctgctctttccctatatagtcacctggcttgtcccttacttttttcgggtctttgttcaaatattaacctgctcgccttacattcatgctcctccatgcctactctgcttatcaggaggtttatttttgtgtatttatcctctttctccctatctaagtggatactggagtctgtacagcatttttagaccacttacagcttgtgaaaagttgggaatccaaattcctgatttctctctttaatttctgcctgcaagccggccaacactttctaaactcatctcttaactttaattccttgtcaaatgcagccaatggcaacatattatctaaactcttcccctagactaggggtcagcaaatagccaacagaccaaatccagagtgctacctgtttttgtaaataaagttttgtttgaacacaaccatgttcatttgtttacatattgtctatggctgttttcatgctacaatggtagttgagtagttgcaaaggagtctgtccaataaagctgaaaatattcattatctggctttttatggaaaagttggctggcctctgtgttaaatgtataaactcagttggctcatggtctgctttccaagttatcgccagccgtacttcattaaattttttgccactgcatatcatggatttccatctatccagcctaactggtaagctaatgccacatctcttagatttttttaaactattgcaatatttcactcctgctgttagtcaggataattgacagcagctgctacaatcaaaatctcaggggttttgatctccaggtaaccggatgacagtttgtttactgctcatgcaaagtcagaagtcaggtgggcaaccatcctccatcttgtagctgtagtgtcttggaagatgtgacctccaaggtcactgtagcaagttaagagggcgatggaggaagaatataattctcaactgcctttctttttattggccagaactagttataaggcccagatctaaatagaagagggactgggaaatttagaagagaacttgaatgtttgattagttctagtcagtctctgaaacattgatcattaacctccaaacaagatgggatcttaactcattcctgtaagagcctcttggaggatctacataggatggccttccacagctcttccagagggcctggaggtctttcttcatatacagctaaagcagggagtttcttttcacttgagagctgctagtgcagaagaaaaaataattgaatgaaagaataagggtgtgagtgaagaaagcaggttggtgaagaaaagacctgtgggaaggaaagggatacttgaagtcaagaaaggtagccattgggaggcctaggcgggcagatcatctgaggtcaggagttcgagaccagcctggccaacatggtgaaaccctgtctctactgtaaatacgaaaattcaccaggtgtggtggcaggcgcctgtaatcccagctactcgggaggctgaggcaggagaatcacttgaactggggaggcggaggttgcagtgaactaagatcacgccatcacactccagcctgggggtcaagagcgagacttcgtctaaaaaaaaaaaaaaaagaagaagaagggtagaggagggtagccaaatgagaccaaaggtctgcagaagcctgtgaactaccctgcttttcagagcacaggcaccatttaaatccaagctatcattatgactacaaagctatttacttattttaatactgtattatttaatacagtgaatcaagcattttatgacttgaagtaacttcagaaataaaggttggctttccctgtcattgaagacaggttgagagttcatttctgcttaacagatcaaggtagtaaattacattttctatcagaaagaaatgtttagagagctctaggaggagcgctgggtctttggcctgagcaacaggaatttgggctcagtgcccagatctctctctctctctctctctttctttcctttttttcttttttcttttttaccctgttcatgacccttagaagtcacagaaaccttcctggaacctcagtttctctctttgaaacaatcaccacttgcctcccttggcaagttgtatgatgaataatgacacagtgttagcaaagtttctttgaggtctttggatgaaagacaacctataaactttgctgaagatttactgttttattaaaggaatagctgcatatagtactccactaataaatgttgacaaaggtaaacattcttcactcatcctagcaagagcaggttattcatctattgcaagtacaatgagggagggtgtgttccaaggtcataaaaatttctattaatattgtccagaaacatattttggatctatatctacattgtcacctggagttaaactaatggagtcagtcatctagacttacataatattggataatgaacaaaacaagcatgtggcttagctttgtcccttgacttgggtatgtaaagagtaacatggattgctactcaaaaaattaaaaccagaattctggtaaaacaagaaaaagcttcaagatgaatatggagccttgtactaggattgactttgcagagtatcttgacaaattagacaggaagacatatgttggccacataggaaggttctagagagatttcagatctgccattaattactaatatccaggtttctcatcaacttagtgaatttacagaggcttgaaagcacccacatctgtggtacctgggaattgtaggtaaattctctggttatgtggaaaaagctaaggaatatgagtctaggaaactggtagctctgtcattaactgtgcaatcttgaacaaactattttctgggcctcagataccttatctgtaaaatgaaagcattgaactaacaataaaactaactatttactgagcatatactaagtactaagctctttgttatatactatatgtactttatcttatttaattctctgaggtaggtgatattactttcatttaacagatgaaactgcggctcagagagtttgcaaagtattttatgcatagtcatttatttgataaatatttgctaagcatcttctatatatcttatgtcaagaggtaagggtagacatttagctctcatcctcaatgaactcacaataggagtcatcactagaagatggaagcctgagtatgtgagcttagcaggtctaagctcttagccttttcattgtactggatcagaatacaaacacgctgatgtttcttccatctaaatgaacaagtggcttctctcaatcccactttgcccatcagcttccaccccatttagatgcttctcattgtagcactcctataatgagttgtctgtactgcttgtctccaatgcctgtcctcctattttctcttaaactcaccccactcaggcttttgccccaaccaggcacccaagtcttatcatggacatcaatgatcttcacatgctaaatctaatgggcagctcccactcctcatcttacttgagtatcagtggcatttgacacagttgatcccccttctccttgctatattttctcttcacttggcttctaggacttcccctttctcttagtttctttcctatctccttggctgctctttatcagttttatttgctggtgtttcctcttctcacagattctgagtgttgtaatattccaggactcagaccttggcgctcttctttgtctacacttactcccctggtgataacaccccgtttagaactctttaataccatctttatgcagatgactcccaaacttgtatctttggcccaaacctctctctcagatttcaaatgtaagaaaccactgccacttgccatctccacttgaacataatagacacccagcatcagcatgttcaaatgtgaacccgccatcttttctctgaaacctgttctgcttgcagccttctccatctcagatgattgcaactttaccttctagttcctcaaacccaaatccttgcgtcattcttcactgctctcttgcttacatactccatagccaatccattaggaaacccgtttggctttatcttcaaaatgtatttaaagactgatcaattctcaccactcccactgctatcaccctggtccaagccatcattaactcttagctgggcatctaccctgtgctgggctttgtgccagatgccaggaatgtagataaacaggacacagtccctgcccacagagagtacacagtctagtgagaagacagatataaaacttgataatcatgatgcattatgataagtgctgtggtagagtcgtggaagtttagaagagggtatgtcatctttatatccctttcagctcagatgttaaagctgctcgccttagtcctatatctttaaactaagctgacccacaatgtactagacaccttaaagctaattaaaacaagttgtgggttccattcacaaatactggacccgttcatttacaatacttcagtacctgtctttctacttttatttttgccttcccttccttatatcatgctcatccatgaacttagaggtacaactcagaattctccagcattgacgttcagtgtgtgtttcccaggatgtggcctgcattcacccttcttctcctggcaacttttaataaattgcccactggacccgctccagccccagggactcagacccagtggcctgactggtgctcagtctgtggaagatgacaatagcaatataccttgatgacatctcaaattcccatggaatcaaccagattggtgcttaattaagaacaattggccttggcaccctcagtatgagaaatatctaggtatccatctgttccatttgattttcactgcttccccttaatccaagctctctcctttccttcattctctcccctgacaattaatttgtacatggttttccatacacatctttttaaagtactgcctcagctacatcattctttaggcaaaagtcttctggggttctttattgcctaccaaataaaatccaaattcattaccaatcaaagccctccatacttggactcaaactttccccatcttatctcccagcatacttgtatatagccatgacctacctactcatggagcccataacctgcacacgctttcccaccttctgcttgtgctctctccactgccaggcatggtcttctccccttcattcactgagacaatatcttcaaggcccaagctaactttctcctccatctttcccactgtggcccacaaatctctgcctactctgaagttatagccctttggcctatattcactagcaatgaatcatgtccgtccctcttcataacatctattgcaatgcagtccttattgttttatttgtctactcttacactgctattgatccttttgtcagctatgtcttctcccttggactatgtcatgaacctgtgcaatgggaaagcacagactttcgagtgagatatgggttttatgccagctgtcttattgattagatatgtgactttgagcaagccactcatcatgcagcctcagcttcctcatctataaaatggggataataactgtctcataagactgtcgtgaaaattagataagacagcatgtgtgaaattgcttaagggtgcatggtacatagtgttttttccctttttgtgtcccgcatggagctttatacatagcatggcttgaaaatctattgatttaattttgaaacaatatgtctataattaccttgaattatgaacaattagagaacacccatttctgccatacacattagtgccataaaacacctggaaataatgggtacattgcatccttttaaatgcataactagatttgcaaaaggaaaagaaaaaaggaaggaaatgctccatgtccacaaatggagtgtgagctgacataaggagttgcaaggagtatctgatacttcggctgtccttgagggcaaggttgtccgtttggggtttcattgctcattcaggaacaagacatcaaactgagaagcctgcataagccaataccttttaaaggcacatttggggaaattctgcttagctgtaaagagctctgggtaggaaaaaatgttttccttctgagaaatcatagcaagcatccaatcgtaactaaaggattatacccacagcaggtataataccatagggtttgagtttaaaaaaattttttgggggacagggtctcactccattgcccaggctggagtgcagtggcatgataaatgctcactgcaacctcctcctcctgggctcaagcaatcctcctacctcaggctcccgaatagctgggactacaagcatgtgccaccatgcctggctaatttttgcattttttctagagacagggttttgccatgttgcccaggctggtgttgagctcctggactcaagagatctgcgcaccttggcctcccaaggtgttgggattacaggagtgagccaccacacccagcgaggttctaatttatactacttgagtgtgggggaggtcatccccaataattcaacataagaaacaacttgagctgataacaaggttggcagaagcaaatgcaaaaacctttttgaagagatactcttaacccaagctgcacagaaattccataaacctcaccgaacatcaatccacatatgaaacacagaaacaatctcacaggaaacagcagacataaaaaaataagcaaagcagcaaccacaaaagcagcagaattacacccccaagttagcaatatttactgcagtggctggacccgggtccgtcttcaaggagcattcaatcagactgggaaacaattcattaacagtctaaggcaataaagacaaaacccaatttaagaatggcctgggatccacaaggtaattagaatatgctgttcagcaatcagcatgtcattttccttagaaaacaatgttttacccagtagatcacaaaagcttttggaattcacaagtcagaacctgttgaggacactgaggcacagtttccggcacaaatttgtgctccataatcactggctaaatgaattcataaatgaatgaatgaggtagctaaatctgacccaggttccagtactgcagaacacgaggccaaggagtgaagaggaaggaggagaaacaaatattattgtatttccaaggcacaagcccagctgtctggaaagcttgtaaatagatacagtttgcatcagacactcttccacctgcccactgtagatactggagattatctcactgatcctaaacccaggagtcactgaggctgtctacacctaaatgccccctgctaggaatgcccatcttctcagtgctgggatcttagctccatgtttttggaaagcagatagagtgaggatcagggtaagatgcaagatttgaacagccatttacccctcagagatgtctgcaactctaacagttgcttgtttccccaaatgaatctctaattcatgtgacaaagtgaaataagtgtattccagctatgtggtcatgatggactaggactgaaaacctttgcccaggctcaccttcctgaggtccatccttggggtcttcattcattcactcattccttcagcaaagtttatggactgcctacttttgtttcaggctctgtctacctacttctgtttcaggccctggagaggcaggagtgaacaagacactatagccatgctcccatggagttttcattctaggcaagtggacaaataataataaaagaaaacacatggacaggatatatacagagtgacacatgctacttaaaagaacaacaaaacagggagaagtgagaggcagcagccttcccttcctctcactaaaaaaaaaaatcaaagcatggattcctttttattgctcctcccgtgttttttgtttgtttgcttgtttgttttttttagatggagtttcgctcttgttgcccaggctggagtgcaatggtgcgatcttggctcgttgcaacctctgcctcctgggttcaagcgattctgctgcctcagcctccggagtagctgggattacaggtgcgtaccacaacgcccggctaattttttgtatttttagtagagatggggtttcaccatgttggccaggctggtctcgaactcctgacctcaggtgatccacccacctcagcctcgcaaagtgctgggattacaggcttgagccaccgtgcccagctgctcctcccatgtttttgtcttccctaccacctctgatgaacccacagtttttttttttttttggttggttgtttgtttgaagcttctgttttttttgagcttcctctcttggtagctgagtctctccactcaggggggaaaggagtgagtatatggagatgtcgaaatatttgtagaaatgtcttaacctgcaatgataactgccatcacactatctgattccttagtggttcactcacacacactccagcaaagttgtttctctatgtgagttttaaggctctgcttatcagtggactcatctttgcctccctattaatttcagcatagaaaaagaagttttcccacaggtaacctttggaaacaaaggcagagcttgagcagtgatcgaggcaatgattaagcagtcagaaataaaacgtgagcttgcattcacctctgccggtggcggcctgagcttcttcctgtagactgttgacaaagaaacttgagaaggcaaaaaagccttttcaatagcaagaggacactgtgaagtgcagggaggaccatattatgttgatgatggatgagtggatccctctccactgaatgtgccaggctggagcccatccattagagagagcttaatctgcccagagatctcagcagctccggctgctgaaagataagcctcctcttcctgcctcctcagagggctgttctcctgaagaagctacctggcgtctgtgtagtgttcagaaactgcaggagtgattgcttctcctcctctctggctggcagcccttggggtgcgaagcatgaatccaacctggagctatcttgctgcaagcttccctgttgtcctggtcacaagagtcctcagttgttctcaaaatcgtggaagaaaaagtcttttatacttgaaaactcatagtgaggagagcttaaactttctccctgtgcagaaaagaaaaaaatgcatcctatttttaaatgggtttcctcatagaatcttctgatgtgttaattccaggtcttggtctacagcttgaaaataaaaataccaacaaatcagtgtcccttgtgaaggacttctctccatctatgccatacctctgtctgtccctgtctctgtctctgttctctctctcacatgtctcctccccacccaccctgtgttttgttttgcttgttttgttttgagacagggtctctgtcacccaggtgttgtgcattggctctgtcacagctcactgcagcctcaacttcctgggctgaagtgatcctcctgcctcagcctcccaagtagctgggactacaggtgtgtgccaccacactcagctaatttcttctatttattattattattttttttgtaaagacggggtctcactatgttgcctaagctggtttcaaactcctgggctcaagcaatcctcccatctcggcctcccaaagcgctggaactacaggcctgagccactgtgcctggcctcctctctgtgttgaactcactgtatttctgcccattcaattccatgtattgtccccctcctctctgctccccccatccctgcccacactttcaacatctcccactagtgccatcagcctcctaacaagcattcatctctgtgcttttatatgtgttttttttaaagtctatcctcctcactgtcttggcttattattatgttggtcagcagctccttattacctacagtacagggtccaaacatcttaacatgacataagcaacacctatctactcgtttctttctgcttcctgcacatactcttctcacagctgaagcattctatttaaaggatctcaaatgctgaagtgcagtctccagttgttgcacatgctatgtcctttgctcttctttctaggtgagcttccattcaaccttcaaggcccagattagaaactttggaactttgagaaacacattaggcttctgattgtgttgctattgtaatattgtattgcttatctatttcaacataatgaattgcatacaaatttagtggcttaaaacaacaaacatttattagctcacagtttctgtagtcaggaatctgggagtggtttagctggtggttctggcttacagtatcccatgaggttgtaagtggaataacagcaggaactgcagtcatccaaaggcttgactggtactagaggatccacttccaagctcactaatgtggcttagcaagagacctcagttccttgcttggctgttgactggaagcctcagttccctaccaattgggacttttctcatgacagggcagtcatcttccccagagagagtgacccaagagagagaggcaggaaccaccatgtctttcaggacctagatttggaagtgccatgtcgtcacttttaccatattcgattggtccaacaaacaatggggtaggagaccacacagtgtgaataccaggaggccaggatcatcactcaaaattcataagacccaggcttaaattttggttccaccacttatttgctggctgaccataggtaagttatttaacctctctgagccctgatttccacatctgtaaaatctgaatgataggattgacctgacagggttgacgttgaacctaaaaaggtgatttaccttaagcacttggcatgtagtgagcatttaataaatgttagcaattattatgttgataacagttcacagactccctgggccagtagccccaggggtactcctatacagtcctgtaatgctcttatcttacattactctccacctgggtacttactcttagattcagaagtgtttagaccttcaaatatagggcctctatgtccatgtctttcatgaactgtttttctttgcacaatctcaggcttctctaacaatattaagcttcaatcccattccttcagatcccaaagatgtgaatgagattgtatttgcatccttaaattaaaactccaagtttagcttgtttgttaactccatcccacatgtggtcatctgcttcagaccttggggcctcatccccattggaattgtttttgtgtcattttcgttcatcagctgtgagtggttgctccttgttagggcctaggctcggtgccagggttgccaagataaagaagacaggaacatagccctttagaaccttagtgttgtttcatatcatcatttttctattttctctggatgtctttcttctcaatcttgcttgaaatgcagttttattactaacaaccaccaattcttgagcactagcttcatgtcagagtatgttcatgtcatccctctgccattcctgcaaagtgggtattaccgttctccccatcccttctccatcttggaaacagaaggctcctcatttattacagaggtttctgactctggatcttgagccctttccaaaatgacaagttgccaatgtaaatattttttaaatttagttttatccctagaatgtgatcaccctactgcagattggcacatcactcgcagtaatgtccctggtccctgggagacatgcacgccagtctgccggtgtttgtccaaagggtgacagggccccttcagatctttggtttccacagtaactatgcagccagccattcactcccggctccagtccactttccaacagagaagaaatgagcatattaattgaaaccctaaccccttcagttttctacttaggacttcaaagttaccagaaagtccgcccagatctcatttgcccgaataattctttcgcagggtggtccccacccccacccatgtccactccctgccttcctttgctctactctgtgctctgggagcctggcccctctgaagcatcaccacagcttttttgccctctggttccctttgggttcagacaaagggaggcactggctagagatcaaagggcagcaggagaaggagactgaagtatttcttctttcctgattcctctctacttccgcaccatgtttcaggcgatagttgtgtccctggtggccatagctcctgccagggtgggtaggagggaggtacctcctctgagtctctagctcttacttggcccagaaacaatctttcttccccttgtcctttcatgcctaggggtgctaatgccttccagatgatgcaaattatgccctatactaggctattgtctcagttccatgaaattgcaaaatacattattgactgtcatggttttctccacactacttctgatcaaggaatatgtttcatagcaaaataagtgaggcaatgggtcttacctacacccatgggatctgctatcttaatcttgtaagaagcagtgggccagacagaatggtggaatggaacagcctgctgaagacctattcgtggcaccagctgagagacaacactgtgaaaatttagggtgctgttttacaggatgcagtatatactttgaatcagcatacgatatatgttactgttgtacccatagacaaaatacagaggtcaaagtatcaaggggtaaaagcagaaatggctcctctcacttattgacgtaataacatacttatagaactttgttctgatgtcttggtggtctgagtacccaaaggaagaatgcttccaccaggggacacaacccattcaattgaaacattatgggctcctcaggccactaaattaaaaggcaaagaaggaagttattctacctgctggggtggttagttttgattaccaaggagaaattggattgctgccatacaaggagggcatggaggactgtctggaacccaggggatgcttagggatgcctattagtacctccaggtccaatagtaatacttaatggaaaaataggcagaacctgaaagaccccaaccctttagaagtgaaagcaatgatcattctgccaggtaaagaacccacatcagctgatgtcctggcagaggacaaaggaaggaaatgtggaaagagtagtggaggaaagaagttataaatatcaactttgctggtgatcagttaaagaaacaaggactgttaaaaactatgcatggttttttccttacgtgttatttacacatgtattattacacacatactcatgtcttctctctatttcttcctccttatgatttataatttatttacgtattggtggtggttaacttaactttaacatatagtctttagtagagtgaaacaccaaaagccaaatgaagaaagtacggaggaagatgggaatgatcaactgtgttaaaagtgctttcttcatttccacaactgctaaggggctcaagaatccccttacctgggaagctcctttgacatcctttgaccagcaattttactagccagcaaaagctaccattgactgaggactttcttaagtacttcacaggcatactatcattcagcagaacactctttaatttatctgtgggataggaattgtgactccaatttgcacattcaagagctgaggtttacaatattgaagacgcacactcaagtttactatctgtggagctatttgatctaaaccaggtctgtatgagccaatgtcctgtttttcattgcctcatacttgatttgtttcttatttttcactaaggtaaatactactgatacaaacatcttatacaaaattaaaatttagcctctagatcacagaacgttcagatgggactgtaactaaatgatcaggcgagactgatattcatgtcacccagagacagatactgtgactgtcatctggaaatgaacacaattacttttgggattttgtgtctttttgtctttttttctctgggagaggtaagagtacatttgtacaaaggctagttgcatgttattaggcagagacgtaaaaccatattgttgtatggaagttcaagtgtgtatagaagggtgtatatgagtaatgaggggccaaaggggtggactggaccagatggtcagttatgatttctcagctgcaagcccatccttctatgctctgtgttttgatgctggggctgggactctataatcacatcactcctttaccagctggttctgtgaataggcgcactaaaggaaaggtagatgggaggaagaggaagagacttacttcttccaattttggcatgctgctcctgtcagcatcctctaagcaatagtttgtctccctggtagtggtaattggttccaaggcagtttacgatatggaagcaggctgccatcatagcaagcaagtgagagagaaacagagggtgaggaagatggaagccagattcatttgcaatctaatctcagaattgacaccccatcacttttgttatattctactccatgcacaagaggattatatgatggcatgactgccaggaggcagagattattgggagctgtcgtagaggtcttctaccatgtgatgttaagtcggtgtccctgacgaatcaatgcattctgttagattctgttcatatgttagttggtttctgtttctgtttctttactggattcgtatacggtagtctgttggtgtttgctccctttaccctgctttgtaaatacagtcaagtcaccatataacgatgtttcagtcaacgacagaccacatattcaacagtggtcccataagattataataccattttttctatgatgtttttgtatgtttagatacacaaatacttaccattgtgttacatctaccctacctgcagtattcaatacagtaacatgcagtacagctttgcagcctagcagcaataggctataccatatggtctaggtgtgtagtaggctataccatctaggtttgtgtaagtacactatatgatgtttgcacaacaatgatgaagttgcctaatgaagcatttctcagaacatatccctgtcattaaggcacacgtgactgtaattcctccattaagaactttaaaatttgaaatgactgggatgaattattttagctcctgggctgcagactgatgactgagtggataaactcagtgggctggtactgatctgggggttgcatggatcctctgtacttggaagcagaagaccaaggctagcttagctttgccactcactcgttctatgcccttggatgattcacttaaccatcttaaaccctagggtcctcatctggaaactggggagaataaagcctcactttcagggttatggtgaagattaagtgaaaattcaagtgcctggaagagtgtcgagcacacagttagctctcaagaaatggttgctattattggtagaaaatgtatcctaatgttcaatcaacctgattaaaaatgtctactttgtctgggcacggtggctcacgcctgtaatcccagcactttgagaggccaaggcaggtggatcgcctgaggtcaggagttcgagaccagcctggccaacatggtgaaaccccgtctctactaaaaatacaaaaattagctgggcatggcggcaggtgcctgtaatctcagctactcaagacgctgaggcaggagaattgcttgaactcgggaggtggaggttgcagtgagccgagatcacgccattgcactccagactgggtgacaggagcgagacttcgtctcaaaaaaaaagtctatttcacagggttgtggggattaaattagatgatgggtgcaaagtgcctagtactgtggttaatggttgacaagtgcccaataagtattagtattaaattgctttttaaaaatttcaaataaaatttgtttgtaggctagaaagtacaagtacactatattaaaaaatatttctgttaaaaaggaattaacttggtatcaaaattaggcaagaacccattttatttataactacatttaaaattctaaaactggtcgggcacagtggttcacacttgtaatcccagcactttgggagactgaggtgggtagatcactagagatcaggagttcaagaccagcctggccaacatagtgaaaccccgtctctactaaaaatacaaaaaattagccgggcgtggtggtgtgcgcctgtaatctcagctcttgtgatgctgaggcaggagaatcgcttgcacccaggagatggaggttgcagtgagccaagatcgcactactgcactccagcctgggtgacaaagtgagactctgtcaataaataaataaaattctaaaacaaagagaatccaataatcaattatctctctccccctctctctccatatgtatcataactaacagatttattccaataattctcatcaaaatttttcttttgagatggtgtcactctgttacccaggctagagtgcagtggtatgaacatagttcactacagcctcaacctcctggcctcaagagatcctcttggctcagcctcccatgtagctgggaccacaggtgtgcaccatcacacctggctaattttaaaaaagtttttatagagatgaggtttcactgtattgcccaggctggtctcgaactccttacctcaagcaatcctccctcagcctcccaaagtgctgggattacaggcatgaggcactgcatctggcctaaaataaacaaacaaacaaacaaacagtgattgatttagtaaacattatctttttctctggaaaactgagttacatggatttcacaaggttactgactttcaatgtatggctaaaattggtggtagattaatttatggacatgctagtaacaaaatagaatttaataatctgtttcatcctctaagtatttctgacattttgttgttgttgctcattagtccctggctacaaataaccacaaactccctagttaagatgatgtcaggactctcagactagggaaaaaagccacattctggttgtaaatgaaaatttaacggagaataagatatttgaaagagaaaatcattgttttgagaaaggaacaaagaagccagacaaggtataaactttaccaaatgttcaaaaaattcatttaatatcgggctttataattcatgaagtttcttttcttttggctgccaacttatctaattacaattctagattgacagcaaaaatatttaatattctctgaggaaatacccaactcaggtgagacaaggacagagcaatgaaatggaagaaaactgtgagaaaccagggagactgtattagtccgttttcacactgctataaaggactacctgagggccaggcatgttggctcacgcctgtaatctcagtactttgggaggccgaggcgggtggaccagctgagatcaggagttggagacgagcctggccaacctggtgaaatcccatctctactaaaaatacaaaaattagctgggcatagtgtcgggcgcctgtaatcccagctactcgggaggctgaggcaggagaatcacttgaactcgggaggcggcggttgcactgagccgggatcacgccattgcactccagcctgggaaacagatgagactccgtctccaaaaaaaaaaaaaaaaaaaaagaactacccgagacggagtagtttataaagaaaggaggtttaattaactcaccgttccgcatggctggggaggcctcaggaaactgcagagggtgagagggaagcaagcagtttcttcacaatgcagcaggagagagagagagagtgaggtaggaagtgccacacttttaagccgtcagatctcgtgagaactcactcatcatcacgagaacagcatggggcaaaccgcaccacgattgagtcacctcccaccaggtccctccctaacatgtggggattataattcaagataacatttgggtagggacgcagagccaaaccatatcagagacaatccacgagggccatgaggtcggctcagccctgatgtactctggaaatcctggaatcaatgtgcccatagagggatgtgtgacagggaggagggatcctagagggtcatgatatgacctggaggcaatgagatcaaattcctggtcctgctaagcccccaaatcgtaagagtttacatgctttcaggtatttctggactgtgctttttaacgtctcaaaacctttttacatacatcacctcatttgagcctgatacagactagtgagctaggtgagggctggttcttctctatctaggtgaggaaagtgacaatcgggaagagaaaggacaaaaaccactgcatgttaatggaaataaatgacaaggagaaacaaaacaaaggcaaggactccatggtgatgaaagaaaggcacattgcccaggaagggaagtggaggccatggccccacttctgctcctgaccccaaccaggagaccaccaagttgaacccaagggtgtggctgaagatgtgcctggtcttctaagatgtttgctgtccaactgctggtgttgaacctccactcctcctagttccttaatcatgtagataagtctatttacatcctccactaataccaacttttacagtggaacggggtaaagccctaaaaagtatttgttactgtaatgtaccatatagtggtaattattattataagaaagtaacttgtaaactgccaagtgctatacaaatgtccattatcattattatgatgatgattagataatgatcatgttggtttttctccaacccaaggagtgctcattcagtcccatcttttcttcttcaatttcagtagcttccctatccaaagccaaacaaattttagtgttcttaataccctcagtatggtagcttgttaatgtctcttaaaagctcaaataatttatgcttactttttaaactttcttcttataacacagcttcccctcccttccctccctgtcccccaaagccagaaactctagtgggctagagaaatctccaactggcagagcttttagaaatagagttaggcgacggggtgtggtggctcacgcctgtaatcccagcactgtggggggccaaaccgggggggggcgggtgtggatcacttgaggtcaggagttcaagactagcctggccaacatcgtgaaaccctgtctctactaaaaatataaaaattagccgggtgtggtggtgtgtacctgtagttccagctactcaggaggctgaggcaggagaatcgcttgaacccgggaagcggcggttgcagtgagccgagattgcaccgctgcactccagcctaggcgacagaatgagacttcgtctcaaaaaaaaaaaaaaaaatagaaacagagttagcctcacagagtcacagaagtggaaggacatggaagtgaacagatgacagtactcagacccacagtgatcacagtggtcacttccccaggatcacagtggggcagctgcagtcatgagtgaaagtcagcacttccagcacccggcctagcgctctttgcactgagcagggctctctgatgtgattttcctttgcctccaatgtcaaaatcccaggcttctgagattttattcttgttcatagtttccccagtatggttccacatagggggttgatcataatcctgaaagacccatcccaaatattgaaatcctgaaagatcaaaatcccaaaaatataattctggaaaaaataagaagaaattatctttaaaacatttatttacatttttaagggagatttatttgagaaccatataaaaactgacagagcacttcagaggccaatttacacaataaaattggcaataataacatatatatctttgcaaacataagcactcagctattctaacaacagtcacatgattacaacaattacaagcagatgaactgtattcataaggcaatatgccaaaaacaaagtgtataaacatgtatcatgatggttggtagttgtgtgtacctagctttataactccagtcatccgaaatactgtgatggacaacctgtcttttgacaagatcaatcaaaaacctctataggtcaccactgcatatgcagtggcccaaaaaggcaagatctcaagaaattttggtctttcacaaatgcagatacacaaaaaggaaatctgttcatttattgaggaagtttcaatgtttttatattgagaaccacagcagacaatggtgttactctctgaggccaaaagcctcaggacccagatggccgctgctgttaagtactggagtgcaaaggctggtgagcctggagttctgatgtccaaggcagcagaagaaaagtctgtcccagctctcagagagagaccagttggccttctatatttgttatctccagattgttggccaattgaatggtgtccaccaatatcaagggcagatcttcctcaccgagtctactcagtcctctggaaacaccctcacacacacccaaaataatgctttaccagggtttcaggcattccttaatcagtcaagttgacatctcaaattaagtcaataaatccatccctgtcaacttggcactatatgcatctccttaaaccatacttaatttccaaataaagaccacaacaaggtaacagtttcacctaacatgatgcaactatcctatgattgtgattttcaggattttagatgttaaggatttagtctttagaaattttgatctttcaggatttcaacctcggggatgatggcattcaggaatgtgtcttttgggatcataatccaaactctctataagtgtgtttcccagtggcccttcttgggacactctcatggatagaagtcacctgggaatctgccaggccttaagaacaggggctagtgagaaaccaaggatgcacacagtatgaatgaataatcctaaaatgtctctcttgaggttgttggaaatgtcatagtctagccatggaatcctgaaaatttgcctgctttgagttatgtctagagtggacagtctcaactgcagtgatattctcagagccacttggaggtctttttgaaaatactgattccagggcctcactctgaactgcctgaatccaaagctctgggggagaaaccctggcagtggtagggttgaaaagctcccaggtgattctagggtgcagccagggctgagaattggagcttcagaatctagagatcatattaagttctctacagagatctggtgtctttgatctgttaatttcaaagtctacaaatccactgctattcattcttgggaatgacctccttttcttaagctcaaataaacccacagtctgctccaatggaagagtttcacctgctcagcctgccaggtccaccctcagcatccatcccttagacagatgccctttgtctcctggtgaagcccatcattcatatgctggcttccccccagccccaaataccccatctctaaatgaaccccaaatgtgcctccttggtttctacactaaaagagtcctcactagacaactgaatatggtagatgttcatcagatgaggacatgagacaaatacacctcacatctactgaatccttaatttgccccaatttccattgaactgtttattcattcattcattacgtatttaaggaacaccttttgtaaccagattcagcttcttcccttctgaatatcttgaataatcccacatgaggaccaatatctttgcaaccatcagacaagtcaccatgcaacttctggtactgtctaacatccagctaaggattatgcctgatgaacacatctgcaaagcagcagctttccatgcctgctaacttgctaccctctctcctttcctggtgtctctctcttcagagagagaacactgatgatttctcactgcttgtttatgctttgacagaaagccctcgtgatacctagaaagcctagatactagcaagtgaactggttcttcctaaacaagatatcctggaaggccttattcacaaatttaagtgtgtcaacattgatctgagaaagaaggcaggtatgctgccccagtacattccatacagaagtgtgctgttcatttcagagcctgacattctcacctgttctgattcatgaatcacttcccaatagacagtggttaactccctaacttcccatttcttcagatataaagtatgaatgcaaactcaactttaagcaacagaatctgccaacagattctagtgtacaaactttatagccagactccctggtgcacctgtccttctcctgggaaacctctagaactgccccaggcacaggcctgaagaaatgtgaaataagtggtgtgtggattgccactttcccccttggcaagctttggcaagacatccttttgtctttccctgtcaacctggatgaggcttcagtcttctcaacacgagatccaggcggtcactatcctttggagctggtacaaaaggggcaaaatctattgtccaacagaagcagtggaagaaagtatctttagaactgcacacacctaggtttggaattcaaccctatgactcacccaacctcagtttccttatttttagactgagatactactacctacttaccatggtgtggtcatgaaaattaaatgagttaatgtctgtaaagtatctagtatcttcctagcacaataaacacaggttcctttctcttttctctcactgtgggacatttccttgaagatgtgatgagcattttgttaggtaattttagggttggtgataggtaagatctgttagagtgggggaaatagtatgtatagataaaaatggaaggatttttagagtttacagaggaagagcccacagaatctggaaattctagctgtagagggaggcaccaaaggtaagaatacagtgtggtgaggctgtgtttttgaaagataagaaatggtaatgagggatgattaccaagaaatgaaagtgcatgacaagttttgaagaaactagcaaagcagcatacgtggttgagcctaagttgctggtaaattagctgcaaattaaataaaattttaaacaaggtccttataccttctctaactatttgatcctttgttttttctaatgaatcacaagggcccgtagtacagagtggctataaagcaatgacattaattgccagaagatacacttgaggaaaatcagttttaatatttctgaacatatccaatccgtggttagaaataaggagaatgcacattttactcattgttaccaaacccatcacaagtggctagagtagtaaaaggagaaaggcctggaactgggaaggcaattcctcctaactagccacgtagcatccatgagatttagtcttttcttctgtaaaaggaagggggtgtttgacgtgtatcaatgatgtagcagaatgtttttggttctaagtaacagaaaagctggttcacattggcttaagtaataaagggaaattactagctcatgcaattgaaaagcccacagagatttgaaaaacttcagggctagctcaaacaacttgaccagggaccaacattcccttcaccatttcctggctctgctatctcagtgtttcttcatcttagggagactttggcagatctctgtggttgcaaaatggcttccagctgttctgtgaggctacatgccctcattcatttaaaaaaaaaatctttttgccaatgttatcagcagaagtcctgaggtttactctaaccacactctcttaggtcacatgtccatccctgaaccaatcactgggtcaggggatagtatgtgatgattgatccagcccaggtcatgtggtgctaggttcattcccattgctgaaggtggattctccataactgcatggattcccatatgaaattagaacagttgggaagtgagaagcagagaaggaaaggtgcagagtcaagcaacctattttctttttttaaatttttattttaagttcaagggtacatgtgcaggtttgttacataggtaaactcgtgtcatgggggtttgttgtacagattatttcatcacccaggtatttaagcccagtacccattagttatttttcctgatcctctccctccttccaccctctaccctcaaataggcctcagtgtgtgttgtttccctatatgtgttctcatcatttgactctcacttataagtgagaacatgcaatatttggttttctgttgctgcattagctgctaaggatatggcctccagctccattgaagcccctgcaaagtaaatgatcttgttcttttttatggctgcatagtactccacaatgtatatgtaccacattttcttcatccagtctaccattgatgttaggttaattccatgtctttgctattgtgaatagtgctgcagtaaacatacacacatgcatctttatgacagaatgatttatattcctttgggtatattacccagtaatgggattgctgaatggaatggtatttctgtctttaggtctttgaagaatcaccacactgtcttccacaatggctgaactaatttacactctcaccaaccgtgtaaagtgttccctttctccacaacctcaccagcatctgtcatttttggacgttttcatattagccattctgactggtatgagacagtatctcattgtggtttgatttgagtttctctaatgatcagtgacgttgagcttttttcatataattgttggccaaatgtatgtcttcttttgaaaagtgtctgttcatgtcctgtcctttgcccagtttttaatggggtgatttttttttcttgcaactttgtttaagttctttatagatgctagatattagatctttgtcgatgcactgtttgcaaaaaatttctcccattctgtaggttatctgtttactctgttgataatttcttttgctgtgcagaagctctgtagtttaattaggttccatttgtcaatttttgcttttgttgcaattgcttttggcatttttgtcacgaaatctttgtctgtgtctatgtcctgaatggtattgcctaggttgtcttccaggcttttacagttttgggttttacatttaagtccttaatccactttgagttaatttttgtatatggttaaggaaaaagtccagtttcagtcttttgtatatgagtatccagttatcccagcaccatttgttgaatagggaaccttttcccattgcttgttttcatcaggtttgtcacagatcagacagttgtaggtgtgcagtcttatttctgggttctctattctgttccattggtctgtgtgtctgtttatgtaccagtaccatgccattttggtaactgtagccctgtagtatagtttgaagtcataagcaaccaattttcatggtcaaagggatttaaaccttttttggggtgaacagagttccaatatataaatatgtgcaagtgctttactagctgttatagaaataggggtttacagccatgttttctgtcacttttaaatgacctgcttagaaacctagtgctctagaggacagagattaggctctctttgggtccctccagctctattgtttgctggtgcttgataagcaaatatctactaggacaacatgtgttcatgtctactgtctccaggcacttcggcaggccttgtgctatttatcctgtgtacagctttgtgaactaagtagaacattaattttattaagaatatccttcttaatgtaaagacttatcagtatccaagcatcatttgtcaaggttgcaaatatttacctaagtttctgataaagaccagagcaataaagccacagaccagcacaaataaatagctaacaaagctgaccaacatacagcactagggagaaattatgcgaaaggagagggaaaaaggaaggctttcttcaaataaacagtgctcagaagtttggtttcctgaaagtcccagggaattaattaaattccctgtatttaatttgaaagttgtatttactttgaaaattaggtggaaagtattttaaacttttttgaaaaaattgaaagttcccttaataagaactttggcataaaatctgaaatactttcaaaaattattattttaaattatggtaaaatacacataacataaaacttaccatcttaactatttttaagtgacactttcaatggcattaagtatgtttacattgctgtgcaaccaataccacagtccatctctagaactcttttcacttcacaaaactgaaactttatgccattaaacagtaacattcctccttccctccagcccctgattaccatcatcctactttctgtctcttgaatttgatctagatatcttatataagtagagtcatacagattttgtctattttctgaatgggttatttcacttaccataatgtcctcaaggttcatccatgttatagcatgtgtcagaatctccttcttttttgagacaaagtctcactctgtcacccaggctgaagtgcagtggtgcaatctcggcttgctgcaacctccaccttccaggttcaagcgattccctggcctcagccacctgagtagctgagattacaggtgcctgccaccacacctggctattttttttttttttttttgggatttttagtagagacagggtttcaccatgttggtcagactggtcttgaactcctgacttcaggtgatccacctctatcggcctcccatagtactgagattacagacttgagccaccgcgcccagcccagaatatccttcctttttaaggctgaatgacaattcattgtttgtgtataccacattgtacttatccattcatacattgatagacgcttggcttgcttccacctttagctattgtggataatctgctacgaacacaggtatacaaatatctttgagatcttgctttcaattcttttgggtatatgcattcttagaagtggaactgtaagatcatatggatgaaatactttttatggcacagttttgttttgtaaaattcttaaatatatattgcgaagtagcaaatactcgcagattgataatttggtgatttcattttatagcttaacaataggtataaaagagaaagcaaccgggcaaaacttttagaagatcaagtggcttctttcctgttcatggagatgtaagcaaataagagttcaattgtgttctaggcttgcatttgtgtaagtcttacaatcataaaatcaagtgcaagggatccatagtctaactcaggtttaacttgatgcacgggtccaagaaaacaacgccgtgcttcaggaatgaaacaaagaggagcttcttcagcagtcagggagagactgctgggctacccagatgtaacctatttttgcttgtctagcccacagacttccttttctgtccagatggacataacgacaataggaaacatgtctccatttcttcctcagtggagaaaataaaagcatctccttgtgaatatggtttcattgtttgaaagttatttgcattaaagcttccaaatttagtcaaatgtaatttcttagaaacaatatttcttaaagggagttatgtgttccttgaaatttgcaccagctactaaaacaatcatgctttcaaaccaataaatgtggtattaaaatgtcttccaactctatcaacttcactgaaaaaagaaagctagcattttttttggcacataaaacagcagtaattcaagcacaagcctcatattgtgttctcggttgtgacacacaataattggtgttggagtacttggagagaaacagtttgtatctccctacaatgaagaaaggacacactttgggtcagggctattcgtccctgaaaaagctgggagtgtttcagaggtggtaacgaagacactgtctcgttcacacactcattaatagtatcacctttcattagttgggtaacaacagataatgaaaattaatcaaacaaaaccccttttgacagagtcttcgatggtgatgtcatagaccattgaatatgcaatgctttttgctccagagacttctttctggctgtaagtgctgtacactcccaggatgatttgtgaatcagggactaggttggttttgctggaacaaagacgtggctcacgcctgtaatcccagcactttaggaggccaaggtaggcggatcacttgcgatcaggagtttgagaccaggctggccaacatggtgaaaccctgtctctactaaaaaaaaaaaaaaaaaaaaaatacaaaaattagctaggtgtggtggtgcgtgcctgtaatcccagctacttgaggggctgaggcagtgagaatcacttgaacccaggaagcggaggttgcagtgaaccgagatcgtgccactgcactccagcctgggtgacagagtgagactcggtctcaaaaaaaaggctaagaatgctaaatatcttgcagaatgtctttcaggagactgaagtcactgctaccttagactctcttacctaaacatttctatgttatcatctttgtaacctatgcttccaccaaaaatatgagattctaaagaggataatgagtgagtagttccttctctactctgccctgtctttctttctctttcttcccaggggcaactctttctcgcctgtcatatgttaccatcatcctcttgtgtatgcatgtgatatatgtatcactgccatctatggggccaagacggctaaagaacatttgggctatgagcattcttgtctctggttctttcctcctagtacagttagggccaacctttagtgtgcataagaatccctactttaaatgcagattcctggaccacccccagggattctgatttactagttctaggatgagacccaggaatctgcattttaataagcaccacaggcaattctggataggtggcctcttgacctcactttgagaggccatgtctctgagtatgacagcctagcatctctgccccagcctggagctcagtctcatcagggatgggttagtgcccttggacaagagcagcagctcccaaatttcctccagtgtgtttgagagcagctgcatgtttctgtaaacgcattttgcagatcattttctggggttaatcattgcaaagatctgattcagacagtaggtttcaatcacactttttcatggctcaatataattaagggcggaagttgctgtgttgggtgttccacggtggccacgaaccgtgactgacagattggacaagcagaagttccaaacaaaacaccagctcccacagagctttgtgagctgggaaactggccaattccttttccttggcctcagtttgctcatgggtaagggagctatgtcttacctctcataggtgttaggaagataaatgactaaaaaagccattgggtcaaatgacatgccacctttgacatctaatatgaggatttagcagagggctctgccgccactgtgaaaactcctatcttctaaaaatcttatctggaagagaaagaaagaatccagtgtaaagcacatactttgaatcagatgtcccactagactcctccttaatcttcacaaccccttgagatacagtagtgggttacttaagttccactagggtacaggaaacagagatttgcaaactttaccctagggcttggtccacagaaaagaaacacaggcaggtaaatgaaaggtctagagcaggggtctccaatccccgggctgcggactgatatgggtccatggcctgttaggaactgggccacatggcaggagttgagcagcaggtgagtgactgaagctgagctccacctcccgccagatcagtgatggcattagattatcatgggagtgtgaaccctatcatgaactgcgcatgtgagggacctaggctgcatgctccttatgagaatctaatgtcagatgattgtgagttgtataattattttattatatgttacaatgaaatagaaataaagtgcacaataaatgtaacatgcttgaagcatctggaaccaccccccgcaccacccagttcactgaaaaattgtcttccatgaaaccagtccctgatgtcaaaaatgttgggggccactggtctaagggagaaccaagatttagggatcccaacgcaagccctttcacttttaaaaagttacacattgtaattgcataatgaagtaacatgtgaaccaattcctctcgtaaattcattacaagatggagttaaattcctctttgtctctccttctgtaaatgtccacattcttctaggaggattcactgctttaggtttgctgaatatttttaaagaccttgtgctatgtaagcacatacagatatctgtacccctggaaaacctacggagtgattttatgcatatgtacccatgttctgtgtatgcgtttttaaagtagaaatggaaccacgtcatatacatcactctgcaacttgccttttgcactgaacaatacctctggaggatttgttattacctgtacatgtcagtctacttcacttgatttaactgctgctgaagcttccaagctttgggtatccccagcctattcagctgttctcttattggtggacattttggttgttcccaatttttgctaaaacaaatgtagtgaacaccccatacacgcctctttgtgcacacatgtctttctaaagtagattccacaaagttggattgcttcatggtatgcagggtatgcccagttttattttttagtagaattgtctccaaaatagatacatgtatttacaccagtggtgtctgagagcatatttcccctgttttctcggccaatattgatatatcatcaatttaaaaaaatgttgccaatctgctggcaaaaaaagagtatgatctttcacttaaatttaccttttcctgattactggtgaggttgggcattattttatatgtttgttggctatttatgtttcttcttttgtaaaatcccttaatctactttttacccattttccatagtgttgcatagcttttttttcttgctaaatttttggagttctttatgcatcctgaatcctaaccttttaggatctattttctcctgggttacttgacatcttaacattatagtatatttctctctctctctctctctctctctctctctctctctctctgtgtgtgtgtgtgtgtgtgtgtgtgtgtgtgtgtgtgtgtgttttcaaacagaagtttctaactttgatatgatcatatactactgagcttttcttttatgaattttaatttatgttctgtctatgaatgcctcctctatccccaggtcataaacatattttttcctattatgaagccatgtatttttctggccagggcatagcatgaatctatgtaccttctatcaggctcagggctgctgcatgagcaaggatactgacattctgcctggagagcaaccatttatactttaactttcaactggattcagctgcagggtgatcctcaggaatatgcttcttaggtagcctaaggggactggcttaggccgtagcaagaagcttttgagggccatcatcaaacagaaacatttaaaccacaaatccagtaaaggtatggaatgactttcttcagagatagccaaaacccagatggatttattatcttaggatatttagggtaagtccacacttgagaaggttcaaatgatctgctacaagttacttggccttcccactggcagcactgtctaatggaaatataactcaagctgcattagtattttaagacttctagtagccacattaaaaaataagtaaaaagaaataggtaaaataattgtaatgatttaacccaatatatccaaaatagtatcacttcaacatgtaatcaagattacatgttattaacatattgtacattcctttttttgtatgaagtctttgacatttgatgtgtatttctgctcaaagcccatatcaattcagagagccacatttcaagtattcaacagccccatatgcctagtggctactgtattggacagagcagccctaaggattaagactgcaaaagatctatgatgtgctgaaaggcatcttctctatttatattaaagtgattaagcaaccacagtctgaatttttaagtacctccttcaccctccccccatcctttgttctcctaacacaagtgtattataacttcaattgatcccacctactgatgtagactaatcttcctaaagcagttttgtttggattctttcctggagaggatgttgctgccaaagaagacttttaggaggaggtgaagttaagcggaaacttggaaggtgggcaggaattagccagatgtcagagggaactgtgtgattgaggatgtggctgcggtgtataggctgagagtcaagcagacctcagatcctacagagacgtataggtcctgctgagaacttgaactggattctgaagataatggactcatcaaacatatgcagtagagagtatgggagagaggcaggatttgaggcaaggaaattggtttgaaggaaagtgcaaggtccaggttaaaaataaatgagggcctaagctaaggcaatgcattcattcattcattcatttattcactctacaaatacttattgtctactgtgtgagagttgatgtctcaggtgctggaggttaagtaggaaaaaaagcatgcaaaaccctctgccctcacagaacttcaacatcctgtggggaaaggaagtagatggtgatgaaaaacggtgatcctcaagtttcaggtcttgcttggtgaatgatgggaccattttctgaaatagatattacaagaggcagaacaggctttcggagaaataatgggttcaacttcatctgtttgacaaaggtttggatgtttggcagatattcaagtggagctacccagcaagctgctggatatgcatatttggataattctggaatagatgtggaagccatggcatatcaattgtataaaatccctgggagtgaatgagataaccctaggaggatgtatggaagcaagagtcacaactcaaatgattacagggctcaggtgagttatgaatgtatgtgaattgggtcatatgtgaaatagagtgttgtttttgtggctaaacagagagtatattctgtctaaggcagcaagatttggctggtggaccaccagtttgcaattcctacacttttggaacttctttctatgcctcttgtctcatttttcaaataaatatttttatggcaggcagctagctgttcatgaaaacccatttcctcttctgagatactcattgcagttcctagcctccttgccattactagtggccgtgactgggttctagccaacgggatatgagctcaattttcagccaatgccttaaagaagagggtgtgcccctccatactctctcctcttcctctggcttatatacatgatgacgaagtctagaggattttggagtcacgagatggaaggaaccaggaataaggccacctcccaaccaggacatcttcttttgactattatctgagtgaaaaataaatctttgtgatgtttgagccattatacaagtttggccctgtttgttactacagcctagcctaacttaagaaatccactgctaaaccacactaatcctggctgtgacatctctaaggtcagggaccatgtctgtccagttcattcatggatcctcaacacatagcccaggacatagcatgcagtaggtacttaatacaatttcttgacaacactagctgtgttttattgagcatgttttatgtgccagtcactgcactagatcttttatatattgtgcattatttcatttcatgtaatgacaactctataaagcaggttccaatattatacttttttcctcgtaagaagattgagggttggaaagcttatagctggtatttgaaatgaggcagggtgactccaaaacacacactctgaaacaccagtacatgaccacatgcatactcatttcagcattttaactcaagtattttctcccaccaagaatgccctcaacccctcctccccaattattgaagcctgccttctgcatccttcctagcacccatacaatcattctaccctttaattagtccagcaggaatttcatatatatcattactacaacagggattccatgtatttgtctgcttctagaaataagttatcttgagggtagcacaatatcttagacattattcatctgagtgttccttaaaacatacgggaagatggagaacctgccatgtgccaggcaccctaggcactgaggactaaactgcaaataggacagagacaatcttctcttttgaaaagctctattcttgtgggagtaaacagacataaaaaacgcatcacagcacaatgtaacctccacattaatagacgcagaagaagagcggggaaccagttctttctggaggaggaaagaaaggactcccagagcaggtgacatttacctgagcttctgaagagtgagtagaagttctccagttgtttaagaggaatctcaattagtgggaaaagcatgtacaaaagtgtggatacatcaagatgcaggagttcttctggatggatgaggtattggattgctaaaatgtaggattccttcatggattcattaatttattcaacagatactgagtaaacctagaatgtgtcagggattgcactaaatgtaaaggattcaaaagtgagcaaaacagacatgatccctacccttgtggagcttagaatccagcagggatggcagctgactacaaagctctagcaatcctgtgtgagaggaaaggaagaagggatagcccacatgtaagtgagaagctggagaagtgggctggtccagattgcaagagacctttgacaccattctagggagaaggaaatctctcgtcaatctatcaccaagtcctgcctctcctgcctccttgatagctctcaattgtgtccagtcttctcaccgccactattctcagtataggtcatcatctcttccttgaatgaacgagatagtcttctaaaaggctttcttgcctgtcatcccccacccccacccattgtcctcaatgcaaacagagggatctttaaaaaatcaaaatctgttcatgttatgccctatggtaggcagaattctaagacagccccataatctccatcttcctgggggctactttggtgattatattacagtacacagcaaaaggggtttttcagatatagttaaggttactaatcagtcaaccttaagacagagaaattatccaggtaggtttgactaatcaagcactttaaaagcagagttttctctagctagtggcagaagaggatggtagattgattagaagcaaaggaggactggatggatttgacatgtggttgctgactttaaagttgcagggaggggggtggatatcctacagaaaggatctgagagagttctgtaggagctgagagtgaccctggaggacagccaacaaaagaatggggacctcagacctacaactgagaggaaccagatcatgcaaacaacctgaatggatttggaattgggtattcccccagagccttcagacaggaacttgaaccagcctataccttgccttttgcctcggacatcctgagcaaagtatgcagcagccatgccaagttggacttgtgatctacagaacagtgaagtaatagatgggtgttgttttaagtcactaagtttgtgataatttgttacataacaatagaaaactaatatacctccgacctttccaaccccccaataaaactactggggatttaccaggcccaggcagttaatcgctacaccagttccattagggaggtatttttattatcaccatttcacagaccaggaaactgaagctcagagagattaatacttttcctaaggttatagagctagtacgtggtgctgaaatttttacttggctgttctgactccagatttgcactctatgggttctcattgtctttaagataaatccaaatacataagcatggaattaaaggcccttcctgatcccattcctgttcaattatccaacttcagttttaggcactcctctcaaattcctgacagcccccataactaacatgctcttgattcctgactgcactacaatcccttctagaatgctgcttgtccctcccctccatctgctttccttttggcagactctaatggtcctttgggtcttgtctaacacacctcttctagggaaagccttccttgcccctccaagatgggttggatgccactccagggtcccccagaacctcatgctctcccttatcagaggacacaggacattgtgttgggaatgtttacttggctgtgccctcccactagactgtgaactctttgcaagccagaactggcgattagttcattgtcaaatccctagcgtaggacctggagcagagaggtactcaataaatatttgctgagtgaatcattgaatgaacaaaagtgctttagccaagaggcaatggggagccatctaaggtcttgaagaaagggagtgagcttattattacacctgtgctcacaaggacaagttcagggcaaaccttgcactcagtggaccatcctcatcagcagttaaggatgaaacaagttcatttgcattgtggccttgggtttcttgcactgtaaagcttggctgttatctcttctggaccacatctgaatattagaaaatgccagaagccttcacagtttccccttatggaggtggaaagcataaaaatagcttgtgacttgggtctgggccctgaactcccactagaatgaggagcccctctcccaaaaaggctgtgggaagctgaggtgaaggtgacgtggagacccacttacgtgacactacagggaacgggcagccgcctctgaaggtctgtccccctccagcccataccgttccatgcctgcacttgctcccggagcacattgccgaatcttgttctccttagatatgcaaatattgcttcctgtcgagaaggactgggaggccttccgctttagaggcagcgcttatagcgctagctggtcgtggaatgcgattacagcgtctccattggagaccgctgagtgcctcggtttccctgtctgtgcaaagtgcactccccagacgccgctgcctcgagggaccaggaaatgcgtctgggggcgccaggaaagatgagaagataaagtcacgatgcgtccagctagctatagacacaagcagaggagccagtaggccaaaggagacgcacagctgatccgtgccgaggcgcgggctccactccctgaagtggagggacccttgaatctttccttgcgtaggcgcgcggcagagcagcgatttggcgaaaagggccgagactcaggatgcctgcaatgcgagcgaggggcggacagggcgcacggggcgcggcaaggctgcgaggggcgggcctgggccctgagcctcctgcacttccagccacagctctgggccttgggggcgggaaggggtggagccacgtggggaggagcaaaacccggaggtcccgggcaccttgggcagagccagagcggcgggagccggtcctgggcgcgttgccccgggagcgcccgtcgtccgggcagagcgcagccgcaaccgcgaccacagccgcagtcgctttccagcctgccttcggtgcgcagcgggggaacagggctagtgcagccgccggaggggggcacgggctcctctcccatcccagagctactgggctgcccttgctgtcctcgccgccccagcagaccccggccggacctgccacctgcgccctggttgcgccatggatccttcggaaaagaagatatcggtgtggatctgccaggaagagaagctggtgtccggcctctcccgccgcaccacttgctccgacgttgtgcgagtgcttttggaggacggctgccggcggcgacggagacagcggcggagccggcggctggggtcggccggcgacccgcatggcccgggagagctgcccgaacccccgaacgaggacgacgaggacgacgacgaggcgctgccgcagggcatgctgtgcgggcccccgcagtgctattgcatcgtggagaagtggcgcggctttgagcgcatcctccccaacaagacgcgcatcttgcgcctctgggctgcctggggcgaagagcaagagaatgtgcgcttcgtgctagtgcgcagcgaggcatcgctgcctaacgccggcccccgcagcgccgaggcgcgcgtagtgctgagccgagagcgcccctgtccggcccgcggggccccggcgcggcccagcctggccatgacccaggagaaacagcggcgagtggtgcgcaaggcctttcgcaaactggccaagctcaaccggcggcgccagcagcagacaccgtcgtcctgttcgtccacttcgtcgtccactgcctcgtcctgctcttcgtcgccgcggacccacgagagcgcgtcggtggagcgcatggagacgctggtgcatctggtgctttcccaggaccacacaattcgccagcaggtgcagcggctccacgagctggaccgcgagatcgatcactacgaggccaaggtgcacctggaccgcatgcggcgtcacggggtcaactacgtgcaggacacttacttggttggggcaggcatcgagctcgacgggtccagaccgggagaggagccagaagaggtggcggcggaggcggaggaggcggcggcggcgccccctctagccggcgaggcgcaggcggcggcgctggaggagctggcccggcgctgcgacgacttgctgcggcttcaggagcaacgggttcagcaggaggagttgctggagcgcctttcagccgagattcaggaggaactcaaccagaggtggatgcgacggcgccaggaggagctggcggcgcgggaggagcccctggagcccgacggtggccccgacggcgagctgctgctggagcaggaacgggtcaggacgcagctcagtaccagcctttacattgggctgcggctcaacacggacctagaggccgtcaagtcggacttggattacagccagcagcaatgggacagcaagaagcgcgagctacagggccttctgcaaactttgcacactttggagctgacggtggcaccggatggggctcctggctctggcagtccctcgcgggaacctgggcctcaagcctgcgccgacatgtgggtggaccaggcccgtggactggccaagagcggtcctggcaacgacgaagactcggatacgggactgagctctatgcatagccaagactcggactccttgcccatgtgcgaatcccttgtgtaggggtggggggcggggggcggggggcgggaacagggggattcttttttcttgcagaatgcagtgggccagccggctcgcggacttgaaaccaggctgttgcgagcccagagctccggctgggcagcagcgctctgcgcagcctcgcgctcatctggctccggggtgagtgcagagcagggtgagggtagaagaagtaggatcctcaatacaagctcattaaagagagggaaggagggaggaggcaagaaccccctatactggaaaacaaacaacccaaggaaattgacgtggtccgagcccattttcaaagtaaggaagtataatggagatttcgctactcttctgtatgggaaggactgatggcagctagaactttagtttgtggtatgaagtgctttaaaagaaacacttggatgaaaaggaaattccttgaatgttaattgtgactgtaaacgtgttaaaactagccaaagaggacgcactggtgtcggtctctgcctttcttacctctttgataaaacccataggcaccaaaatcctggctgtttacatttctgcagatttgggaattacccatctgctaaatcatttgtcttttattttctttcaaaggctaaactgtatcgaagtctaaccctgtatttcctcctagtaaacacaatagatgttaaaagggaattcttttcccaaaataaccttttattattacaaaagccaaacataatcatttgagatataaaatcctggcaaacataatcgtggttaaaatttaatctgggccctttgggatctgtcccttcaaaggcaggtgagttgccctttaattcgtattgccacttcattgactcaatcactgttatttcagaaaaaaataaaaggaagtagcagaattcaagttacgcaaaacaaaacttgctgtctaacaagcactctttgaaagcaaagatgttttagtgttcagcttttaaattgagctatgtgattaaaaccaaccatgaccttaacggattttacccaaactcgtctaacttcagtatgttttgtcagagattaatcagttacttgttcaaacttaaattgagatagtgtaaatatcagggtttcctagataaggacagaaaagaaaaaaataaaacaatctcatagtactccttgggtgaacaatgtgattaacgatggcacgtagtcatggaaaaaaagataaaaagtgagttaagaacttgaattactcttgtctggcacacgcctatgcacatgccaggagatgcaagtgcaacaccatctcagtagctggcgacagagctggtggggactccatgtaattgttccagttgtttcaattaaaacttatcagttgtagctagttgttggccccgcggaaggagcctgctggccgatttccctctgcagctcagtacttctgaggaatgtgggatctaatctgtcctgagaaggttattaacaatggggcatgtgtgtggtaccagcatggtgcagaagcctcttatcaacctactcttgaggggctggctccagtttcaacactacatgtgaagataacttaagaggtcttgctttatacagaagttccttcccttgcagagattctctatctgcttgttgccaatgggagcctgcccttatgacctcctcaaaccactgtttgtgctgtctcctttttagagacagcaccccccacccgccccgcactaccaccaccactgccctggtattacaacatgtgtgcctgtttgcagattttcaagtaaaaatgggaatttaaaggccattttcttaattgatgttttcaaaagacattagctggcataactatggttttttagtttcatctgatgcaggaaatgtctatgcatttggtcttgaacatgataaaaatgaggaagggactgaaaaaaacccaccatccccagacaatcatttgatcccataaacacgaaacctaatgatagctttcattttgaggcagaggtaaaatcctcattagagtgtgacaaaatgctacttgtctgaatggtttatgctgacaatgggctgacctggtggttttaaaattattgtgctgtttttccccctcagggtggtaggggagtgattcttggacgtttattaactcaaaaagaacgcagaagttggcagaacagaactgcctggaagaaaggggctgttttccttttcactattattattttaaactttgatgggctgctgacgtcagcaaatatgcttgacgcctgtaaagcaaataagccacatcacaagcagaaagcctgtgggattttctggtgccctatttctagaaccttccctgttctgaccatttgaaggtgcttatttagtcaaccgttcaggcagctgcgaggctttattgataacaaatggcagcctatttggcccattttttttcttttatccaaatcaattatattcctaaaaggcactctctgtgagtagaagaaaggagtgtgtagaacaggctgacgtgggggagcggggaggaaggagacaatagttctttttactaagagctttcgcaagcctgagaaaggtgaaataaaggtataaaaagcaccaaaacagtgcctgtgcataggaagtgcttaataaatgctaaatacttcaagttttaattcacatttatggtcaccatggcattaagaatgagaataaatgcatgacagggaatgtaccaatgtcaggatttcagcgcccctgggaaaattaactcagctcctattctccagctctaatggaaatcctgggcagaaaccagcaaacttaagaagggtatgaaatgtaggtcccttaccagtcagccccaccctttttttttttttttggtaactgagataatttattgtatttttgatctgagttatcctagtctcagccatctcccaaaccaaaagattccatatggcatctttatgtttgtttatttccttataaagtgtgtttattttttgctgattagaaaagttgtgtacacgatagtccttacgatgaacctgaaaataacataaaaaggcaagaaaagtcactctaaatctctgtaccaaaaacctgtcactaccaagattggtatatttacttccaaaccttttgaattgtgcagatttcatatttgcttctgtatttaaaaatatataattttgataagattgtatatacatgtttatactcaggtttgacagactccctgtaaacagatctacccatctggtggatataccatagtttacagaactgcgcatgttatcagtttgtttcccatacttttttttactgttataaaataacaccgtaataagtttctctgtgcatgtatctgtttacctaattagactcccaccctccccacaataagataggtttccagaaagagaattctcaggtcagagtacaaacatttagaggcttgatactcactgccaaattgcttttcaaaagatttgttctaattacaatcagctatgcatgagcatgcctgtttcactacagcttagctttcattagatattatattttgttaggaaaatattttaatcaaaatttactaattaattcttcgtggcctcaggaagccaaagctgacaatcactgacttaaaatattcttacaacagcaagggtgggcccgtggatcagaagtgttagttaagagggtgtggtgttttctctcctttccattttttttccttccctgagtatttgcttaaggtaatattaatagaattttatctcatatcagaattggtcaatgatctgagaacagaagggacagaaactctacagaagcagggctaaggagataacaaattgaatcagagttataaaaagaaaatattcgttatctttttcatcttgagtctagtggaaaaggctattcttagaaagcaatgccatgaaacatatttgattttgtgcttctccatacccacctctagcaaaaattaaatcaaatgaaacacataaaccaagttgtttataagtagtctgtaatgaacagtttagatttttctaggaatttctttctaaatatgatatgcacttgaggttgttcttaatatcttgaaaagagaagatttgattatgacaatctgtgaaatttccattgtgaaaatgcttgcgaaatttgttttcccaagcagaaaagaaggaagatgaggagaaatcaagttttgttgagtttttttgaaatgccagatcctcgtgttttttcacatgtattttctctgcattaatcttgtgagatagaacgttttaatctccaatgtttacagataaaggaactaaagccattcagttcataagtaagagatgcgggattccaacccaagcctgaccacaaaacctgtgccttgttgctacacacacctgatgcattacgcacagtaagtgttcagcacatccagaagaaaaagtccccgggactccagagcgttgccattggaaaggcttcagagatgatcaaagtcttgtccaggtatttctaccaggaaagtggagtacttttcggaagatcacacttttgctaaatctactaggtgaagatttagtaaaatacagaggaggggaaattcttatgtaaatatttgggtggctgtctgggagaatgaaaaaaaattcttaaaaaacgaatactccctgtgttagcttggaggttttgactgaatgccccatggactgttgttgctctacaaagcgcaggtgcatagtcagtcaacaacgtggactcctcagccatcagggaagacagctgtgtgctagtcagactcacatctggaaggtggtaccaaccatgaccgtgctggtgggagctgtccccagcacttttaacaggctttatttctgtttgagcctctgggtacatgaggatgtgggaggagtcgaaggagggagtgccaggctttccaaggatctttgtgtgtggcattaggtatgcacacctggctgaatgcatctttggccacaatgaccccatcgtgctcatggagaccttgcatggattgctttgaaggcctgcttcccccagcctctccccttctcatccattcccatgcaaatctcctgtttcagacacttctaggatttcccatagctttcaagataaaatccacatttcttagcaggtttgtgaaggttgttggttttccagctcaagatccctcctttaggtccaccctccccaacttaagaccacggaattgagttgatcctatttcttcattcaggtcacactatcatcctccttttatgcatgtgcccttttctatcttcattttacttcatgttctcctccctccccattcccactcccatttccctccttgctcttatgataggcccctattccaatgtattaatttacaaccttccaaaccatcttatatattcaaggctgccatgttgcataccctcaaggggcaccattcatgttgtattctggcatctttccccagagggcaccatttgcatggaaaactgtgtgaatggtaaccctgaggctgagcaatgtgccagcacagttcatatggttgtgtatgtatatgtatccttgacagtagactgaaactgtctgtatgcttgtgtttaatatatatgactttattgagctataaaatttattatgtttctttctttttcacatgacattatgtttgtgcaagcattctgcattggtatatgcaaatttagaccattatttttttacctgcatggtattctgtctctttctgtatttccttagtgagtgatatctaggtcgtcaccaattccttgctatctcaaacaaggtgtcgattaacacagatagaaatcggtggacatatgtgagtgctgaactgcaggattgctctgccaaattgctatacccggttaggctcttactaggagtgaagatttccatattccccacaagcacttgatattgatcaaccttctactatttgcaaatctgttttaatttgcatttctttaaaatctagtaaagttaagcttcatctgcttattattctttaggtcccccttttgttaattgcctatgttgttattgaccatttttcctttggtttcacttttctggcagattttcagaagttccttacatattctgaacattactttcttttaaccttagagctagtgtgaatatcttctatctgtcctccatctctaactgtgtccctggtatctgttgttgaaaatgtctttacttttaatgtagtcaaatttagcatccacctcccctgtggcttgtggtttggggttcttgtttaagtaatgaagtcacaaaaatatggttctatatattttcttctactagcctcatactttctctctctctctctctctctctttagttctttcttcctctatccctcctttcttccttcccccttatttcttcttcacagataaagtgaaatacttctgtggaaataatctttatcttatcaagttttaccctaaagaatagtttaaatcctgattatcctgaaatgtagactaaatttttgtatttttggtaaagacagggttttgccatgttggccaggctggtctcgaactcctggcctcaagggatctgcccgttttggactcttacagtgctgggattacaagcaagagccactgtgcccagcctaactttctttttctttttttctttttttgacagtcttgctctgttgcccaggctggagtgcagtggcatgatctcggctcactgcaagctccacctcccaggttcatggcattctcctgcctcagcctcccaagtagctgggactacaggcgcccgccaccatgcctggctaatttttttgtatttttaggagagacagggtttcattgtgttaaccaggacagtctcgatctcctgaccttgtgatccgcctgcctcggcctccccaagtgctgagattacaggcgtgagccaccgtgcccggccccagcctaactttcttacattttatttttatttaccagtgttcaaaataatggggttgtccactagcattctccaaaggtgactaatagttcttcttgtttgttcatttttttaggataattataaaattttaaatttaaagtatttcatttttttcaaaccattgtggttattaatattactgatgctccgtttacctatgtaacaaacttgtacatcctctacaggttccctggagcttaaaataaaagttgaagaaaaaaatgctgatgctcaaattgtcccctctttagctactgggagccttttcaggtcagcttctgaattcttttcacacaattttcatagtctttgatagcgttctttgctctctagtaggtcaaactatttcaggctcctactattcattttctgtgccagtcctgcaatcaaccatcactataaggagtcctgattccttttagtgggaaatgatatttagaagccacaatctggatgctaggggtctaggttagtgattgcttttaggacttttcagagtcaacgtgtagaaaatatgtttttgttttattattattcttttgcttggtttttgttttgttttctattatttttaaaattgtggtgtaatatatataacataaaattaatcatttaaacaatttttagggatgggcatggtggctcacacctgtagtcccagcactttgggaggccaaggagggcaggttgtttgagcctgggaactcaagaccagcctgggcaacatggcgaaaccctatctctactaaaaatacaaaaaattagctgggtgtggttgtgcatgcctgtagtcccagttacttgggaggcttaggtgggaggatcgcttgagcccaggaggcagaggttgcagtaacctgagatcatgccactgtgctccagcctgggcaacagagtgagatcttgtcttaaaattttttttaagtgtacagttcattggcattaagtacattcacagtgctttgcaatcatcaccactatccatttccagaaatttttcatctcaaacagaaactctgtatccattaaacaataactcccagttctttccttctcccagcccctggtgacctgtattatctttgtaaagaatgcctatttgagccatttcaccatttagaattgggtttttgagggggatgggaattgttgagttggagttctttatttactttggatattaattacttatcagatatgttatttgcaaatattttctctcattccattgtttgccattattgagtgtctgtattagtctgttttcatgctgccgataaacacataccccaaactggggaatttataaaggaaactttaattgactcacagttctacatggctggggagccctcacaaccatggcagaagagcaaaggttgtcttacgtggtggcaggcaagaagagagcttgtgcaggggaattcctctatataaaaccaccagatcacatgagacctttattcactattatgagaacggcatcggaaagacccacccctgtgattcaattacttcccactagattcctcccataatatgtgggaattgtgggagctacaattcaagatgagatttgggttggggacacagccaaaccatatcagggtctttgatgcgcaaacagttttaaaattttgatgaagtccaacttatttattattctctttgttgtctgtgcttttggtgtcatatccaagaaatccttaccaaatccaacatcataaaacgttctccctgggttttcttccaagcattttataattttaacccttttgtgtttaggtctttaatccatttttagttaatttttgtagatggtagaaggtaagatttcaactttattcttttgcatatggatatttagttttcccagaaccatttgttgaaattgttatcctttccctattaaatggtcttggcacacttgtcaaaaattaattgaccacacatgcaaaggtttatttctgagttctctgttctgttccatttgtctatacatctttccttagtctagttccacaatggtttaattgctatagatttgtagtaaaatttgaaatcaggaaatgtgagttttctgtattttatccttcttttaaaaaatcattttggctattttttggaagtaccatatgacttttaggatgagtttttctgtttctgcaaaaaaaaaaaaaaaaaaaaaaaagccagtggaattttgatagggattgcagtgagtctttagatacctttggattgtattgtcatattaagaacattgtcttctaatgaatgaacatgagatgtctttccatttatttatgtcttctttaattgctttcagaaatgttttatagttttcagtgtccaagtcttttgcctcattgttagaattattcctaagtattttattttattctgtttgatgttatagtaaatggaatttttaaaaattcctttttagattgttcattgttgatgtatagaaatgcaactgattttttttgcattgatttttcatcctgcaatgttgctgaatttattagctcacttttttgtgtatggaatctttaaaattttctatgtgcaagattatgtcatttgcaaacagatataattttacttccccttttcaatttagactccttttatttcattttcttgcctaatttctctgcttaaaagttttaatacaatattgcatagaagtagtgaaagtggacatccttgtcttgattttgatcttcaggaaaaaactttcagtctttcactattgaatataatgtttgctgtggatttttcatatatagcctaaatcgtgttgaagatgtttccttctattcctagttactgatttaaaaaaacaaaaaacaaaaaacaagaaagggtgtttcattttgtcaactgctttttctgcataaattgagatggttattattattttttctttttttaattgtggtgtattacattgattttcatacattgaaccctccttgcaaaacaggaataaatcccacttggtcatggtacataatctttttaatatactgccaaatttggttagtattttgttgagacttttatctcagtattcataagagatattggcctgtcgttttctattttctaagtgtctgtctggttttggtaccaggataatgttggtatagaatgagttggaaactgttacttctccttgaattatttttagaagagtttgggaagaattggtattaattcttctttaaatgtttcatagaattcaccagtgaatccatctgatccaggacttttctttattgggaggcttttgattactgattcaacttccttactggttatataaggtctatcaaattttccatgtctttatgatctaattttggtaagttgtgtgtttctagaaaatcatctatttcatctaggttatccaatatgttggcatacaattattcataatattctcttataatcctttttgtttctataaaacctgtaataatgtccccacatttatttatgatcttagtaatttgaatcttcaaccttttttccttagtcaatccagctgatttgtcagttttgttgatcttttgaaacaagtacttttggttttattgatttttcttttttgtcgctccattctccatttcatttatctgtgctctaatctttattatttccttctttctgctagctatgagtttagtttgcctttctttttctagatccttaaggtgtaaagttgagttattgattcgagatctttttaaaaaatatttatgtttagagctataactcttactgttagcactgctttcactgaatcccattagttttgatgtgctgtttttttgtttgttttcatttgtctcaagattttataatttcctttgtgatttattctttgatttattagttttttaagggcgatttatttaatttccacatatttgtgaatttcccagttttcgttctgttactgatttttcgctcattccattaggatcagaaacgatattttgtatgatttcaacttcttaaatttattaagacttgtttgtggcctaacatatgatctgtcctggagaatgttccatatgcacctgagaaaaatgtgtattcagctgtagttgggtgcagtgttctggatatatcttttaggtgtaatttgtttatggcattgttcaagttctctatttctttatttctcttctgtcttgtgttctatctgttattgaaagtggcatattgaagtttatttcaactattattggagaactatttatttgattctgtcagtgtttgcttcatatattttggggctctgattttggtgcatataggtttataattgttatattttcttggtgagtttacccctttatgaataaacaatgtttgtctttgtttcttgtaacagtttctgactaaaggtttattttgtctaatgttagtataactaccccagctctcttttggttactatttgcatgaagcatcttttcccatcttttcactttcaacctagttgtgtctttagatttaaagtgaatttctatattttctatttgttgtgacaacatcttcatactttcctttagcttttaagatatggcttcctttgttctttggacagccctaaaatagctgatttagtcttgtttagtaagttctgcttttgagcttcttcattgatggtttctattggctgcttttttcccccatgaacaggccgtactttcttatttctttgcgtgtctcataattttttgttgaaaacaagacttttaaaataacataacattgcaactctggaaatcagatccttctcttcctagggtttgttgttggtgccatttgtctttgttgttttttctttttgttatttttgtttgtttgtttagtaactttcttgaactaattttctaaagtctttatccttgtcatatgaccactgaaatctctgctcagatagcctagtggtcattaatgattggacagagattttctgaaatgcctgtaactaataagcctctcagcctttactgaggggctatgtgtgtgtatgtgtatgagttgggatatgttttcactattgaggggctcagtttacaactctgctttagctcccactttctacttgcttagagcctaaaggtctgtcagagtggggagcttaggactttctcaggtctgtcctgagcatgtgcacattcctatgcgggtgaaaccttctagatttctagaaatattttagagcttttcaaagcccccatggactatctcattcaccagcttttccttttaactaacttgatcagcttcttagttttcccaactgcaatcactgcttcaagcagttgtgatgttagataattgtctgtagttgcttttgacaaatgtccccgaggaaaaagctgttttgcattgtgcgagatctgagtcgggtcaaataaataccagccagggaactgccagacaggtcaaatattggcaaatctcagaatggtactttagccagctcctaacacattctctcccttccagtggttcctgagctgctggttttcactgtgattatggggctgctaattttcactgtgattgtggggttgctgattttcactgtgattgtggggctgttggttttcaaggctactgtggagctaggggcggggatggtaagagggcaagttaaaacgctagaaagcatgttgttcttactaagattctgtcatttttctttattaaatgctctttggagccttgtaagcttttggttaatttgaaaaaactgggaaaagttgattttgacaatttttttgcctgtattcttgttgcttttattgccaagtggctttttggaggttctcagtctgccgcactgacatcacttgtcaagattgttttcttctttgttccctcttttataggatgcacagaattttctttggctgacttgaaagttgtacatttaattttactcttctgtttctccagacttactaagagccatacttatgcttatttttcctgaccaatctataatcttatcgaatctgtgtttgcctccaggcaagacaagacccttaacacactactctcacttctctggtctctctgtcttttcattttggcatcatctacaattttagttctagaaaatcttatttaactaataataacctttctctgcctattttactgggattgaattaaatgtatacattatcttgagcagaattggtatctttaggatgctgtatcattctattcgagaataagataatactgcagtgtaacaaatctcccccaaattcagtgtgtcttaaaataacaataatttattctcatgcatgcatctgtgtgaggcagctggggcttagttaatctaggttaatttcagctgaacttggctacagtctatgagttttctttagacctgcttcatgtatttctcgtcctccttgaaccagaggcacagaactttcctaaagctcccttggagttgttacagagtggtcaggctaaactcttcttttttcctctgcttctgtgggccttggctttttcaatccaagtcaatacacaaatatcacatgatggctatgcaccaggcctaaagtttgggcctgcaaaagcagagataagtaaaacagatagcattccatcagtaaaaatactctctgagacactgatagtaggattttaaatggattcaatatcctagatttatactttgtaggtaacagttctacttttaggaatctacagaatatttgcacaagcagttaaggatgtaagttagtaatcttcattacagcaatttttataataattaaatattagaaatcgcctcaatagaagactagttatataagctgtaataatcatattattttatgttatatagctattaaataatgtgaatctgcatttctgatgtagaagaacacctatgatatgttgttaaataaaaaaaagcaagtaagtggaaagagtataaactcattacttatttttgtagctctaaaaatcactatttcttagctctgaccactgttaagttctggaatcaatgaccaccaagtagtaatgagcaccctagcaccaatgctgtggcatttaaatattatttttcattaatagggtaagtgccctttaaaataatggctgatttcaaatacagggcaggacatgaataaaatgggtctactacaccttacatactaaaaagcaagaaaatggttaaaaacgttgtggttatgtctaaagaactcagggccaacctaccaggctcccaatagctaaagatgggaaaaatttaagtttcagtgagaataaaactgtaatggactcgtcaaaaatataaaaatcctgagattcacaatgataccacaaaaaagaaattaactcattaaccaacttcagagattgctagaacaccaagttgtttttctagaaatcagtaataaagagaacatttattctgtcttttctgtacacactgtgtttctaagtcatcaaacagttgacgaaggaaagtctttacaaaagagttttagctaagaaatacagaaggaataattgaattagaaaagaacccttatgcaactcctaaaaagttgatcactgatggatgctaaagtgagtagatgtcaagaaaaatttatagtggatatatcaactgacaagattgaaatccagggatcatccagtcatgcttgcctcttggtatgataaaataggaagtattcagccttacctatcaaatattgcacacaaaataattgaatctgaatctaatcaagaatctagttctattgagattacaggaaattgtcagactagagaacgtgtggaatgatattctgagtatgtaatcagccaaatccatactgtgggaaattctacagaattaaaacctcatttctttagtaaatcaattttctaaaagaaggaagggaaatgtaactattgtaaccattatagatggaaagagtcttaagagacatatcaatcatatggactttggatattaattcaaacaaacctaaggtaagagaaaaaaccccacacattttaggacaaagaaaagaaagaacagaatattataaaagattattatttttaaatatgataatggtaaaatcttcttatttttaaaatattttacctgttagaaatacatagtaaagtactatggtgaaataatatgatggctgagatttacctgagatgtttcaggaaaaaattggaggtagtggagaaaggataaatattaataaaacaaaatgggaaaactgttgctatttgttgaagcttgttgatgggtacatgggattcattatgctcttctctgcatttgtttattggtttgatgatttctataataaaaagtgaaaaaagtaaaagagaaaaagaaaacgaaagtcaagttgtggaacaatgtgtatagtatgctttaatttttttctttttaaagaacagagtagaacaaagcactgttatactattatctgtggttatctttgggaaatgggactggggaatgatgtaggaagcttctgttttttattttataaactttgatttcatttgaatttttaaataagtacatataacttaagtaactaaaaaaaaagagaaagaataaataagatgtcataagtaaggtatgaacaaagtactatggaagcttgtttcctgtgccctggctgaacatagctgctgaaaggaggacctgaggttgtgagggtgcatggaacacttgaagtcagtggagcagccttacacggaccccacaccaactcacctgccgtgctgtgaggaggcctcagcgacatgacccatgctgtctgggaaaggcagtgatcgcagttcattgtgtgacagctaagcaggctttacagtagagtgagtccatgattagctgcctaagggaatgtattagatctgctcactgtgtgttaaaatacaaatttgtatcattctgaacaaatctcttaatggctgagtagactactttgttataaagatgttaccagttattcgttttttaaccatatcttccacgtcagtgagtttcctgtgttggtccagagctgggaggagagagcacctgaagggcatagagggcctggatgactttggcatcagttggtttaaaccgctggctcctgcagaggctgtggagatttcccagggggctcacaaatccatagccatgccaggcataatctaagcatcataaaccatccttcactttcatgtactgctagtttgtgaattttctgtagatggcattgcgatcagttgaaatccttactgaaattggaagattttaggatcttctgcatcaactaccatgacatgggatggggggtgtctgggctctaaactatttgatatttgaagagatcttcatatggtaagaaaatagggaccactggtgtggagttatgaattattcttaaactgctcttcagggttgaagtttgggtgccctttctgtttgtttataataacatcctaggcatatttctgccgtaatgtccactgagacacccaaggcttctccttgctcccagagcaacttacacagaaatccattacagtttttataacagtgatatatgatagctcagtgttatgtctcccccactagtggggtggggcggaaaatttggagagatgagaacagggattcatttattcaacaaactcatgaagccactggctgaggacctagaggcagagagatgaacaagatccctcacagagctcgctgagtgaccatcccggtacagtatgggtaagtgctgtggctttcctaggaaaaccaatgaggcctctcacacagattgtggaggccagggatggtgggagcagatgatggctaaattgagatttgaatgaccagttggagtttgccaatgaaatgagggagtggggggcaatctatataggaaaactagaaagtgaaaaagggcagaagaagagatgatacaagccaagctgagaggtggacagtgtggggaggggaggctggagaggttggttggggccagaccatgatgggtccccaccaaggtgacatgatgaagacttgggcctttaacttgagacaaatgagaagacactggaaacttaaaggcagaaaccctaagatgagccaatttgcctgcttgcgtgacttgggcaacagtgtgtgtgctggcttgttgtgtgcaaaatggaagtgaagacaggagtcaggcagctgattcctgatgcaggtaagattcaggtgggggtctgaatgaaggcaaaagtggttgggatggagagatgaggacaggctcatgggatgccgcagaggaagaatagactcagcttggcactggtttggatgtgcagagggaggaggagggaggactcagataatgactggatttccggcttcagaaacaggtggccattcactgagataaggaatacaggaggaggagcaggtttgggggaagacagtgcaggaactcaaactctctttgggtgatattttgtctattttagtatttctaagagatagctagctaccagaatcatcaagaaggtggatatctcaagccacggaggaacatataaatcttcctgcctttggttgccaggggcagtttttgaaatgtacataccaggacagatgccttaacctaggtagcacaggaccacacactctttggaaaagcaacagtgaagacaacctttgtgttttgaggaaatgaaagcagtttatttcctgaggggaaaaagtgtcatttagagacaatactgctcagtagagtagaagatcaatgtggctaacatcagctttttagtaagacctaaaagtaatgcaactgctggaaaaagctctatgatttggtggaacatttaaggtttgatcccagtagttcaaatccaggcttttccacttactaattctatgaccttagtcaaattatttaaccagagaggttaagaataataagtgcctaaaacagttgctgtgacaacagagattagtacattttagtgttgcaaacatattatactgaactgggcgatgccaagtgccttgtcccatttgtccattctttcattcatagagtcacaaacacctactacaggtatctactaggtgacagacactctggcagtcccagaggacatcaagtttactaagacgtggtccttcagagtcaagcaaggatgaaaaaagaaaaaaagcagagaacccaggaatcaggtggtccattttagaagagagttgaaaaggacctgaactagggcatgggaaaaacagacatgtacgagctgtttaggagctagcctcattcacatgtcatgatgaatcattggtatagggtgagagaggagtagcctagaatgaatctcagtattccagcttgggcatagggaaagatacgggtgggggctccttagatggtgtggaataggtcttggccagcagtgggggtaagaggtggtgaagttactttggaagatattgagttgaggtgtgtgtgtgtggatattatctgaagacaggacggggcagccatggacagggatttagctgctcaaagaaatgtgtagagtgggaagggaagaagactgaagatggggctctggagaagactgatatttaaacagtagataaaaggagaggaatacacaaagactaagaaagaacagagaagtaggaaaagaaggaaaaggtaacattgtgaaaatgacctttgagggagtgagtttcaagactagatggccacctgacctcatcaggtttggcaatgtataaatataaccttgaaaagagtagtgcgagtagattggtggaaaccaaagccacattcagtggcttgaggagcaagtgggaagtgggaagttggagacagcaaggaataagaactcatttgagaggtttggtatgatggggtaaagatacgactgtagttgtaaaaggatgaaggtccaaggaagaatggcagacaagggggagggagatccgagatgaggctgaagaagtaggtgggaggcacaacatgcagagcccaggaggccacaggaaggagtttggattgtatttgcaatgtcctgattatcagggaacagatttaagcaggtgaatgatgtgacctgacccctctggctgctcagtcaatgacagaggaagggaacaaccagggtttgactttctcaaggtggagacggtccataatgaggccctggcagtgggtggctgaagaggtctgctgaaggtgagggtcaccgaagccagaagccaaagctgttaggagacccaaaggacccacggtgatgccaggaattggaatggagagaggaaaaggtctggggtgagggaacagcgggaggtcagtcaatggaagcagggtcgtgactcgggaaggtttgcactggggcagtggctaaggacaaggggacaaatgaccctgtaactctgagcatgttcctcctctgttcagcattcatcaaaactctctattacccactggagaatgcccaaacatctcagccctgtcctgcacaatacatcttaacagcctcatctcccactccactctcccccagacccattgaaccacttgaggtttcctgaacatgctatgctgtccataccactctccgtttgcacacagcactcctcccatctgaaatatctgtctcttcttccctcccttgcaagaacccctacttatcctttatgatctgttcaaatatcactcctctgtaaaccttttctcaagtgccccggccattcagggagccaatatttactgaacacctatcacatgccaggctctgagcaaggcacatatttatctactctctcccctgtgctgctccatgcaaacgtcccaggcctgccagcgagtggtgtctggccctgtgccagaactcccagacttggctcaataatcactaaatgtgagaaccagtctccattggaatctcatcaacaggaagggctgggcaggtttcttctcatttccttgccttagctcccacctcagcagcttctgtggctataaacaacaaaggacacctagtgtgggagcttccctggtctgtgaaacagtgttcttgattcatggggacattgtgatcagcttttactgcagtgcattttccatattttgacttatggatacctcagtgcatggcctatttgtatctgggcaccagatgatttttccccaagagtcatttgctttgctgtaagcagaatggaagtaactgagagaatctctttgggggatattcctcttagagtagagacatatgtaaggtggcaaaagcactcagtcaggggctgatatttagtaaacaaatatttcatgagatgagtgctgggccaggatatgagctaggcactgaaggacaaagatgaacttggtcccagccctctggaatgtcagagctgctgttcaacctgcagtggagctgtttccctcaccctcctcttggcattgacactctcactcatctttcagcttcagcctaagcctccccttctctggaaagtcttccatggggccagcagctatgacaagttgtctatccaatacctttttcccttcttccttataaataaactctggttatatggtatattttgagtagtattgtatatagttgatgaatttcatttctcaatctccctgtcattgaaatgcaagaagttgggtgatgtttctgacaaagtgccttaaaaggaaatgattcagctgaaaggtgccccctatttgccctcactcacttactcccttttcatttctggacctcagatgtgatacctggagctcttgcagacaccttgaaccataaggcaatcttgccaatgtaagacacactaacaatggcagagaagaaatatagagggtgcttgatgatcttgaaactactctaaaagtcctggactgtctacctctggatttctccatgtcagagaaacaaacaaaccttatattatgccacctttatttttgttgcctgtcctgtgcaattaaacctgatcctaaccaaaacaacccctaggctgctttactcctttatcctgatttttttttttggtagcccttactactatctaacatttttattggtctctgttgcccattagaatataagctccatgagaatagtgatttctcatgacctagaatagtgcctggcatgcaatacaacctcattaaaaagttgcagcacttgttattgttatacacacccagcacatttcttctgtacagtcatcatactaatcacacttgcaaccacgcagttaacatctgccttccccaccaggctgtatacatcatattgacagggaatatatatacacacacatatatatatatacacacatacatatatatatacacacatatacacgctatatatatatacacacatatatagtgtctatatatatatatacatacacacatatatagtgtctatatatatatacacacacatatatactgtgtatatatatagtgtgtgtgtatgtgtgtcttgctctgtgttgtatcatcagcatctagcttaatgccattacataaagaatccatagaaatgctataagtggagaaaatattaatttgctgaattgtgggcaggaggaggtggctgaggaggtaagggtggtctgacagcagtctctgtgagaggagcagtccaagtgggggcgggaggtgagaactggaatatgtcttccagggagctggaggaaagagggtctcttgggaggatcctgggatggaaactgtccaggcttctggaaagaggtgaagtgagaaagatggcagctacctgatgagattgttccctgcaaccagttctccatcttaaattactaaatgcatgaaattcctgatcttattaggtgagttgttgaaaatattgaagacatggggtaatgggtgctgtgtgttgtaacaggagcagcgcatttgaacacaggagaggaaatgcagataaacaggatggcgtaggccatggcaatcacagaaattctgtgagagactcctgactgctggagtgtctgaaatgaatggttatggacaagtagacatcatttcccattgttatggcttgaattgtgtcccccggcccctgcaaaaaaaatgtcgaagtactaatcttcagtacctcagaatgtgaccttatttgggaataggatctttacagaggtagttaccttaaaagaaagtcattgagatgggccctaacccagtgtgaccaatgtccttataaaaggggaaatttgtgggaacaaattgtgaggacagaagaaaaaaattttttaaaaaagggaaatttggagaccaggtgcagttgctcatacctgtaatcccagcactctgggaggccgaggcaggtggatcacttgaggtcagcagttcaagaccagcctggccaacatggggaaaccctgtctctataaaaatacaaaaattaactgggaatgatggtgggtgcctgtaatcccagctactcgggaggctgaggtgggagaatcacttgaacccaggaggcggaggttgtagtgagccaaaattgcaccactgctactccagcctgggcaacatagtgagactccatctaaaaaaaatgtgggcaaagagataggcacagaggagagatgatgtgaagatgcacagggagaggacagctatgtgacaggagtagtgtctgcataaccaaggaacatcaggaactgccagcagacagcaaagcctgggagagacaaggcaggatcctccccttgagctgtcagagcatggcccagcgacacctggcctccggaactgtgagacaatacatttctgttgttgtaatccacccaatttgtggtgctttgttacggcagccctagggagctcatagacccatgaagtatgtaggcccagctgacatctgttacaaaacttaattaaattgaactgaattagtgttgcttcctttttagtggaatgatagaaagctgtcccagggcaatggcagcataaagtaagtgggcctaactctgcctaagaatatcaggtgggttttacagagggggtgtcatgaaacaaagtcttaatggctaagtagatggtcactgaataggtaaagagaaaaggaagcctgggctgaggaaacagacaggaaaggacatgggaggaaacaggtcataggtgtgttcagaaaatgactagtgctttttacggttgagtgtaagttcccttcaggggaacagcagagaaaacactgcaggggacagcttgctcaggttatgaaaagcccatatttctagctaaagagtttggatagtgtccttcagacaatacagagtgattgaaggattttaggtatcagaattctattatttcatctgtgttctagaataccaaccagtggcagagtggaggatggtctggaaggatggattatagtcaggagactgattggtgaaatagtccagtgtgataataataataataatagctaatattcaattagcattttattgtctatgtctacatctactttctgatagccttgtcagtgctcacccaaagcctgaaaaataaccattaatgataattatccaggccttagagttgggaaaagcagacacctgcagtctagatagacacatacatttcacagtgaggacaaaagggtagcaggcaagtgcatggattctggtgcagactgtctcagtctaaatggggcaattccacttcctagctgggtgaccttggacaagtgatttaactctggtctcagccttttgattcatacatgaggctaaagacaataattactccttggtttgttgcaaggataagatgagtgtgcaaagtgaacagaaaaatgcctgttgtataacgtgctatttgactgctattattaagaagtgttttgagaaggcatttccagggatatagaaccatagatgatggtattactcactccccctggtgggatttggaaaaggagaggggatgggaccgaaaagatgtatgggagcctgctgggcagcaaagaggagggaaggcattcctgacacggggaacagagtgtgcaaaggcatggagaaatgaagaaatgaagacaactgcattttaagggaggatggagagtttgaagcatagggtttgcctggaacaggtcgtgatgtaagtgtgataggctggggccaaagctgacgatcctagagttgaagatgtgtgtaacaatatcagatctgtcctgtgttggccatgtgtggagggaagagacaatgggcagaaagacctagaaggaggtaaacaatgaattggggccagaactagaattataaacagggtttgtaaatatgaagagtaagaaacagatgtgagcagcatttctgatttggaatggaccaaatttgatgcctgtatgtgggaagtgagaaaataagaattgaggaggagtaaaagatgacaggtaccattcatttagacaaataattcagagggatgcctagacttcagctgggctttgcacatgctggatataaggcgcttttcagacatccactttggtggaggagtgcagaagacagttgcaaaaatcagtttggagtctggaaagccaagtgggagcatgatgctgactggggacccatcggcatgtaaacactggctgaagctgtggaattggcagagcttgtctaggaatgtgtacgatgagaagaggagacggagcaaacctcctgcaacaagtcatggtttcttaatttggctcattcagcaaaatctacatccagattaacaatgtggaactcagcaaatattctctttacttttagcgcactgaagaatgagctgaagatgaaataagtttgagttttgaataggagtggttcaggaaccaagacctgatattaaagggaatgaatagaaatgaatgatcattataatacatttaataacttaatatacttaataacacctggcatttatagaccacttttctccaaaggaactggaatctctccccagacactatgaatctttagagaaagtttgggaggtctgtaagaggcaagggagatcatattaacttgtggcacgcagaaaaaatggggctctcagaagaccaggaaattctgtttaagaacagagcaaagagtgttttgtgactgaacaaccattgctctaagcaccttccttgtggccaacagtctgacctaccttcttgtctagatctgataacacaatcttgtgcacttatgatgttgcaaaatcctcaatctcaaatcctgtctcaaaccatcccaagtatatgggcttcatacattccagaagaggactctattgcaacaagatatgccctagtgcagaaagtagagtatttagaaccacacccacctgggacaagggccacagctgctatttactagctgtgtgatgctgggctatttattttatgtctctgggtctcagtttccccaacctcaaagtgaagataacacttcctacttcagggttgtatgaagtgcagtcaaaaaacatttattgagctatgtgcctagcattgtttaaatttcttgggttatactggaaaacaaaacagagatccttacccttgggctcttacctttcaaggaggtaagaggtgggagggaaggaaagatggatggtaaacaatgaaataatagaccaaagaatctgctgtgttgggagactatgttagagttctgagaaaaggatagattgggtatgtttgtcactgagcaccctgtctagctagcacatagtaggcattcccagaattggtgccactattattgcaactaaggaaagagtgaatgaagtgcctgaggcagaatgataggctgtaaatttttatgaaaatgtgtctatctcttaaacttcaattaggagtaagcagaaaagttgccaaggagggataacagtagaagattacaaagtgaaaaaaaagacctgaaatgcttttaagtaatgtgtaatcagttgcatctattctagtgaccaccaattaagctgtctcatgcaagctcacagagaaaatcacttgcccaaacaggtagactatgaaacgcacattataagaccttcagcattaaactcatgagtttcattttttaccataactcagggagcagtttagaaagttagcctattttattctaacaagcatcctctacaagcgaccacttaaaacccatatatttttagctgtattttaattaaaaagtcgacattatatcaatgacattttcttttctttttttttgttgagatggagtctagctctgtcacccaggctggagtgcagtggcacgatcttggctcactgcaacttctgcctcccaggctcaggccgttctcctgcctcagtctctggagtggctgggattacaggcgcatgccaccacgcctggctaatttttgtattttagtagagacagggtttcgccaggttgcccaggctggtcttgaactcctgacctcaggtggtccacctacctcagcctcccaaaatgctgggattataggggtgagccaccgtgcctggccaacattttctactacatttcgttcatgatgccatcttcagttggcttgaagggtcaccatcaaaggtttcggtcgttcatttattagtttgcctaacaaacatttataaagttaataataaaaatgaaagttaaaaattcttcaacataaacccgttaccatgtcaaatatttatgtgcaatgccaaatttaatattctcaacaaccctgagaggtggataccttttagataagaaaagtgaggcttagagagattaagtaagttcacatgatcaaataggttaaaaaaaaaaaaggcaaagtcaggatttaaacccaagtctgactggccactgagaactcatagttgactactgttatatatgacagacctcatgctaaagggtaaggtatggttatggtcttggaggacctagttattcaacagggagacatacaagtaagcaaataattatgagacagtatggcaagtgctaacctaaacatactaggcatactctgggaaccaagaaaaaaaatatttgcctactcagattgattgcattggagaaatgtttccagaagtgattcttaaggtgggtgttgatggataagtaggagtttgtctgaaagcaaagggcgggtcatgaaggaaagagcatattgagcaagttttctctggctctaaagcccatgcttttacacacgatgcgaaactacctccatacatcccacgattagtcagacggtcactgaatattctgtagtacgctcaggtcttttagggaaccaaaaagaaaagaaagaaattactcgagttaatatctataatcaacccagagaattcaggtcttactcatgcatattctccttgtacatgtttgcccccaaggattttgaaatgagtcacttatctgaactctgcccaatgagacaaccagctctgacaggcagagttcacagggcactggggacctggctgtgtatcccagaaactgatcacagtgggctctcaccctgaagctcctcagtgagtacctggtacactctagacacaaaaagtaaacgacagggagcagtttaagatagggttgatgcagcaatctcagaacaagtggtcaacgggaacatggtgaaattggtttggtttttggacttgtagttgtgtatgataagagaaagaatgatttcaatggcgactgtgtagcattgtcccgctaaaaggatagctttgtaggaaagagtttttctgttctctgagaaatgaaaatgtgtttgcatttctgttgaatcatggcagagataggctcagctgtagatattcctgtactaaaggctataattacaatgggagcccttacataatgcttattgcaattgggcttgagatttgaaagctgaacaagggaaatataacgtctcacacagaggtaggaacatggttggtagacaacggttatttgctaaatcaaataactaaaatattaagtattagaaaagtcaaatgaatagataaatttatttgattttcctttggtgtggacattttaattaaaagtatgggttatttatgattccaaagaaaaagaatcaagcactgaagcaagaggaatagcatgtacagtggccctgggcaggggaacatatgaggtccctagggaaatgcaaatattccagagtggagtgcaggagtggagggggagatggattccgccacattaggctggagaaggtgagaggtccagactcgtgattaaggagttgagaacaatgggagtattaacgcgttttaggtagaaatgatttatgtcttcagaggactcctctggatgctatgtgagaaaggattgcagggagcaacagtgaattccaggacagctggccacagaattcctgaaggtttctcagtaagagggggatgaacaagggggtggcagggacatgggcagatgggacggattagagactgggcaagtaaaactggcaaggctggagggaaagagagaaatcatcatcaactcctggaattttcacttgatcacctgggcaagggtggtggcacatccggagatgggaaagagcagaagcagaaggtgagaacatctggaggagaggatcaagaggttggttttggacctagtaggttttggattgctggggtgacatccaaatggagatttcaggcataaaatatggagtatggggcccattggaatggtttagggatacaaattcaaaagagatcgcgtgtgtgtgtgtgtgtgtgtgtgtgtgtgtgtgagatactaaacagaaatagatcataggctcctactatacagcaatctgttttcttggtctaaaatatttcttgtgcacatttctttgataacctatatagaattcccttatgttttaaatggctgaatggtattccattgtgtagatatgccatgttttaattaaaaattttacattatgaaatattagaaaaatagataagtacaggatgtataacagatatccttacacctaacagctagatttaatagatgttaacattttcacttatcagtctcggttctccttattttgggtttagaaaactaatagttcagatacaggtaaactcctgctcccatccctctcattctttttcttcaccccccgccccttatcctttttcagagctaactaattatcctaaaggtggtgtgcatgttttctgggcatggtttcgtactttccaatatgtgtttgcttctgtaagtaatatatagtacagtgttactttaaaattcacatacatggcttcatatagttacatatcctcttgtaatccattgttttcactcagtattgtatttatgatgtttatccatctttaaaaacaaagtcctccaggctgggcgtggtgactcacgcctgtaatcccagcattttgggaggccgaggcgggcggatcacgaggtcaggagattgcgaccatcctggctaacacggtgaaaccccgtctctactaaaaatacaaaaaattagccgggcgtggtggcgggagcctgtagtcccagctgctcgggaggctgaggcaggagactggcgtgaacccgggaggaggagcttgcagtgagccgagatcgcgccactgcactccagcctgggtgacagagcgagactccgtctcaaaaaaaaaaagtcctctattgatggacactgtaattctgtttttaatctgcatattccaaaataaatacaaggtggtttaacatgggtacaacctcagggacataatcctgaaactgctctttaaccatgtgccatccatgaacaatggcatgaaaatcacatgtttatttcctgagcctaacactggagctccagtgttggatactaatcagagacacccgcagcagctgctgcaggctgagcaggtgttatgtaatgaaatattctggtaagaatgccctagaagttgctttgtcatcacatcagctcaggacaggaaagaagctgtggattgagacgcagagaatagggcctaggctatttcttctgggatgggagtcaacagagctgttccctagcattgccctactcttaatcttggccctttcgtattttccttaattgctcaactctgaagctggccagccagctcttacaccaaacactcactctatacctgagagactttttttttcttctcctcttccttcttatttctttttctttttaacgtacacccagcacctcccagctataaagaaaaactgaatactttcagtctcaaacaaagctttatagatttgttggcaggaaatctagagtggaatttgctattaaatcttagtaaagcaattcttcaaacaacatgtacagaacaatcaaacacttttagatgtcaatccccaacaaaagcatgcattgtccctgaagaacacccagtggccctaactttcttagagtgagaagagtttacaaaaatgtaacttatttcatatctcaggttgtctgctgaatggactcttccacaatccatcaagagtaaggcttcctgatagcacatttcagctcaagtagctccataatggatgggtttttctcctcttaggtaaaaacagaagcatttttacaaattgaaaagtaagtttgtaatgatgacaaagtcaagtagcaggtgtagtattgctcgaattttcaagccttctggaatataatatttaatatttgttgagtacttatcatgtatcaagcactgttatctcatttaagcctcacaacagccctttgagatagatattgtcaccatctccactttccccataagggaactgggacctcacagagctaatgaaatgttaaggtcacagagcttgtaagagagggcagcaggttttaagttcaaggagtaggacttcaaagcccatattccgaattactgtactgatttgatgaattctgaaaaagctttcaacttttcagcatgataggaaaaaggaccaatgaatactgagtacctactaggagccaatattgcacacatgctctcttatttaaatctctcaacatgtttatgaggataatgttctcttctctaatttatgtatgagggggtggagtctacaagaaaggtaataggtggttggctgacaagctgaacccaggtgcagtaggaagagccagaccatcctatctcctggaaagggattgagcacatagaagttccttgataatgctttaggttttacaggtcttctctcattcttgctccatctttgtaatgtaaaaaatgtgcatgtgattcagtgggagaatgtctggctctttgaaattataaatttgtttacatcagaaaagtattaacttatgacccaaatgtaagagcctgcaagtaaatcaaaatgtcttattatgaaaggtaataaaagaagagacaagctggtggaaaagaccttctgtgacctgaggttttctccactgcaaccattcatagctttttctgtcacctccatgccattggaggcacacgtgatgtgtatgggcaggatagacgttacacatatgagcctatgcaaaatgatcctgctcccacctgaaccccaccctcctaaaaatgaaaacttttatttcccttactttagatattctttagaattttctcacatatccccaaacatacacattaggaggtctcctgatgggttatttgatacacgaaccaaagttagcagcaaaacaagagaccgggtgaaactatgtgattgggtatgacgcaagggtgtgggagctgctggcctttgatgttgtgatgtcaggctccagtgcatgttacgagggaggcaaaatcctcacctttgttttctttaggctctagagcagttgtcaggggaactgtgttttgatgaactcaacctgactcctgctgaggttggggtgaactctcctttggaggaggtccccaaggtcaccaccatagccctgcagcatcctctgtcaacaagcaaggggagccaatgtgttattgttctttcagtctccatggctggcctggaattcaggaggagaaatgggaaaggaggggtggaggagaaaaggatttgttccagctctagagctggctagtaaacatcgctagaaatgcaaacagagggagtttttgcaatgaagagtgacttcactacttttaaaggtatatgcagtatatccacatacaaatattcagagatagaagcagacccttaatgtctgtcctgctggggacacaacgccctcagctgcatccaagccccttcagctccaagaagggtacttggtgtcaggtgactcaggacagcctcttttaaagaatacagagcccaggaatacacttgacatatattctctgaggtgttaacactggcagcgagttacactccacattttcatctatccctcacacaattgctgaatacaaaatactcttgaattcaagcagagaagtcttgttgagggccttgagcagactgaaagcaacagaaaggcaaggcatttggacagcacgtaaaagctgagctgacccaattctaaaattctaattttgccaagtatagatttaagccttcccctttcccatgtaggtgcatggttatttaacacacagaaattttaaagtaaccgcatttaagaccctttcactccttgggaggcgagagtttctactttttaaaatctaacatacagattaaaaaatccaattctatggaattaggaaatcagacttttcaggattcaaagaggactccacctggacattgtttgaaaaaactccgaattcccatagggagaacttaagtgccttccagaagtcctgggagactccaggcaccaagcaagacaatgtctggcccctgggctgtgttttataagtgtttacaaagctgtgaacctacagagaggcagatgccattcaaggggtaaggccagggcagttcacactttatttccattatcccagagagttctctcaagggcaggaggagcatttcttatttatcgctctatcttctcctcaagagtgtcaggtgcacagtcagatgcacgtaattgttttcaaatgaattaaaaagtactcttaatttgattattgtaatttcacaaacacagttgctgtaccctagaaaaggacagggcaaccatctgagcccactgatcaatctcagcatcacttgctaagatactattcaccttacaaaggaggaaatgggctcagagtgggacgctcagcactgctgcctctgctgcagtcccttgtgaagcacacagcaccaccttgaagaatcagtgccaaaataactgaagctgatcacatgtttaaagccaacttctagttgacaggaattacaggggagagagaacaagtgcaatttcaccataaggaaccaaataaactaacccaaaatgtgggactttctacaggacaatggacctggttctaacctaagcattggctttaaaaaataagggagtggcttgagaaactacattacctaaaatgatttaagagacataacaaccaaatgcagtgtgtggatctgaaattgtgattcaaacatgccaactgttgaaaggaaggaaggaaggaaggaaggaaggaggaaggaaggaaggaaagaaagaaggaaaggaagaaaggaagggaggggagaaaaaaaagtaagccaactagagaaatttgaatatgaatttggcattaggtgataccaagagattgttacgtttgtctgatgtaaaaacagtcccatggttgtgtgaaaaaaaatgcccattttaaaaagatgcaaagtcgagagtgaaataatagtaaattaggaaattgcattaaacatatatagatgaagacaaaatggcaaaatcttgctaactgttgtatacattgatttagtgtaagtttctctattgggtcactatacaattatactagtataattgtatgtttacaatttttcactattaaaattttgaaaagtttttaaaaacacaaaacatatataggccaggcgtggtggcttatgcctgtaatctcagcgctttgggaggccgaggcgggtggatcacctgaggtcaggagtttgagaccagcctgaccaacatggtgaaaccccatctctactaaaaatgcaaatattggccggatgtggtggtgggtgcctataatcctggccactcgggaggctgaagcaggagaatcacttgaacccagggggcagagattgcagtgagccgaggtcgtgccacttcacttcagcctgggtgaaaatgcaaaactctttctcaaaacaaacaaacaaacaaacaaacaaaaaacagaatatatatagcaaagtgttcagtttcttgatctcgctactctcctttctagttgcagtaaaatttaggcacctcagctctaccatgcttttgctatcatgccaaaactggatggtgagttccacttgctcggagtgataatttgctagtctttaagactatcctttaatctcttgccttacatattttcaatcaggtctgaaaatagtaagaagactttacatctcctaaccatggtgcaaagcatggtcaggtttggccagggagaggtaggaagaaggagggagactctgtgggagggagcaggcagaagggcgagcagaatgccaggttccctcccctctgaagctgacagaaggtcctctaggcagtgtcctggaggcttgcttagaagctagcctcagaggggagaaataatggcaacaaaactaaaccaaaaacagcatgaggtagctataagatagtgaaaagccattactgttggaatgagctgttgggccggatgacttaacctctctcagcttccgttcctttccctgtcaagctgcgatgacaatactctcttccagtgtagctgtgaggagtcgatgaggtgacactggtgaaaattcccagcactgggctggatacctaacagctactcagtgaagataaattggatctcaattgagaaaacaaatatttattaagcaggtattatgtgtcaagcattattataggtagtatagacgaagagcatgaagatgaacaaaatagggttattgcctttaagaaactcttatttttgtacatatttgggagtggtggcagaatgagcaaggatatggaaataagctaaaaaatgaactagcatttgttgagaccctgctgcatgatagtcattctgctctatgttttgcctatgttagctcactttatcctcacaggaacatgccaaggtattgttcacttcacagaggaggaaacaggctcagagaagctcactacatttgccaagatcaggatataaagtctcctcaaacccccaagctactctccccctccctacattctggatcctatggatccaaaaatgtgcaataaaaataaaatcctaagttccttaaccttctaagcagacccccactggccaaagagaccccagaaaaactttgaaaactgttcctaaccgtgacaagaagggaggcccattgtgtctcaatgcctctttccttgctaaccattaccagaatttttttcctaagagttaaacagaagccagccctggaaaagaaagaagggaagactcatccctccactgacttcaaccaaccgcctgacaccatggctagattcccctccctttttgcaattttgacatgacagctaaccagctaacaaagtattccttcctgatccgtgaccatcgagtggttctggccagtttactgagggtgcacacgaactgcctttgtgtcctgtgtttctccttttgacatacagagcctagttttactgcatcttaaggttgtctccaccccttagtgaacatgggacatatgttacatgtgtgtttgcttatcgcacatgtgcctaccctctttcatgaatattcatagctcttcctataacctgttaaatccgtgtgttatttaataacatacatattaatgaaactcctgccccagccattcctctctagaagtatctgcttttggtctcagccagaccctgcttcccagcctgcagattgcaatccttcataagaaagctctcctttccaaatgtataaatctcatgattttaagcagacagaagctagctgactggaacttcctcattttagcacagccaaataacagattcgtctataccagcatctatcctgtttctttccttctggcactataaaggaagtgtgcttcttggtatcacttggattctggatcctgtaacttttcttggaccttgctgtgtggattatcttctctcgactcctgcatgtccaaccaagacttttccactgaatccttcccatcaggcattcgactctctaggtctccaatattagaaaaacctccagccccacatgactctccagctgtcattccatcactcttcttcccttcacatggaagctccttgaaagagttgtctacaccacaaaggtatccatctccttcctcacttcccgttcctctgacctagtccaatttacttcctgtctatacttctccaataaaattgcttttgccaaggtcacaaatggccttcatgcttcctgatccatcattttgtgtatgtgtgtgttttatttctttatttttttaaaattgctttttacagagtaatgttttcctgctaaatgttgttgttacccaaatatttaaataaagaacaaacttttaaaaccatcttgattgagatatgttacataccgtaagattcacccatttaatgtgtacaattcagtggcttttagtctatcacagaattgtgtaaccatcaccacaacctaagtttagaatatttttctcacctccaaccccaaacacttacccattaacaatcactccccttgtcccctagtcctatgcaagcactaatctacttcctgtccctatatatttgcctgttccggacatgtcatataaattgagtcacataatgtgtgacactttgtggctggtttctttcacttagagcattaggaaatcatgttttcaagggtcgtccatgttgtagtgtgtgtcagtacttcattcttttctatggccaaataattcacacccgttgaatggatatagcatgttttgtttatctggtcatcatttgatggacatttgcctattatccaccttcagcttttatgagtaatgctgttattaatattcaggtacaagtttttgtgtggatttagattttcacttctcttgagtataggtgtaggaacagaatttctgagtcacatggtaactctatgtttacaatttgaggaactacaagaccgtttggcaaaatagtacggctgcaccattttattttaaattttcttttttttttttttgagacggagtctcactctgtcaccccggctggagtgcagtggcatgatcttgcaacctgcgcctcccaggttcaagcgattctcctgcctcagccgcctgagtagctaggattacaggtgcccgccaccacgccgggctaatttttgtatctgtagtagagacagggtttcaccatgttggtgaggctggtctcgatctcctgacctcgtgatccacccaccttggcctcccaaagtgctgggattacaggcgtgagccaccgcgccgggccggctgcatcattttaaattacaccagcagtgtatgagagtttccgtttctgcacatcctgcctaacacttgttattgtctacctttggtctttatccacagcttttctttgtcttttataaaattgacatatttaaagaatacagctgttttcccgtttgtgttaatagaatggtcttcattttagatttctgatgtttcttcatgattacattcaggttgtacatttctggcaagaacgctgcctagatgtgtccttctcagggtatcacatctggttgctcatgacatccatctgtccctctcgatgatattgatttcaatcactcagttgaggtgttgttcaatgtctccactttataatggctatttttttccttccttgcaactaattactaggctggtgcaaaagtaattgcattttttgctgttatatcctttcaatggcaaaaaccacaattactttttaaaattatttatttatttattttttattttactttaagttccaggatacatgtgcagaacgtgcaggtttgttacatagctatacatgtgccatggtggtttgctgcacctatcaacttgtcatctaggttttaagccccacatgcattaggtatttgtgcaaatgctctccctcccctcctcccaccctctgacaagctccggtgtgtgatgttccccaacctgtgtccatgtgttctccttgtccaactcccacttatgagtgagaacacaaaaacctcaattacttttgcaccaacctaataacagtctctgggaaacaaagatagttcaaaatattctgctcctagtcaaaattcccctctagatttagctttcatttgatggtccttgcctaattctatctttactatgatgtttgtaaagtgatcattttccagctatagcccttcctgcacatttattagctggtccttggcagttgactgtaagcaagagctctcccttctccacttatttattcattattggtgaggattcatgaattcctgttgttgttttttttccgatgagttgtaattcattactatacttaatggatttggttggtgggagtcactctgactcctgcatccttgtgacatgttccaatctttccctctctttgtctctctctctcttgtccttacttcctgacataataaggtgttctaggttcatcttgcccctaccccacctcaactctggaaccagccatttctctaagggtctggttccttttactggggaatggtattagataccaagatctgggcgctaagtgtgctcattgctactggtgtgtttttgctttttgatgctttcagtagacagagctaggaaatatatgcacttaaaatatgtatattcacacacatacacatgttttagaaatcatgagtttatctccatttccacccccattggattctttcttgctttcttccaattcatatttgcatgctccttcttccacagtgaaaccctaaaccttaacaacatcaatatgctgttcactcctttctcaatcctgtaatacatatacactcatttcagaattgtttcacctattccattacaataaacaaacttactaaaataaattctggatttgtttgtaattcttaaaattcataaaagtgttagtggtcaatagtgagaaatctaagaaaataccctggagactcagaaaccctgattaaaatctgttataagcctaaaatccaagttcaatcctcagttcagggttgacctttggatattttcttcctagggtggaaggcagtggtagtttcctgagagcagctttaattgaagacacgtctgcaatccactgtgtgatcctagaactcgttcaaataggcatttacgctcaatatatcttgagtttggtcttgctggagcatgccacagacagcacaaccaccagccacattttattaagctagactgcgccagactgatcacagtggtggatctacctggcaatccaaggaaccatctcctctttctctcaggcgagactgaactctgcttaccttcctctctcttcaaaaaatgcaatagaagtatcaaaaactgtcttaaactgggcccagaccaatctggttataagcttaatactccctcacccaaattatttcgtgattcctagttcacattttttgattcaccttgtgtactgcaaatccccctatgtttgttgacttctagtcttgatgccagaaatgcttagcaatgaagaaaggactttgagctgtgaaactgaagaggagaatctcccaatctggataagagattgttaatgagattgaatgttcaggaacatgataaattcctttcatggggcctgataaatttctctcttcttttcccactcatgttaatgtatcagttgagggctaggcacagaagtcaagcagatggggctcaacatatctttagagggagtacagggtacatgttatgttgcactacccaagtcccctttaggaaatgagggaatcattctcccagccgcagggagtactcccagaagatcaccctcagctgacagccgtctctgggctggggattgttttggctgaagaaaactgtctcatccagggtcacaccttccagaggcagcctacatccagtgagtcattcaacttggaggtataaaggtccagcccactctctccaatttgggacatgtctgtggagtttctgaggcctttgctgggactgcattgctttgttggactctccctctgaccagtctgctttcttcttctctcttccacaggtattaatccctagagaactctcttacaaatttcctaaacgctaatgtcagaatttgccttccaaaggatccagcctaagatgtgtccagttcaggaaagtgtcctgaaacattacattcagctgagttgtgggcactgagagagagaaacgcaaacagagagtacttatgattccagggatcaacttaagtgaagacccagacgacttaaagactcaacaccaaaactttgaaaaccttgcctgtctcatctggggcctgacacagtctttgttgaatgaattaataatgataggtgagctttttctatttatttcagattgcaggttgcatttgtttatttgtttacaacaaaagtgcatgaacaaatcataccaagcaggaataataatagctatcatttattgagctcttactttgtgccaagcactttgtgtatactgtcttatttatttctcataatgatcctgtgaggcagatactattgttattctaattttatagataagaaaactgaggtttaactaagttaagatgcttgctacagtcaaagagccagtgaaactcttggccacacatactagactccctggggacaaagaacctcaaaggagcaccgctgagagctgctggagcccagagggggttgcgccctctctgccagatgtccatggatgcctggccctttggatggttctgcctcatgcagcttgaggctaggagagctgagaccaggctacggtttggcttctgcctctttatttcggggaatggcatgaagatcaaagtgctcagctgctggtgagagagccatagttccaaagctgtagatagttgcctctgctcaaatgaagggaaacttgatagacgagtttttcctgcctttggcaaagaaggtgccagcacaagggtaatatttaaagatcacacagggatttttttttttccaggagattgtgtattgaaaaagggtgtggggttggcgaggtgtaaggggaggcctttaacaaaaaaagaagcttgtacataggttcctttgctggtgggattttgtgcacagaagatgcaacatgcctcttgtttttttctgctcatcaactcaatcatctgttccacccatgtctattgggtgcctactacatgtcaggcacagttcaagacactgggatgtagcattctagattgtagctttcatggagctcatatgctactgcggggaggataggcctgcctgtgcagagagctgggttgcaatcttgtagtattttctcatgacaatatcgagtgctcagaattgctagcactaagcacatgggtaagcgcacaagtgtaacaatgggtttcatctacgtaagcagagggaattacagaactaagcaggaaagtccatggagtgcacaaatgggtgattgtaaatccccttgatgcatctggcaggacacttaacagtggggtgcaggaacgatttagagtaaaaccttatgaataacggggatgggggagccaaggcagccagcctagaagttgtcctattcccatcagcagttaaagagggctataaaggccatctctttcagcatgatgaagagcagaggttttctaaccttactagctaggtttactagcagcaggcactggaccaagtggattttcactggaggagaaatacagcctacacattacatttgttgtgcaattagaaacaagaacagtaaaggtcagagttaggaagatgaagactttgcaggaggaaggaccgagagagctcactgactattactgcttcagacctgatacaatgacaggatgtgccctgtgaaggatcctggtggcacgtgacccagcacagcatgcaggagatccatggatgaatcacaaggataactgaagaagagattgcagaacagattcagggaagagaatgtcaaaggccttttgtcttgtcctagtggaaaggggcaggtagtgaaccccaggcccatgtggttgttttcattgtgtactattttttccctacaataagtatatttatgcttcacagtttgaaacatgtgtatgggtcatcatatattgtggactctttatttttaaacaagtctttttgctgacatgcctataagtattgaccaggaggggacgtgagtgggcatatcccctctccatggaagttgcctggtgcccaccatgggcagactagctgagctaccacttagagggcgggtctgaccaagagttaggaatccaccatcgtggttcgctctttgaatttcctcctgtgttttctacagttgtgaaagctgcagtcagccctatctgtgggaactttaagaaagtgacccatccgaccctgcagcaactttctgcctggtttttctaaactgctaagatttttgacaagtgatttcatggtccttttattcctgtgtgtcagatgcacagtatttactttgtactatgatttggatatgcagagaaaacatactttactttttctccacctaatataaccttcctttaaagtcctcacccagctggttagcaaagagaaattttgtgttcaaattaaggcttaaatcaatattaaaaccaatattaaagtatatttagattaatctcttttggacaaatggctcaatctttcagataatattcttcttccttctggtatattctcatctggtgtgtccagatatacgtgtgaggggtggtggtggtttctgcaacctcacgagggccatggggaagatttagggtctttgtgcctgtgccctgtgcttcctctggcctctgaagaagtgtaacacatgatctggcccctctcagctggatcagagcctgggagcaccctctggctgactcatcccgaccttggctctctctggcatcagacaactctgatgagattcccatttggctttggcttggctgctccattcagtggccctgggtgctcagatcctccacccttgtcatgtcaagaactcctttgctggactcttgggttctccttcactggaagcaaaggcaactcagcaaagggagccttggagtctgcctctgctttactgtgctggagctaccagggagaggcatctgtctgtcagctcagtgtaggcacctgggaattagcttcctcctcttcatctttactgggttgcagaatagaacctctgcgcttctttgagttctcagatttatctaacacatccgccctcagtcagccaggaggtagcggatgagggcaacagccttgctctcctgcctcccctgtgttccttctatctcctgctattcctggacagattgaatgtggtggtagggaggtgctgaagggaaaggaggtgtcaagcgtggctctcaagcttgtgcttggtccagtcagatggatggtggtgccatttgccaaggtagagaactctggaagagaacaaatatgagaaggtagattatgagtttatgtttttaacatgaagtgttgttgaataaatggatacactagaaaataaaaaccttgagaaaaacaaacatgtaggcctacacacacacacacaccatttgcttccaagaagagttctgtgcgcttacatcttactcttagaaacaccatctactgttgtagcattatggatttttacctccttctgctgtactggaatcagcctccatgacctacatgataaacacattgaaaagctttagcacagaaagatgtgaaaagaaacccagggcatctagtgagaacgggcccacacactgtacaggaagtgattaaccaacacccagcagccacaccagcctcagatggtatcattcactaatcagagattgaagaaaccccagaggtgatgatggtaagtttgggaggtgaaggtggtgggggagctgcgagatggaaggcagaagattaatttaaaactgagaaagagttttcaccagaaaacaactttgctaaaaagaatctgctgacaagcctaagccaatcttttaattcaatctaaattcatcagctgaatgtggtctcttacaattatgctccactctgccactagctaggactacctcctgcatgacccctttgaaatgttgattttcccacacatatgttcattccccttgactcaatgagtctaaactttggacttgattctaaggaatgtatccaacaataggaagaagctgtaggcataatgttcattggcacagtctctatgatataagaacgcccttcatgttaggaatgtgcatccacttcatgaagaacattaactgtgatcattaggaaagctatcctgcagcatggaaaaatgcttggatattccctttattgaaatgccaccatgtggaagcactatgccacatttagatgcaaaactataaatggatacacaagggaataacaaccctagtgcatctatttgttaagtgattggattccctggtatatcagtttattcagatgaagatgaaccatagagatgataagtccctttaaaaggttacacattataagagaactgagatttgaacccaagtttgtctttctataaagcccatgatgtattcagacattcagtcaacaaatatttattgtctttactatgtgccaaaaattgttctaggccatgcactttggatgatattatattccctggaaagaaaagtaaaaatgcagcttttcatattcaaatgcaattttttttttttttagacagggtcttgttctgtcttccaggctgcagtacaagagtacagtgtcatagtcatggatcgctgcagtcttgacctcctgggctcaagaaattctcccaccttggcctccaaagttgcaaggactgcaggagcataccactatgcctgactaattttttaaaaaaatttgtagagatggtgtctcagtatgtttcccaggctggtctcgaactcctgggctcaagccagccttctgcctcagcctcccaaaggactgagattataggcatgagccactgcacctgaaaatcatacaacttcttatcagaggatggcaacaagaagagcaagacttaaatgttttagatgtattttacagtttttagaaattcagtcttgtctactcaccatctgctcataccctacccatcttcaagatttctctcaaactcccttccccatctcctctagctccacctggcctctttctttcctaactccctttgccacacaacacacaccttattagagcttgctgagtactgattgccagtgctagatagctactctgagtactgattgccagcgctagatatctactcttaggtatacattttggtatacactgtcttgctcttcatacatatatatatatatgtatgtatttttctttctttcttttctttccaacaaggctataagcactgccccaatcaattgagagttgttaaggctggaacttctcttagtaataaacttcacagtggtattgccttaccaaaaaatctctatattcaaactagaaaatgtgcaactttttaacattcttcaacccagcagcttcaagcccacagagacttgaaaatcaacaaaggcactttaaaatatctcatttaattatttcaacaacctatgtatacctatgtaatgagctataataacaaccctcaactctcagtgacttatttcttgccaatgctgcatgtaatatttaggtcaatgggggctttgttccatatcatgcccactcagagacccaggtgatagagactttactatctgaaacattcccagtgtctagggtaagaggaagaagtggtgatataattaaagtcttccatagttcattggtgaaagcaaattagatggccatacccgaaatcaaggaagaatggaagtgtaattccaccaattactcaaagaagaagaaccagaaatattcagtgaagagcattaatgagtaccacaatattattgttattattgttctttctctctttttactttgtaaacacaattaaacctcacgtaggttaagtaacttgtccaaggtcaaatatttaaccacagtattagtcaacttgggttgcctaatacaaataatataatataattatataatagtaacatataatacaattatataacaattatattatatatataaataacaaaataccacagactaggtggtttaaaaaacaggcatttattttctggaagaccaagatcaaggtatgagaaaggttgggctctggtgaggcctctcttttttgcttgcagaaagctggcttcttactgggtcctcacatggcctttcctttgtatgtgtgcatgtccagggagttgtggggagagaggtctctgcgtctcttcctcttctttataaggacttcagttttattggatcagcgccccatccttatgacctcatttaaccttaattatctttttaaaggccttatttccaaatacagtcacattggaagtaagggcttcaaagcatgaatttggggagggacataattcagtccataacaccatagaaaagccatgatttgaactgaggtctgtcttatagttgagtctatgctgcttctgctctaccacactgtttctgctttccaggaaagatgtactgcgtactcctcaggttctggccaacctaagttattattcccagtggggctttttgttcactaatctcaatctctgattcagttcatgtgtaccctttccagatattatgcctatttgcctttctattagcctatttattgttcatttcttatttctaaaagaccctactatgttttcttcaaaatagtatgtattggtaataccaagatcaataattcataattataggctttaagggtcccatcttctagaggagcagccagtaaaactagcaaataattccaaaagcaatgtaataagcactataattatgttctgtctagtcagtttttgaaaacaggtatctcccaaatttttgtattctactcatctgacaaagggctaatatccagaatctacagagaactctaacaaatttacaagaaaaaaactaccccatcagaaagtgggcgaaggatatgaacagacacttctcaaaagaagacatttatgcagccaacagacacatcaaaaaatgctcatcatcactgaccatcagagaaatgcaaatcaaaacctcaatgagatactatctcacaccagttagaatgacaatcattaaaaagtcaggaaacaacaggtgctggagaggatgtggagaaatagaaacacttttacactgttggtgggactgtaaactagttcaaccattgtggaagacagtgtggcgattcctcaaggatctagaactagaaataccatttgacccagccatcccattactgggtatatacccaaaggattataaatcatgctgctataaagacacatgcacacgtatgtttattgcggcactattcacaatagcaaagacttggaaccaacccaaatgtccaacaatgacagactggattaagaaaatgtggcacatatacaccatggaatactatgcagccataaaaaatgatgagttcatgtcctttgtagggacatggatgaagctagaaaccatcattctcagcaaactattgcaaggacaaaaaaccaaacacctcatgttctcactcataggtgggaattgaacaatgagaacacttggacacaggaaggggaacatcacacactgaggcctgttgtggggtgggggaaggggggagggatagcattaggagatatacctaatgtaaatgacgagttaatgggtgcagcacaccaacatggcacatgtatacatatgtaacaaacctgcacgttgtgcacatgtatgctagaacttaaagtatatataaaaaaaagaaaagtaaaaaaagaatgaaaagacaagccacagactgggagaaaatatttacacacatatatatatacacatgcatatacacatatatatgtgtatatatatatttatacacatttatatttttatatattatatatcacatgcatatatatatattttaaaatataaatataatatatagaatataaatatatgtgaatatatatttttataatatataatatatatttatattataaaaaaatataaacacacatatatgttaatagatttgtatctacaactgtcaaaacttaataataaaaaaacagttttttacaaggtaagaaattataacagatgcttcaccaaaaaatacgtgtagtgacaaacaagcacatgaaaaaattcattgaacatcttaggaaaatgcaaattaaaaccataatgagataacactacatacctattaaaatggctaaaacaggccaggcatagtggttcatgcctgcaatcccagcattttgggaggcggaggcaggagcatcacttgaggtcaggagctcgagaccagcctgactaacatggtgaaaccctgtctatactaaaaatgcaaacattatctgggcatggtcgtgggcgcctttaatcacagctactcaggaggctaaggtaggagaaccgcttgaacccaggagcaaagtttgaagtgagccaagatcgtggcactgctgcactacagcctggatgacagagactctgtctcaaaaaaaaaaaaaaaaaaaaaaagcctaaaacataaacaaaaaaacaaaaaacctgaccttaataaatgttggtttggtggaaatataaaatggcaggaacatctcctacatgattcagacatgccagtactaagtctttacccaggagaaataaaagcatgtgttcctatagagacttatatgcacgtttgtaacagctttatttgcaacagtcctgaacaagaaatagccccaaagcccaccaactggtaaacagataaacaaaccatgttctattcatacaatggaatactactactcaagactaaaaaaaaaaaatcaatctacaacatggagaaagctcaaaatagttatacttagtgaaaggagatagacaaagtgcataccttttatttcacttatattaaactataggaaatacaaactaatgtacagtgatggaaaacttatcagcttatcagtggttgcttggggatctgggaaaagatgcatggagaagggcgggaaggagggattaacaaaaggtaactggaaacaaacctttgagtaatgtttatttttattatctttattttgatgatggtttcccaggtgtatatttatgtcaaaaaagtcatacactttaaatatgtgcagtttagagtatgtcagttatactttataaagctattatgaaacaatggagaaaaataagtcctattaattatcttaattgttcttccccaaagcatttgcagcctaattatttagcccactactaagtggtcggtgggttaaagaaagaagacatttatttcattcaaatgcttgcaatccagttttggccagaggtgcaatggatagatgaggatgtatacacacaaaacaatgcatcattatctaaagcactgtactgatcacttgtgacatgctgaggtaacaatttatttttacaattgaagttaagatttattctcatatggaattataaaatcgctgctattttctgacagccaacaattgtctgattgttctagcgtgtctttgaaaggaggcatcattctttagctaagtagctgtggaacctgtatgtagctttcctccatcagttaaccaatttctttaccatctactgtgctccagacagagtgatgggcatcagagtcacggcgatgagcagaaaaagctagagttcttcccttcttggagcttgcaatgtcaggactccaagttattgagaggctagcaagtcataagtcccctgggaccctgtggaatacctaggctgaaggtatgatgtaaggagaaggttagattagatcagatcagtgtttttcaaactgtagattgcaacccattagtgggttgtgaagtcagtatagtgggttgtcagtgaagaccagcatttaataaataaataaatggaatacagtatattagagtacattacatacattaagaacaagtgagatatttcaatcgtgtgtgtgtatactaaattgtgaaataaagtaaatttcttactatagattatgatcaaaaaagtttgtaatactggctaaatgaatcactagagccctcagctctactgttttaaagaattctgataatgattcaccccttttaagtagctggggattatatttggaaccattatttctttcattgatttggtcccaaattttcctaacttggattcagcattggtcttttagtgtctatttctactttaatttaacaatgtgaacttcttaaggttaattcttgtgttttatttgtctttttttaaaaaaatattttttgtgtgtaacccagaactttgcacacagaaagttttcaataaataatggattttatttttaagaagtacttttgtttaagtcttcaagtacatatcaagtgcctactatgtgcaggacaaataccttctgctgtgctaggcgtgagaagtactatgaacataaataactgagctaacctttatttgtacctcttcaactgtactttccaaatattcagagattgttcagaatgaaagtccagtcagcctcctgggccacacagcacagctgttgtaccagtgccacgtattcatggttaggtatactatggcctataccgagcaactgggcagtgtctgtcgttttggcaagagaaacccctgccctcaccaccacccatcctccttggcctcctgaaggagtaacagctcccgtttccttttgtgccttgttccttgactcaccttagaatcctcacctggagtcccatcctgatttatctccatagacctctgcaaactaacaatgcccttccttagcctctctggctgccaccagtggaaatcaagagagtgtcctacagcattctcagtgggatgccctcctcccacctctacactgccatcaacaggagtccagagcacaatcgtgagctctacgtgcccctgaaaccccccttctccctaccctggtttatttccaacacttctattttatcgccattgtctgccttgagaccatctcaacaaatctcattcgtccgtttatatcagtcaccacaagagacccaatgctccaggtgactctcatctccacgtggctccaatgttatgttactgatgaggccttcctaacttcactaattaaaaatgcaacccacccctctacaaccctccacacctcctgggccttctctctattttatttttccccatagcacttaccattattgagcatactatgtattacttgttttattgtcttttccactagactagaagctgcatgaaggcaggaagtttggtctgctcatggctgtattcccagtgaacagtgccaagcacatagtcagcactctgcaatgatatgtggaatgaggaatgtatactgtgttaacatttaattgttgagggaggtgtctatgattttcttcttcagaaaaggtggagactccagtttgggaatgtaacctgccactaggtcagtagggtgtctttgaatggctcaggggctgctactgggggaaatatctcacagaatctcagggaccatgtgtcagctgcccctgagcactaagccagatctgccccctcgacctcattctccacaccacaggctggaagacccaagaggctggaatgtccccttggccaaggatgttctccctcagagctgcccctccttccattccccatctcaggaaatgctcagacatgctctgtctgaacactgggactgatctgtgcaagctttctttaatctctcccatcgaatccatccctaagacctgtctcctattccttcccagtacgttctgaatctgaatggttttcatcacttccgccatttccactcagtcccagccaacacatcaccatgcagtagccatagaattactcccctgctgctattctcaactccacagtttattccccatggagcagagatctattcatttgtttacttctcatgttatcaaagaatattttagtgacaggaaattggtggaatgaaatgctagatgaaaagagccagatacaaaatggaataaaaagtaccatcaaaatatgaatatatgtatagaaaaaaaagcctagagggaaacacatgggtattttaagagcagttatctctgagtagtagaattatgaacggattatattttcttccttatactgttcagtattttacaaaaactctacagtgaacacggacagtcattaaaaaaaagtgaataagaaaaatgttgagagaccaaggaagcggtactaatgatgagcaaatttagttgagcagatttaagttttttaacttaaaaatgaaattaaaattggattcaactcacttttactgatcacctcttgcatctcagtcactgtgctatgtgcttttcccgtgctttatttctgcaaggaaggatttttgctggttttgtagataagaaaatgaatttggagagattaaatggtttgtcccaggtctgcagacagttcatcccaggccctttccactcccctaccactgtctggtcttgccccaagggctggcattcaagcagaccccaggagaattcctggggacaggggctgctgagcaaagatggtgggagtgaaattactagctcaataaggggagaaaacagacattcaatgtaaatcaagcgactagagtaccgttttatttatattcaagatgtatttaaagttgaaacttattggcaaagtggatttaataatcacgagtaaaagcagcataaagttaaaccttggcttgttccgctttcttgccctataaaaacaaagccccaagctctggggttgacgcgtctggcaagagctgggctaagttctggcacatctgcagaaagtcccacctactgaggggaaggggagaagaggagggaaaatgagaggggcacttgtaatttcttttggcactccagagagactaatcttttagaaacaaagccccttcccattacgcttaggataacatccacgtgtcaggtccccaaggtctggccctgcctatttcaccaaccccctttcttccctttcggcactttggcactcagccctgtctcacctgcctctccctgtcccagagaacttgcttcttcctcagatctttaccctgcaagctccctctcatttatctgattttagctgaaatatagaaagccttctttgatgacttcatctaagatacccctccctcattccatcacaaacttttatgagcagaactttttattatatagtattgtattcaaagaatatatgtaaagaataggtatgttataacacataatgcaatgaacactatgaacgtgtcagccaactccagatctagaatattaacaatacccgatttattttttgcatagtacttattactatctaaaattatattatgtgtgcatttatatgtatttattttgtcatccctactgaaatgtaagctctgatgtcggtcttgtttattgctatatcccccggagcttagaatagtgcctagaaaacaaatattcacgaatagaagatgaagcagaaaggtcagagcagtgcggggagtggtggtggttggccttttgctgtctccaagcagagatccatgagcccctggacacggctgctccttccccgtgtttcttcaaagtctagttgatgtgctgttgtgtaatgtggagtacaaggtccagttacacagacaaaagcacacaagactcttgccgtttcagactcagtttctgtctctggtaaaatagagacagtaatacctacttgcaggatacctgagttagagatacaaacattctcacctcccttcaccctcatatgaactgaggggcaggaccaatcagtgaaggggtgctgctggcagctgacggcttcagacctggaaagagaaagagagacagacaggctccgggttgcaggagtgaggtcgacagagacccaggccactctgaaaaccatgggggaatatctgtccccacagtagcagatatttaagcctccaactgggtccgtgaggctaggaccaggcccccagagcagtgagatctcctggcctgggcactgcttccctaaaagaggtgggaaatttctcagggaacaaacacatggtctcggtgcatgagtggagaatgttaagtccctgataagagaaatgaaatctcttttctcttcagtgaatcagggacagacttaagtagaatctcggtgtttttctccagtacaagtgccctgattgagccggtctgtccccatattatgtccaaacattcttcaatgcccctctttgcctgataggttaattaattaagtaattcaaccaacattcacaaagcagccaatatgtgtcaggaagcctaacacagactttgggattagaagatccatagatacttgagaggtttccaggccaagaggaaaataagcagatgcacaacagtgacctctgcattagcccgagaagggtagagcccaggggagggaactgccaggttggctgaagctgagggcagagtgggggtgagcaggtgggaaaaggagttgcattgagcctaaaagaagatggagagacagcacaacagtacagactgagctgtggatggtgaaaaataggaactgcgaggacatgtggcaggagggaaagggagtccttttgtggatgtgggctggagccatatcctgaagactttgcttcctatgtcctgaaggcagcagagcagcataaaccgggaggtcagggaagatgttcctgaggaactgacaaatgaggcatgcactgaaggacctgtgggagatggatgggtaaaggagtgggggtggggatctcggcagacagtggggacagcatgatcaaaggccctagtgtaccgtggaacctcttgaaaagcttcatccccgtaggccctcccaaggggtaataggggagggcggggtaagaaaggcagcccaggaattcagtcccaacctcccttggcccttggaagcaagcgtaggacaagtaacagctttgcttctttccttagtacctcagtcctattactcttcctcttcttcccccttatgacaaaccccctgcaagtgttttctgttggagatggcaagaggagcaagggtgttacctagcccacctcaactgctaccctactcagtttgaaagctctgtctgttccccgtttctttcacagaaggaaggcttcaactaggtttattcaattacatctaacttgcgtaaggttatagtgataattcgttgattgtttttcctgatttggatttaagccaagaatttaattttgtgtaaataatagacacatttaaaaagtcagagcccatttaagaaatagactttacatatctcaccaaaaacataagtggcaaaagaaaagaaagataagatgactttatcaaaatttaaaacttctgtgctgtgaacatgtcatcaagaaagtaaaaagacacctcacagaatgcaagaaaatatttgcaaatcataacactgataacagacttatattcaaaatatgtaaagaacttttacaagtcataataaggtaaaggactcaataagaaatggcaaaagacttgaataggcattttggcaaagaaaatgtacaaatggccaataagcacatgcaaagatgtttaatatcattagtcattagagaaatgcaaatcaaaaccataatgagataccacttcacacccactaggatgactctcataaaaaagacataataagaagtgttggtgggggtgtggagaaattggaaccctcataccttgccagtggggatgtaaaatggtacagcagctttgataaacagtgtaacatttccttaaaatgttaaacacagagcaaccatgtgacctagccatttcactcctaggtataaggtgtacccaagagaaataaaaacatacgttcacacagaaacttatacatgaatgttcaaagcagcatcttttgtactagccaaaaaatgggaatagcccgaagtctaccaactgatttcatttatatgaaatgtccagaaaagacaaatatatgaaggcaaagtttcatcatttcctttaatggggagagggggccaatgggaggaaatagagattgactactaatgggcatggggtttcttttaagagagatgaaaatgttctaaaattagattgtggtgatggttatataaccttgtgaatattcagaaaaacccattgaactgtatactttaagtgggcgaattgtatactatgtgaattataccttaataaacctgttagaaaacaaaagaagcaagctaatgacccagagtcgatcaatcaatattgtcagagtctgccatgtaaagtaaatttacccagattcttggcatagtaagcaagtcaggcagaggaaacttcctgaatggaaaagtatggcaataataataataatagtcacattattaacagtaataactcagatcgatatgatctttatggttaacaaacactttcttatttatttgattaaatccttccactcacttgaatcatacgagggaggcatcattacacacatcctgcacctgaaggaactgaggctcagagagtttaagagcaagtgagatcaccagattgtaaatgctaggctgggagtagagccctgcctccaaatctggtgtcactccaccaagcctgagagggcaaggggccatgttcagtcttgtttatgctgatatcccctgtgcctggcaggatgaatgaatagatgaatgagtaggaaactgccactttttgaactctgcaaccaggtaatgcaaagtgggctccagctcctcctagaaaaagagagaccagaaaggacatgttggagaaaatgtgcaccacagggttgcaacatcacaggcactggccaggagctcagtccagatgtaacaccgatttcgatccctgtacagattgaagggaccaagccagggaatatctcagaacagaaggcttcctatttctagctgccttgtgcattgtcctcagccaaccgatgccctactgggatggaactaggggcacccagatcgcctcagccccatctctagactcctgccatcttgaattctttgtcaacatttccaccccagagggaagctgcagccctcaagcctggggacttccaatagccagtttgtgctgaacaggcactatgaagaagctattataggatcccacaaagaagatacagtctcacacagccacaagtgtctactgctggaacttgaaggggacagagatggcttgttttctgtctctatggagggctcgcccttctgcctaacatgctgagttggctgatggttgagtttgataggctgtgtttcacatggtagtggaggaagaagcaaagatgctcttttgctgaggtttccttattcacgggccagaaattatggagccagatgttctggaaggagacttggatttggaaacacaccaacctgagtaaaaaaaccatttctggcatttaccctggtgcctctgtgagcccaagttcctcatctaccaaatgaaaatctcacagggctgtagtgagagaagtaacttacgcaaggcccatagtcagtaaatggacagagcttggacttgaccccaggagtcttgactccgcttccataagggcgcagtgggtaagagatgtgtaaactgcacacagaagcactggtcgtgataactgcagatgcctcctgccaggggtggaggctaggaaggaggaatgggagcagacgaggtttgtgtttcccattggtcagggcagagtgtgcgctccatgcccttaagagagtccatggcctagaagagttcttactttgcagacttggccacaggagaggctgggctctggctctggctgtacaccttaaatgtatatggttcttatttgtcaattataccccagtaaagcagggggtggggaggaagaaaggaatcacctggagatgctgctcaaatgagcattcttcccaagcacatccttggcctggctccttccacagtccttccattttgcaaccattgcagcatttgggccataccaggaagggatgggaagcaaacagtgaccctgttcccccaacgtggtccatctggattctttatgtctaaatcacactttgttcctttggcgattctgtttggaaggccacgtggaactgaatgtcttactttccttctctgggctgttaaccaaggaacaagccacaatattcccttaaactaaagcctaatacagagcaaagttctaaatctcttcaagtctatgaaggctgagagaggtaagaaatctgcagaagaagagtttgaagctagtagaggttggttcatgaggtttagggaaagaagccatctccataacaaaaagtccaaggtgaagcagcaagtgctgatgtagaagccacagtgagttatccagaggatctagttaagatcactgatgaaggtggctatactaaacaacagattttcaatccagatgaaacagcctactgttggaacaagatgccatctaggacttcatagtgagggaagagaagtcaatgcctggcttcaaagcttcaaaggacaggctgactctcttattgaggctaatgaagctggtgactttaaattgaagccaatcctcttttaccattttgaccatcctagggcccttaagaattatgcaaaatctactctacctgtgctctataaatggaacaacaaagcctgaatgacagcacatctgtttatagcatggtttactaaatattttaagcccagctttaagacatactgctcaggaaaaaaaagattcctttccaaatattacttctgattgacagtgcacctggtcacacaagagctctgctcaagatgtacagggagattaatgtaattttcatgcctgctgacaaaacatccattctgtagcccatggatcaaagagaaatttcaactttcaagtcttattattgaagaaataccttacatagggctatagctgtcatagatagcaattcctctgatgaatctgagcaaaataaattgaaaaccttctcgaaagtatttgccattctaattgccattaagaacattgatgattcatgtggggagattaaaatatcaattaacaggagtttggaagaagttgattccaacccccatggttgactttgagggggtcaagacttcaataaaaaaagtaactgcagatgtgctggaaatagcatcaactagaattagaagtggagcctgaagatgggactgaattgctgcaatctcattattacatttgaacagatgaggaattgctttttatggatgagcaaagaaagttgcttcttgagataaaatctactcctggtgaagatgctgtgaacactgttgaaatgacaacaacggatttagaatattccataaacttagttgataaagcagtggcagggtttgagaggactgactctaattttgaaataagttctgctgcagataaaatgctatcaaacaacacagcatgctacagagaaatcttccctaatagaaagagtcaattgatgcagcaaacttcattgttgccttattttaagcaattcccacagcaactccaatcttcagcaactaccaccctgatcaatcagcagccatcaacattaaggcaagaccctccatcagcaaaaaggttacaacttgctagaggctcagatgatccttagcaatttttagcaataaagtattttaaaattacagtatgtacattttttagacataatgctattccacacttaatagaatacagcataatgtaagtgtaattttatacgtattagaaaataaaaaaaattgtacttgctttattgtgataatcacttattgtggtggtctggaatcaaacctgcaacggctctgaggtatgtctttataagtgagctcatggggtatttgtcattatatgcctggcttatgctgaagcataatatcctttaggtctatccatgttgccgcaaatggcaggatttccttctctttaaagactaaatgatatttcgctgcatatgtgtctatagatatctatatatctctcattttctttatccactcaaccattgatgaacacttaggttgattctatatctttgctattgtgaaaaacgcaatgagtacaggattgcagatatgtcttttgagatattgatttcatttccttttttaaatatccagaagtgggattgctggatcatatagtagttctgtttttaatttttaaaggaatctctgtgctgtttcccacaatagctgtaccaatttatattcccaccaacaatgcacaagggctccctttcctccacagcctcaccaatacttatctttcatctttctcatgattgccatcctaacaggtgtgagatgatatctcatggtggttttaatttgcatttctctaatgatt

SEQ ID NO: 16 - DNA, 151801 bp, Artificial Sequence
  Synthetic BAC sequence
tcaatgaacctagtttagctttttataaataagctggtgatgatgatgatgacgataaattcataaacattcttttattcataaacattcttttattctttaaagcacacattttctttctgagccacaaagaaatctccccacctccatatttacaaatgggacaatgaaactgatcagtatatatgctcaactgccaatacaaagaataaatccagtaaataatgttgtgtctgttctcaggaacaaaaggtcccaggtcattcttggggctcactcaataaccagggaagagccaacaaaacagataatgcttgttaagaaagagtttccctatccatgctatgacccagccacacgcgaaggtgaccttaaacttttacaggtacgtatctttgattgtcttctcaaaagtcatagaaccttctacaatctggccgccgacgtgaaaacctttccttggtgcccctgttgtaaaaactcacaataaagaggatcctgaaattttggactataatttaaaatgtaaatatttatcttatcccattaacactttatgtttttcttccaacagctgatggaaaaagcaaaaattaacaaatatgtgactatccttcatctacctaaaaagggggacgatgtgaaaccaggaaccatgtgccaagttgcagggtggggcaggactcacaatagtgcatcttggtccgatactctgagagaagtcaatatcaccatcatagacagaaaagtctgcaatgatcgaaatcactataattttaaccctgtgattggaatgaatatggtttgtgctggaagcctccgaggtggaagagactcgtgcaatgtaagtaaaataagatcccacgtttcagctattgaattaagtcatgcagacagagaaaatgtaatgtcatgctttgttttgtcatggcactggcttctacaggatcctagagctttttgaaataagtttaataaaaccccagtcaaataaatgaatgctcgcagctcaagtgagtcattaatcaaaaataagaagttcactgctagtgcatggggtgacctactacatatttttgattttttacaaaaattactaagaagcaatgtttggtctcatttttcatgttaacatacgtagatctaaacttgaagatatacaacacttatgagagctgaagtcagggttcctcaaggccactcagtactctttccccatttcagtacattccctctccttccccactacgttcctctgccatttaacatcggcatgtctgaaatgtctgtcaagcctggctgaatatttccagccagaccccatagcttcctagagcttagtttaatctgcagcaaacttcaaagcatgactcataccagaaaatgtgtaagcttccatcctagaaccccctgagaagaggtgggatagggccatgcttaaagatgagaatagaagaaacattttgcagatttttaaactgagtactaccttgcatttctcatttgtcccaaagaccctatagagccttacctgaagaagggtgtgcagtatgcatggtttggcagttaccagagactgagaaatccaaaggtctctgtccttccctagatctatgtcttgctttcagaaccaaagctagccaaatcccaggaaaagaaaacatttgtcttcagtacctgtccactttctcttctctgccctagttcccccattccctcccttgtccaccaccctgggttcccaggaacccagaaccttcatgcttttggaacccacatgcagcatcctaaggccacggcagcatcccaagacgctagtccccatcccaccagccacccgccaccaccgaaacttggcaatccttgcctgttctctcaacaccctggaattggctattgatgaattaaacctaaaggactaattctgcaaatgccagttactgtaacaggcaggggaaataaacctgttcagggaggatcccgggttccaacatggttctttatttcatatctttataaggccaacttttgcctgaaagggactgatttggttttgtttcttttggaaggcaattatctgctagaagaaccacaaaacatagtgtttattctttgcttcaatgtatcatctgcatttgactattttgccccttgagttattaagcattttgagaaaacgacaaataaacaggagactttcctttccaaaagcagagcaatagtctcaaaattagctgataacatgtacaagtttcacttcgattttcactggctcataaataaaccaagtgaaccaattcaaaaatattaaaatatttccaaacattttaatttttaaaattaaagcactatcttcaattaagtcaaggttggtcttaactgcatattaaatgctgcagaatttcttccatttcactagtggtaatgctgaacactgaccccacaccctacccctcttgttttcctccagggagattctggaagccctttgttgtgcgagggtgttttccgaggggtcacttcctttggccttgaaaataaatgcggagaccctcgtgggcctggtgtctatattcttctctcaaagaaacacctcaactggataattatgactatcaagggagcagtttaaataaccgtttcctttcatttactgtggcttcttaatcttttcacaaataaaatcaatttgcatgactgtacctgtttctctcttgtaaccttagtgggcagatctgcaccagcaaagtgaagcagagttacatggcagccttgtagataatgcaaggattacgtgatcaatgtcaccagagtcatttgtgcgtcaagtgacatgggaatgcttcctgaattattcatctctctgtctccatgaaatccagcaagaacaaccctaagatcaggtctaataacaaatgcagtaaaggcctccacaattccacaggaaacagaaacagccagtctggaacatttgtgttaaaaggaaatatagggcattgttccacattaacacctgcttttcatgttatacacaagaacctgagtctatgggagaaaaagaaacaagcaatgccttacggtattttccaaattctagggcatacaaataaagtgcttgggcagccaagaaaattatacaatagagagtcagccttctttctcagtgccttgcatttaagccttggattacctaggtgatttctcagttctctttgttcttgagacggggtagatccaatcaacatggtggttacagtggctgccatcccatagtagggagtgagtgttgacttgtagccagaaagttttctttggaaaaaaccgtcataatattttttcaacatagtgaatttagtaggtagtcatcagcctgcagtcatttcaagatgtgattatgtgaacagattctttccatttctatagtccctttagtaatataaattttatatatgtatattatatattatgtaatacaaatttcaatatatacatatattatatatgtatatacacatacacacatatatatacacatatacacacacatatatacatggataatacatattcaaaccaataacatacagcaacacaaagagacaggctcttaaaataaagtgcaaaaaaaaaaaaaaaccaacaacaaaggaaggagcatagctcaaagactggctaaaataatagtaaattcgttttcaaccatggtagttcattagactcaccaagctctttaaaattaccaatgcccaggtcccacctctagagattctgatttaattggtatttggtgggacccaggatgtagtattctttgtatgagctctccagtgattctaatatgcagccagggataagaacccttatactagaaaaggagatctggtgctactatataaaagagaggctctgagagagtaactacgatgatattttaaatacttgctacaatccctcattgctagttaggattttaactgcaaaaagaggatggaatattccctactgtcaatatgtattacagattttgaactctgtttaaaaaatggttgtatggaacccttgttaattgctggtagaagtgtaaattagtacaacttcataggaaaattggcagtgtctactaaaactcaacatatatataaacctatgacctagcaattccattcctgggtagatcccaaacacacatgagtgcttttatccaccaaagatgtgttctggaatgtacacagcagctttattcttggaagtcaaaactagaaataactcaaatatccacacacaataaaatggataaacaacgttacacaggcatacaataaaatattacacagcaatgaaaaagaacaaacttcagttttatgcaacacaaatttaatgttgaggaaaagtgagataaaaaagaatatgcatgatgagattccatttatctgaaagttggcataaggaaaaactaatccatggggatagcagtcagaaaaatgtagagctgctaactaggagggggtacgagggatccctttagggtactagagatgttcgtatcttgatctagatgttggttacacacttatttattcataaatttaaaactcatcaagctataaagacttatgtgctttactatatgtgaattattattctgtgaaaaaattttaattacaaaatttaaaaataaattgtagcccaggcttttgtgtgctatctgaaagcttacctttttctttatgaaaaccatattccaaatttcccaacaaaactaattgtagtaacagatatattaatatttttcttaaatgagagcctcttgttcacatgccagtattaattgagagaagtgctctttggtcatgacatagtgtcatgagagtattaaaacagaagtatccagaacagaatggcaggggacactggaaatggtctaatcattttgctcattttcttctaaacattttcttacaggtaatacctggcatattaggaagatcaaattaaaaccattaaagaagagtgtgcattgcagaaaactatcacatctgtggctttcagtggcctaaaattttctaaggcaagaattactaacattaccaaacagatctaaatttaaaaaacaggaaaaataaaaatatatattgacaaattaacactaatttaacagaagagtcctaaactcccctggtatataatattctacttttgaattcttaaagtttttgttttgttgtgttgattttgggggcatagggaataggtatgtattagtaaaaaaaattcatgtcaaagcaaaaaaaaataatcaaccaatatttgatatctggcatatgcagaacatatgaaggagcaccaaaaaatataacgcatgctccctcaagccctcaattcaaactcctcaggatgttaaaacaaaacaaccaacgattcaaacagtaataaaagatttttttaaacagctataatagtataataataccaaatagatgatacaggctaatgccaagaactcaaacccaggtaacatcatttcaaaacacttcctggagaggttaggacttgtgtgggtgtgtaaaggaaaaggagagagaagcaagaattcagattagaagaaaagctccaataaggcaagaaatcacaagacttagccaaagtcttaatataggagatgaatgtgaattaacattcaaaagacagaacagcgaactgatcaagtttgaaggaaccttagcagtgatcaaattcctatccttgcagatgttgcaacacatccaaggttacagggtgtatttatggcagagccaaggcaaaaaaagatctcctaacttcaagtcctgggctgaggactccagaggttgaggtcaaaggtgtttggtaataggttgtccttgagagttgatgagcaggggactgagaggatcagcacaggacttttagatgttcaacctagcagtggtgtggagtcaagaggatcagttctaagacaattacagcagactggctgtcaggcacacaggatgtgactaggtgaagcaaaagaaaagagagcaaagggtgaactgaggaagcacagagcagaataatcaggaggttccctgagtgggagaccaggataaggatgagaccatcaggaggggaaagggattcctacagaactgatttttagagagagcaatatgcatgcttaacatactgcctagcatatagtgagattttagtaagtgtttttcaagtgaatgagttgtgttttcaatgtgttgagattgagctaaagacaggaaagtatctcaaaagggaactatcctgaggcaatcagaaatatgaggtttggagctggggagaaaagtcatacgggaaagaagtagaaatctttgctatagatgttattctgaataaagtagtgaaaatgaatctctagaaaggggtaagaatgggaggaagaagaggagggggaggaagaggggcagaaagaagaaagcagagaagaaaagaagcggatctctgggaagcagagcaagtaaagcaatctgcaaaagaagaacaggagaacaggcattcacatcaagaagagtatttcaacttgtttgatactcataaaaaccccatggagaagacatagccaacatcatcatcttcactcagaaataaggaaactgaaacctagaggggctgggtgctagtagcaattccatacagaggccgtcccatcagctgcagcagaaaacacccgggtctggtctggactcaaagacaggtgcagcactctgcccctgtggcctgggggaagaaggaaagacagttcatactcctccacgttacatgggctgctgctcaggactgtaggcaatgtaagttggggccatgagtcccatcccaggataaagggctttcccacacccaccaggttcagagctgccaccaactgagccatgctgggagacagcagtcagggccgactgggacagttttctccctcagtgctcttgcccctgtatcagtgtcctgtggctgccataacaaattaccacccattgggtggcttaaaacaacagaaattgattctcacagttctggagatgggaagtctgaaatcatggggtcacaggggctgtgctccctagggaggctctcgaggggattccatgctttgcagctattggcagtcattgatttgtggccacatcactccaggctctgcctctgagaccacatctcctcctcttctgtgtgtcttttctcctctgtgtgtctctcacaaggatacttgccattggatttagggccacctggataatccaggatgattttatttccagatccttaatgacatctccaaatgcaatatttctgaataggtcccagtctgaggttccagagatttagcatgggtatcctttaggagaccatttatcagcctaccacacccttcatgccctatactgttgttagttctgtcttctctaatccaaccattcctacgaatgacagtgctatgctcctgccacatatcccagccttcccccagaagtatcccactgggccccaggtttcaataaactaatcagataaactgaagcagcttaatgaaaaaggaccaaaaaagctctcccacagagcatgcatgagccacacttaggaagttctggagataatacttctccttctgttaaattattatttgccaaagaacattctatggcacagtagtcctatgagaggttaataggtattaaaaacaaaaagactgtttaatgttcacactaatttggaagctttgagttaagaaaattaaacatttccttatttcaggatttcttcattttaggactactagaagcattacaaatgtttcggagatgaggcaacaacaggcagtacttctcagatttatctgaccacagagttcttttaatttgagcatctcaagggctagtgctccttggaaaatgctttgcaaaatctggcccaatccaacagtgactttaatgatcaaaactttaggccaaaataggtgaagctgactctatgaaaggagcctgaggctaggagaatgagggaggaaaggaggtcagatatggttttgagtgggtagctatttgtgggcacagctgaaatcaaactagatgggtggtcactgctcaaaggaccagtactgcctacgactcaattgagagctggaatttcagaaatgatcgtgtactctgatacaaggttctcagcagaaaggagtgtgaaaacactattccactcccaagagagacatatttgagatgcttattcttctacacacatcactcccaacactctcctttgtgcctgtccacgtgcatgcgcaagcacacacacacacacgcacacacacaccacacacacacgcaccagtaaaggatgcctccaaggggacatgggattggccctgggtgtgttgggacataaaaaagtttacatttataacgacaatgcaggccccttattttataggtgagggaaaagatttggggataccaaatgtattgcccaaggtcacacagctaatcaatgacagagccagaactaggatccaattcaatgctgtgactattcagaccacactccaaaccctgatgaaagaatctcttttttttatggaagaccactgtctattatttaaaaaataataaaccatataaatgaaaagcaacttgatttagttgttttaaaaggataaatataggagacggacacagtggcacacgcctgcagtcccagctactcaggagggtcacttgaagcaaggtgtttgaggctacagtgcattatgatcaagcctgtgaatagccactgcactccagcctgggcaacatagaaagatccagcctcctaaaaagaagaggataaatatataatagaacattactctaatgcttttatttatttatttattttgagacagggtctcactctgtcacccagactggagtgcagtggtgcaaacacagctcactgcagcctcaacctcctggactcaagtgatccttccacctcagtctctcaaatagctgggactatagagtgtgccaccatgtctggctaatttttgtaatttttctagaaatggagtctcaccatgttgcccaggctgtgctgatgcttttaaattaataagaaagaaaagtctattcaacaaatgtaataggtaataaatatgccttcactcttttgtgttatgatgaagaagagaaaaagggaaaaggaataatggtggggggaaatcccaatcttttccaaagcatgtactgaaaactatcttgacttaaaaactggaaagctacttttagaatttgttaggaaaatggcatttggactggacgcaaagacattcttgaagtttttctctcacatcagtgacaatcttaatttaccagatagtgggaaatgtcgtctttatctcggacaaaggtcctttttaggctttattttctcaagttctaagaatacagacactgaaagcatgaaaacgttgtcttctttctgcaactatagtcataaatgagaccacatattgatacatggaatgatgaaaccaagccaaaggccagatctcaccctataagctaaaaagctacctactcctattttaaagcttaaaaattacaactcttgagtaggtgggaataatcataagttacctttcttctgtagtcaggtgggtgaggtctctttaactgaaattttccccccaaaaaaaatcatgactatggttaacagggtacggcttagtaaaggtgtgaccagaatctagaatagttttgttccaaactttgtgaccacaatccacagccaaaactatattttatgtagcaaccccatacacaggcacatacatgtactacataactataacataagtttcataaaatactacttaattttccattttcccatcctatactattctatttcactttttattgctgatcttgactcactacattcataatccaatggtcatgacccccagtttgaagaccctgatccagatctcagtcatcaggtgtatgtcaagagcgctgttcttgacccacaatggaaacacagcctcacaacgaaagccataaaaattaaatacctaggccaggggacacagcagtgctccctcagtgtgttcatggaacaagtacttcaagatgtcacccactacagatttcccaaatgtgtttgggaaacaacaaatgctatcaccttctcttggtgatgcacaacacacataatctatccaagcctttggaaggtccttaagaaagaaaacagtggccaggcatggtggctcatacctataatcccagcactttgggaggccgaggtgggtggatcacctaaggtcaggagttcgagcccagcctggccaacatggagaaaccccatctctactaaaaatacacacaaaaattagccaggcgtggtagttggcgcctgtagtcccagctacttgggaggctgaggcaggagaattgcttgaacttgggaggcggaggttgcagtgagccgagatggtgccattgagcttcagcctaggcaacagagtgagactctgtctcaaaaaaaataaataaaaagaaaaagaaaagaagaagaaaaaactgttctagcttaaccccaaatttccaaacttactgaccacatggtatgtttttgtattaacaactttgtatgtatgttttgtataactgctaaacacttttgagaaatactgtatgtagaagaaactaatgggttagagataaaaatgagtgtctaagagctcaaaagtaacctcatctccaactataagcattttaagagaaaaggttaaatgcactcttggaaattctaatattaatgaaaaaactcgcaaggagttaaaactaaagtacttatagcttgtgaggaccagagaaacaaggaaatacacctggtaagtacattctttattctaagcatcagcaaattgatttgaatatcctatcacatgcccccacctagctgaaggccatacctagctgctggaattagttttgtaaacaaccaggttttaaggcttgatttacaatacttctctaatctgaaaaggtccagggaattgcatgtcttttgattaaaaatatgaggattgactcatgctcttcctacacttgcacctgatcaccaaaatggctctgctaagagttccctgtattctgatccaggccacagagtgtgacagctgaagaatacaaaggtcattctgaggctgaggtccagtcgggctcatcatcagaggcaggaagtctatctgataaggctgtttcattgttgcccactaatattctcagaatctccaaagagagtcatggtattatcactacctaacattgcatatatttgttttctgcatgtctcctctcacaaaagtgtaggctccctgagggcaagaacattgtctctcttgttcacctgtgtatccccagcaccccaaaaagtacctcccacataatagatgcttcataaataaataatcaataagtaaacctcagggattggccaggaggccaggtgagtgaacagaggaaaaagacgggatatataatcagagttctacaagagattggatgccggtgccctgttcttgcatcgaccaccagttttgtcttcctgtttccctgggctgggtagaggagatactctactcacccttgagccccctttaacattctagatgcacaaaagaggatttaaggcccagaggacagggcctgggtcttgctccccatcatggggtctttctctcaagaagtacccagtaaaagtttgtagaacgaagctgagaagagtagtggtctaccttgaaagggcagatgttcacagaggaagctcatggtcattagtggcctcctgacacataatgtcttgccctttcagatcgctttatcttccacccattctacaccgctggtttttcttcaaaataagatgatttgtgatgctaactcgagttcaaaaactgcccaagatcaccactccatcattcatatacatatgcaaggaggagatgacttaatttaaagtgatgaacaatcttaggcaaattcagaaacattcaactatacgctctctgaggtagggtggatgtaggactttttcctctgatgaaatgtgtacttagaaaaaccagaaggataaaatctttcattcagggcttttccccccaacaacagctcactttgctataggtgcatggcattttactcacccatttgcttaccaaaaaacccacctgacctggacacagtgggacaggtccacacagtcacatcattcttgggagtaccttgaccagttgcaatctcctttgtcttaggtagccagattaaggaacaaatctgtaataatgatcaaaaatagagaattcttgcaatttctgattccttatgaatatagttaaactggttacaggcagtatgcactgtccatgacccaacctccagtacagctggggtaggatgttaaagaaattacaaccattctaggaaagtttatcccaaggcaacaaaggatcaagtatacaaataggcttaggtgcaataaattgaagaatttaagtgaactgtgatcattggccaggaagagccagattactctcaaagttcatggtcaaagcagtgatggggaaagaaaggaaatgtgaaaaaaagaaaacacaaattatattaactttgaactcacaaatgaagaggtttttacaataaaaagaaactcttgagaactcaaattccttatggactcaatagagaaagagagcttgttgggggcataggctctgttgtaaactattttcacaagattccagaagatcaaaatgaagatgaagcccagaggagatattaacctgtgagtttgtgcttggggtctggatgctcttcccagcatttatatccaagatgtgtaagcgtccatccttcattcctcctccaatggcaaggaccccagactgccagggacaccaatccatggcctttaaagtttcacataatagcacagacaggtcagcttcaaaggaggtgcactcatgaatgtgatgcacttaggtaagcagcaagtccccacgtctgcacctgtcacagctctcctgggcctgctatctaaaggcaggagcaactgcaccctccagagattattcctcagggactagcagtcacttctggaagggaaggtacctaatacgactcaaatcaaattgttatcaaatgatgataacaattgtggattttttaacatagactatgcaataacagttgaaaaactacatgcaatacatcctatggggcaaaaatctgctgctgggatagttcacatgtgcccttgcaaattggctctgaaaatgcaggctttctctgatttgtctacctgtgtccttatgttccaggtagtggtcagataagagaaaagagaactatatgtgattgctcacaactcaacagtctcaagcacttcaaatcttaaagcagttcagaaaataaaattgccttctatttatttataattatagttaattctaaaaaataggatttagtatcacacatttatattgataattgaaattactaataataatcactttaaaggacattttaacaaatactacagttatatgtatctgtgtatccttatcaatcatcttggtaactaccctcatttttgcatcctctcttctacacataaaaatattttataaagtagcaaacatcgtgtttatactatttgattattttctgttgttttcacctattgtataaacagttttccacgttttaatagacttttcacaattataatttttaacaatcccataatattccatcgtgtcgttatatcctgattaatttttgttctgctaatgctggacctgttttggttttttgttgtattgtggtttgatttgtattgggttgggttaattttttttggaaaggagtattttttttgtttttgtgcgtgtgttttatttgctgtttgctctcataaagtacattgtaatgaatacattctacatgtctttttttctgacaaattttttaagtaaattccaaggttcaaaagagttgacataaagttttccaagcagttataactttttacagcaccagcatccaatgagtatactaatttcaccctggctaaaggttacatgaagttaaaaatgttattttacatctagtgaaattaaaatcattacaaaacagattataagggtaatttattttcttcttagcaagaatgaacttttttctgtgtatttatgttcctctagcacttcccaccatgtggattttttgccatctaagcacctacatcttaacgcttttcttacaagtttgagtccattttttaaaaacatacatctgaatatacaatagttgctctcattcttcatttaaccaacttgctaaatttaccaaagttctccactccttctgtaaaacatacttactcctacccatagcatgctagtcttctgttctctagaatgctccacacttctactcccactaattaagctgtgggtttatagagcccactgtgttttgccaaacctgtttatgacaggtgaacttgttattataactgtgatttcatcaaattacatgtaaatgtttaattaaatcacctactttatttggactaaagatgactgttacttctatgaactaaattaaacaatttggaagtcttttctcttttttttttttttaagacacagtctcactctgttgccgaggatggagtgcagtgctaccacaaagggtcaatgaagcctcaatctccctggggctcaagcgatccacctacctcagcctcccaaagtgctgggattacaggcatgagccactgcacctggcctcactctattttaaagattctgcggcagattgtattttccaaagatagctacaacactgtctttcatccaacaagtccttctgagcctcgcccattccctccatcaataggtacaatctaattcctctacctttgaatgtgggacttgtgactatcctggaaccaataaatgtgacaaaagtgacactgcatgaattgcaaaattaggttatattaataaaaggtgttaacgctttcaccttgctctctgaagcactggacctattgccctgaagcacaaactcccaactggcttgaggcaaccatgttgtgaggaaacccaaatcagcccacacaacatgaagatgctctggaattacaagaaggagcatgcccaggcagctggcaaacaagtggtccagcctcccacacttttagcttccgatgctgtctgactgcaacctcatgagtgatcctgagccagaactgctcagatgacattttcccagaatccttacccaggaaaccataaaagataatgaaatgattattgttttaagccactaagtttttgagtaatttgttgcacagcaatagataaccagacagatactataaacagaaaccttgaacaatgaaatatggttatagttcatacaagaaagacaatgaggaattctcatcagcctacctacactcaaagtagaggtcttggtctcatatggtgaattaatgtacggtttaataaatctggtgaatgtaatgttttcagtcaaaataaaatatctacaatatatatcataagttaaagttccctgctttaattgtctttttcaaataaccattctccacctctgattaggctggagaagagggctatttcacagaacacaaaattttgcaatttcaagaggctcagaaattcccctgagcccatgggccccagttttaccatatgatggataataattttttatatttattaataatcattttcttaaatatcctacacttccagatagcttttataataaatattttggcaaaactagaagctacaccatgagaggaatcacgcacatgtcaacctgcaaagtctactcctgctccacctgttggttagctggtgactgaagagacacgactggtgactgttcagtgattccccaggtgctgactgccaggaggcttggcttgctctggtttccggagactctctcttagtgaaaaggactcccatttagtagttcactgcatcagatttttgacaacaaggcatttaaaaaggtaacttgtcttgcttggcttgggttttcaactaattttttgttttgtttttgtatgttgttttcagacagcgtattttacatatattttgcctacttcaagtcatgaatactgggaatttggaccgatcatcattctcaatatcctgtagacatgaaaaactacaagccaggaatattgggccagtacaatgtagtggcagcagtcactatatatttcaacctatattaggaagccctgtaataacttttaaatcctcttgtaataaatttgcttactgttaataaggtagaaccatttctttgctctgtgagtgacatatattctgggactacgttgaggtcaagacacatctgtgtcaccaagtcctcaagaaggaaactatggaatttttttactagaaataagaatttaaaagagaaataaataattatgcagaacatggtggagcattgatctaattccacagcaccctgccatcttctgacagttgatctcttttcttacgtgtgagcttgtgacccaggcccatcagtgtgcccatctctctggccacaattattaactgagagatgagaatgtgaccaaaggcagactagagtcctccctggcacatttccaccagagttataaggaaaaatggcttcttatccagcgcccatctggaagaatctgaatctgaagctgccaagagccatcttgcccagaaaatgaagtctgaaggaagaatgaaaccagagataagcagagccaagagctaaaaagatgggcccaaatgacattactcaaagccttagatccagctgatatttaaaaccagctgtatgtacccaggactccaaagttacatgaaaaaaatagatttacttttttgcttaagcttaagtttgactttggtttcagtcacctacaactaaaaaatctgaccagtggaaagtataaatagggttgtctttcaggagagtgatgacaaactccaaagcaaattctagagaaagaaaaatctcaaaatattggcttaatgattttctttttatatgtgaaggatacccagtggcctctgagtaacaggaaacctagaaatctattgggtttcttaccttgactgccgtagactgggttatgactttcagcggttggccctgtgcactggcacctggatcgtggggccatattgtcagcagtccatcactgcagccgctggaaagcagcctgccatccggtgaccacttcagagcacacacagcttgcttgtggcgaagtgttccaacatgatgctgggctacccgaacatcgtgatgataaacacgccccagtcttgacccactgcgagtttacataacaaaaaaattaagccctgttgctacataaacatttgaaaacatggaggaaagcatagttcaaagtaaaacttctgaaagacccctaggacagattcaaaacacaggtggagattccttgggttaataaggatggagtgttctgcctggaggattcttttcacaagtgaaattgatttgtctggcagagtttgaagtctagatttaaaaatatcctttgatagatgtttctaatgactttaatctgatgtaagcagcgatggaaaaataagctgagaagattaccagattttcccaaagactagtttatatacaggacctaggaaatattaacacttttctgcaactttgaatatttcagattatctcaacaaaatggtttcagtatatatttacagtaaaatgttagacatagaaaaaggaaataaatatctaacaggtagagtcctattaacctatagatccattcttagttttgctaaagaactaaacttctttgtaaaagaagtttaaaaccaattgaatgtcacagcaaactgcaatatgattcctaagcagtggataatgtctccattcatgctcagtgatgtgaatctaaacaactaaagatcacatcactttttcaaagataatgaacgctttctggattaatttaattttctctaaggagtaagtaaatgatgttccacaattatttcagacatttctcaaagtccagtgtcgcattgtttaaaactatgcaatgctgaacagcattgtgattaacaatatgggctctggagccagaccagctgggttattccaactccatcacttactaaccatgtgacttcaggctagtgtcttagtttaatttgaaaaaacaaaattgaggataagagaccaccttatcatgttactgcagtgattaaaatgaaattacacacataaaaagtatagcacagtgcctggcacagagtagtctgaaaatgttagctgctattattataagaaaggatctgctcattttcctcgtggataatgaaactaaattttaacaatgcagattagaaaaggagcttgagtacataattgactgcaataactaagttgttttaagaccggccaaaaacacaagatattcaagtctcaagtttacatcagattacttaaatacattttaaaagtctttgggatggccaggcgcggtggctcacacctgtaatcccagcactttggcaggccgaggcaggtggatcacaaggtcaggagttcaagaccatcctggccaccatagtgaaaccccatctctactaaaaatacaaaaattacccaggcatggtggtgggcgcctgtagtcccagctactcgggaggtggaggttgcagtgagctgagatcacgccactgaactccagcctaggtgacagagtgagattccatgtcaaaaaaaaaaaaaaaaaaaaacagtctttgggatttatctaacttaagtctaccttaaccttaagaactacaatatgaaaatgaatggctatgattaaaagcaatatatatttagaccagttatgtaggctcataggaaaaagtcccttaatttttctggttaaaaagaagcagttaaactaaatcactagttctcaaagggatgtatcatcagcatcacttgggaaatgagaaatgccaattatcagcccctcaagacctaatgaatctgaagtccctcaagtgaagccagcaatctgcattttgaggagctctccaggtgattctgatacatgttctagtttgagaactactgaacaggataatctatgaggttccttctgctctaatttctgtgggtctatgaattggaaatgtgtcccagagagcttaacatattccatagtatagatactgacagcaataaatacttgatttcagcaaaatatccctttagtacctattacttagcacagagaaaccttttgcttgaagggattttcacattttatctgaacaatttagtgcatcccatgcagaaggcacacatgatacatgtggccaccaagacacttacatgaccagcagatctgaatacctgagagggtgggatcatacctgatattaagtccaatggcctattttgttttatttttgattggtttaggttttgaatattacaactgtttactcaggccccataatcaattgttaatacaaacataactgtctccaacaagacgcttcttacctgctgaggataaagtgattccagctcagagccccaactactgacaaatgaccaagcatatttctcagccgctttttagttaccacatcccataactgaaaaaatgaacaaggagagttatgtagcattggagttttcacagcccactgtcttctcaaaggcctgagagccaattactgctgatattgttagtttttgtactaagtgaaaacccagcacatctagccagcagttctcaattctgactgtgtattaggatcagctggggagtctataacactatggatgctgatttagttggtagagtagagcctggggatatatggcagttgttttaaagctccccaggtgaattcaatgtgcagccaagggttgagaattattaccacatttctagctccttctaaattgtgagaattccaaatctggaaatctacccacagttaccaacaaatgtattaataagatgtgggtacccggacacttcctagaatcagtaattccacttactgctaagagactcccttcctgcgagctacagataatattctgatccacatggggaatgacaactttggtgtaagaagaaatcatgacatagacttcacagcattcattatcattgcagagatgagaaagcagtgagagagccatctgtggccctcctaagtcatttgcacatgagtgatattgtttattctattggtaataaacaataataatgatacatgagaaatcagatagattgatggaaatttgataaatccccatctcaaggagcctatcagaaaaaaaaattcactcattttctataactgtactcttaatcacggcttcaggtgaaaaggagaactgaaagtatcttcctctctccaaagctccaaaactggagattctacaagcccaactttagtttcagagaaaatatatttttaaatatgacagaaagattgtggtggaaactaaccagagtatccttacgttttcattaaaaaccattcagtaaaaaaaaaaaaaaaaaagcggaatgtcatctccttttattccccatacttcaagagccacacctagtttctctattttacattaacttgttattaaaagtcaattatagtgtaataatacacagagaacatgatgagaaaaaaaaaaactggccagtacttgcacttctccctcgctggtgccaactgccaggcaagttccctcttttatccaggacacagaagagatatagttacaagtgagacttaagtctatgttttcaatcccattgtggttctccccattccagatgtatacagcagagcccagggctatggcaacaagattctgaaaactccaatctaggatattcagatctataagaaaagcacttcaaattagtataattatacagccacatgaaaacatgttcaaataaacaactttataggtagggggaaaagaataataccatccccatggttagctggaaaatggaaacatggaaccatgaaaatccttaaaagttcaaaaatgaaaagtggaatagaatctagtgtcaacactcacagtctaataagcaataatgcttattatttacactgaaatatatttatttagagccatttaaagaacttggcagattcatctaccattattagtacatgtagacttcgtttaacggatcagtaaaagttaaaagcatataattcttatggagacactcttggacctaggatatctatatgggagatgccaccatcatttctaaccaaaaacaccacccagctagaagaggtggtggttcatgtatgatacctacacgttctcaacagtattctatagcttatactaataagaaacctttgactgctaagagaaaacatatttgtatgaccatttattaaaatataccctatcttatttcttatcagtcagaaactcctgactgacacgtatcagtataaaactaagtagcacaccagttcccctacagtagtttaaacccctacaatacattccgtccccatgataaatataaactctgaatgaaatataaaaaacaaacacctggagatcctgtaaagtaaggaaaagcagtaaactaagtaagggagtcaaaatttggagaagcaaactggcggggggtaagtttcccacttttcttctttcacacctttgccctgaggacaggccccattgatggagtgccagcgaagactctgacaaaaaggccaccatatttctggtcagagaaaccatggaaaagagcctgaggcatagaactgataccagtatgagggaaaagtcctagacatgggaaagccaaaagaaagagatcctctgagtgtgagtatattaattcacacacatctcagccttacccctaaatcacctacatgcagaagagactcaaatcaccttagtaaaggctttaagaaacgaactgagatttgaaacatccatacaagtctcagcctaggctctgatccacatgtatgagatacagacccaaaccagcatggtcaaagtttaagaaactgatctaagatttgaaacaccacccacaaatggcaagacaaaacttaaaatgtgaacctaactagaacaaaaacatcaaccagaacaaaacatcaacattctccacaggacccagtgactataacataacatctacaatatccagacacaattcaaaattactggataaatgtaaagacaaaacataaccaatagatgaaaactccaaggtgacctaggtatagaaattatcaaagactttaaagcagccattatattctccatgaagtgaagaaaaacacacatgaaatgaatgaaaatttatatgaaactttatatgaagctttaacagataaacagaaaaatcaaaagtattttctaagtaaagaaaatagaaaccataaaacaaagctctaaaatggaaatcaaatatacaaaaaccacaaaatacaaactttaaaatggaaaaatataatatctgaaaaattccttggatacactgaatagcaggatagaggtgatagaggaaagagtaaacttgaatatagataacagaaattattcaatctaaagaatgtggagaaaaaatttcttaaagaatgaagcctcagcgaattgtggaataatatccaaaaatctaacatatgtgtaagtagagtcaggtcttagaagcaggataacaaggtgaccatggggttctcaccagataccatggaggccacagtcaatggaacaacatcttttaaatgctgggggtagggggcagtggtggatctttcaacccagaattctatatccagcaaaaatctcatcaactggaagatggaaaatctaacagaagtctgtgccaactgacctgatctgcaagaactgctaaaggaagctcttcaggctaaagggacaatatatgaaagagaaacttggatcttcagaaatgaaggagaacactgaaattggtaaatatttgggtgaacataggagccattttttcctcttaagctatttaaatactttttaaattttaaaacgtttacaattggatggttttcagtgtatgtaaatataaaatgcatgacaggccagacacagtgtctcacacctgtaatcccagcactttgggaggccaaggtgggaggatcacttgagcccaaagagttcaagaccagcctgaggagtaaagtaagaccccatctctataaaaaatcaaaaaattacctgggcatggtgatatgtgcctgtgggcccagctacttgggaggctaaggcaggaggatcacttgagcccaggaggtagaggccacagtaagcctctacagcctccagcctgaaccactgcactccagcctgggtgacagagtgaaaacctccctcaaaacctccctcaaaaaacaataacaaacaaacaaacacatgacaactacaataacctaaaaagtagtggggactttgagagacctatgtgattgcaagatgtttatatattgtgtgatgtgtacaatagtaactctacgtagactaagaaagttaaaattacattgtaatccctagaaaaatgacgacaaaacacaatacaaagagatatagccaaaaagctaagatcaattaaaatagaacagaagtaaaaaaagaaaagatgtccaaggaacaggccttgggtactccaacatttagaggtcagggaaatggaagagaaacacaaatcagcaaaaaaggatgagaaagagtgaacaaaagacactcttggacaaaacccaaaagagtgggatatcaagaaggagggattgatcagctgtctcaaatatagttgttagggttcggtatgaagtctaagaagtaactgttggctataacaatgaggagttctttggtaatgtttggaagagtagtttcaattgaatgatgagacttaaaacttgactagagtggatttgagacaatatggggagagaaatagaaaattataagtataaagatcttttgaaagttgtactgtcaaagggaggaaagaaagagggctgtgcgtctgggcatggtggcttatgcctgtaatcccagcactttgggaggccaaggcaggcggatcacttgaggtcaggagttcgagactagcctggccaatatggtgaaactccatctctactaaaaatacaaaaattagccaggcatggtgcacatgcctgtagctacacgcccagctactcaagaggctgaggcacgagaattgcttaaacccaggaggcggaggctgcagtgagccactgcactccagcctgggtgacaaagcaagactctgtttaaaaaaaaagaaagaaagaaaaagggctgtggcttaaaggaaaaatgggaacaaacattgtttctttttaatataacagttttttaacattttttgaaaatccatccttcttagttggtcatgacaatacattctcttggagaaggagctgaaggaatagggagatagagaactgttcccttcagggatttttctttttccagctcatgcctctttttagatattccatggagcccagaccccttccctctgctcctctctccctcatctagggagcttacactggctcctggattcaatcataatcatctgacctacgggctagtccatcctctttcaactaccagcattcgtttcaaataatctgccaaactgcttctatgtctgattgtctcctttaaaataatattcaagcatagtctttcctctccaaatcacctcctctgccaatctgtcttctcagtgacaccacccttctttctcctgcttcaaaaacttggaataatcatgaattcatttctcatcccatttcttttcttcatggaggaaaaataagcctttactctttggcagctctttcctactaagtgcattctgcatactctgccatgaattttcctttgatgtttctcttagtcaacaactcccaaaacaaatctaaatttctgaatttgaatttttctccataatctgtacccacctattcaccagtccccaatgtatcttcttcattgccattaaatatcttaattaccaacatcctgccttcttcatgctgttaacaataccaaaaatggtccttctcctctatacctttccaagttctaatgatcttccaagacccagcttaagtataaatatctccacaacgtctttctggacaacaccgaagctcactaagctccttctagtctttatagctccttatatcccatgatttattatttataatctaccttggcatatggtatcagttccgtgtcagttagtcctgtcctccaaactagattacaagctgggcacataacaagtagacccaatgcagttgtttgactgattcgatttacccatatttaaaatacatacataagaatagaccatcattagtacaattctttctaatacagtaacataaaatgtatatttcccacaccatgccaacattaacaataccatccctaaatatgaaagttgcaccaggaaaagccaagtatattagccatatttggatgctacactatttggatatgagacataaaggccatctggtttaatcaaatttcaagtttataccagagcacaggatgcattttgtcatttcaacttttaattcccaatctaaatgataacttacagtagtcatttcgaagaccagtaatatgaatcttcacctctggttggagtatggaatcgtttatatcaccagaacttttaagatggaaggattcatctctgactccatctttgcagcctacaagaaacaaacacttctacacagctctaagatcctgaaaatataatatttattcttgtgggaattaagaaataacattaagtgaaaaagcttaattaagtggaaaataagtagtcatcatgataaaactacagtacaaagagccggggaaggaaggaaatgaagagcacttcagtattaatttaaacaagaagattaaaatttttttcaatgacacttcctactaaaaagcacatgcatacagacctgaatgtagaagatagatcttgtgaggagtacacagagatactacatcatgctttgaatatttattctgttatttgggattttaaaaccaaagtgaattttgcttttccacaccaagacttacctggtacacctatgccctactctgagacttcatcaataaatatttattgattcgttgattttagctctttctctcaatatttcagtattggagcacacagactccaatactggagtattgttaatatatttatagttggaatcatacaatatttagttttttcagattgtctgcttttggttaattttacccatgactatctaaggtcagtattctatcttttgttcagttctcatcaaaagaccatactaagttcaaaccacaggccgctgtcttttcatctccaaccactcagcttgtgatcaaactgagaatgataaaatcaaaagaaaccaagaccacccaggtgacttgtggtgtctatgaccagatggcttctgataaaagcatgagagcttcacaatgctacaccaagaaaccaaattgttactcataaattcctgcttccgtgttagctatgaaaacctgtagctgagggcaaaactgcaagattactaaaaatacttaggcttgctgataaagtatcaacaaggttaaaaaaaaaatcaatacccaaagaatgaacaaaaaaactcctggggctgggcacggtggctcatgcctgtaatctcagcactttaggagctgaggcaggcagattgcctgagcccaggagtttgagacccacctgggcaacacggtgaaaccctgtcactacaaaaaatgcagaaattagccaggcatgctggtacatgcctgtagtcccagctacttgggtggcttaggtgggaggatcacttgagccaggagcgccactccacatcagcctgggtgacagagtgaggttctgtctctaaaaaaaataaaaaataagacatgaagaaaccttaaatgcatattactaagtgaaagaagacaatctgaaaaaactaaatattgtatgattccaactatatgacattctggaaaaggaaaaactatagatacagtaaaaaggtttctatgggaaggggagagacggatgaacagacaaagcagtgagcatttttagggaaatgaaactattctgtatactataatagtgatacatgtcattatacattggtcaaacccatagaatacataacatcaggaatgaactctaatgtaaactatggacttttggtgaccatgatgtgtcagtgtaggttcattgattgtaacaaatgtaccactctggtgggagatgttgataacgggggaggctgtgcatgtgtggtgacaagggatataagggaacctgcaccttctgcctaactttgctgtgaacctaaaacaaatctaaataataaagtgtatgtgtgtgtgtgtgtctatatatatatatatacagagagagaaagagagagggagagagagagactcctaaaatatcagaataatataggtacattatctctggcttcatagaacatatatttttttattctaagccaaatactcagcaccttacagaaacaaaaacttgttgctgtttaggacaaaagacgagggagctgaggaaagacatgtccccacatattttattttgcttttaagaaaatatcattctaaggaaaagacaaggttcacactctcatcccaaccatatattcccaaacccccaaaagaacatttagaaggcctgaaattttgtgcctatttttatgcatctaactcaatttttttcccctttttactgctgggaaacagacgcttgaggaataaacatgcacaaagttctagctagaagcttgtccaatctgcagcccacagggcacatgcagcccaggagggctttgaatgcagcccaacacaaatttgtaaactttgtaaaaacactgagatttttttgtgattttttttttttttttttttttagctcatcagctatctttagtattagtgtattctatatgtggcccaaaacaatccttcttccaatgtggcccagggaagccaaaagattggacacctctgtatttagaagttaaaagtgtgtatctatgtgttatctacataatttttaaaagaaaatttccaaaaaaaatatttttttttttgagacagagtctcactctgtcagccaagctagagagcagtggcacggtctcagctcactgcaacttccgcctccctggttcaagcaattctcctgcctcagcctcccgagtagctgggactacaggcacccgccaccacgcctggctaatttttgtgtgtatttttagtagagacagggtttcactatgttggccaggctggtctcgaactcctgacctcgtgatccacctgcctcggcctcccaaagtgctgggattataggcgtgaaccactgtgcccagccccaaaaaatatttttaataaaaaattgggacacggcaggtgcagtggttcacacctgtaatcccagcactttgggaggccaaggtgggcagatcatttgtggccagagttcaagaccagcctgggcaacatggtgaaaccctgcctctactaaaagtacaaaaattggccaggtgtggtaccacaggcctgtaatccccactattcaggaagctgaggcaggagaattgcttcaacccgggaggtggaggttgccatgagccaagatcacactactgcactccagcctggacgatagagcaagacttcatctcaaaaaaaaaaaaaaaaaataggacaagccataaaaatagaagtctactttagcattgaggatttctgtctccttgttcacatttatttttgagaccttgccaaagcaccccatggatatgcttaccagaacttattccagaggggaaatgtagcaggcaagtttccttggcatttatgaaatgaaccacgctagttctctcaagaggattctcacacagaattctggctcccaaacaattattttccagccatgacaataatctcatgaataacacaaaaacgtccatgatggcaacagaaagtaggaatgaaaacacatggggctcagggtcaaaagactttgggaggccaagcacagtggctcatgcctataatctcagtattttggaaggctgaggcgggtggagcatctgaggtcaggagttggagaccagtctggccaacatggtgaaaccccttctctactaaaaatacaaaaattagctgggcatggtggtgtgtgcctgtaatcccaagctgagacaggagaatcgcttgaacccgggagacagaggttgcagtgaactgagatcgcgccactgcactccagcttgggcaacagagcgagactctgtctcaaaaaaaaaaaaaaaaaagaaagaaagcactgagagctccaaatgtagcatggaacaggaccttctagaaattgccacaggcaattatctccccactgcatggctacagagcttccctgataacgctcacaacaccaccatccaaagtttcctaccagctttcggcaaagaggtacacctgaaagtttacaggggctgcctgctgtaaggtttcagagtcattagatatggacaaggcataaagaattgctttatatacacagcatttggataacatttgtccccgtgatccactgatgagcaattacttggcttatgtgggatctgtttcatagtttaagttcccttaaaagaatcaacaacagagccttgcatagagtattcagagggcctctcaattagtctttgccaccaacatcctcctgttcaaatcgtttcttcatgctgccactaaagtgatctatgggaaggggagagacataggtaagtcaagtcaagttggaggaatggccatgtaagtttatttcctctgcctcctattttcaacctaagtacagcaaatgacttttttaaggggtgaagacacaagaacaaacactatgggagtgaatatagcagtgggcaagagagcccaataattttctagacagtggataaaggattaataactgaccaagaagagcataagaaactacccctcaagtgcctgcaaagggagacagtgaagagaaacaagctgatttgccttgcaaaatcccacaagggctccgaggcacagagaagactgagaggtgggttagttaaaagactgtcaagttcccacacatacacacacaccctgcccaaccaagtaaatacagacacacatatatggatataccagaagaaaccagatgtttattctctggataaataaaaatgacaattttttaattcaatagcgccaggcaccatggagatgtatgaaacaaaaaaatagattttgagttaaaaaaaaaaaaaaaagacagagctcactctgtcgcccaggctggagtgcagtggcgtgatttcggctcactacaacctccgcctcccaggttcaagtgattctcctgcctcaatctcccaagtagctgggattacaggcgtgagccactatgttcagctaatttttgtgtttttactagagatggggtctcaccatgttggccaggctggtctcgaactcctggtttcaagtgatccactgcctcggcctcccaaaatgctaagattgcaggcttgacccaccgcgcctatactaatatctttatactgaatttaccctggtactctttaacctacgaaaggagaactaagctctttaccctagtactatttttaaaacagcacacctttcaggaaagttttcactctgagagaagccaaagtaaatggggggttggagggagagaaaaccaaagcaaaggaaaacaacacagagagcacagaagtacttctaaaaatctataaaataatattgtcagagatataggagaagatagtatatccatgaagcatgaacaggatgctgtaaaaaaaaaaaaaggaacagagtacagaaattgcttttaaaaaattaaaagtaggatagccaaaataaaaagtttcatagcgaggttggtgaacagagttgaggaaatcacccaaaaggtttaaaaataaaaaagtgagatgaaaaatagaagataaaagataagagaattggagagtcaatccaggatatttcataaagaaggaaaaaataaatgacaataaaaaaaatattaaaaaataattcaagcaactttccaagaactataggatatggatctccaagaatgaaaatatccaccaatgggcttttgatttacaatgagtttttttttttaatgccaagctttatcatcatgaaatcttagaacactggtgataaaagacttttctaagagcatcaagagagaaaaagcaaagttgaagtcaaattaacacatgacttctcaacagcaacagtggatactagaaaaccataaagcaatattgtcaaaattctgagtgagactagaatttatagccagccaaactatgaatcaagcataaaagaaaaataaggacatcttcagaccagcaaacccagaaagagcacaacatagctgcccaaaaatagtggatataatattgatgaaaagtcccagaagacaactgtgcaactggccaagaaagcagcctgttcagcaggctctgaaagggaggacatcaaggaaaagaagaaactggagtgagtgagtgcatggaaaatgttattgacagctacggaataaaacattggagcatttagaggaaatattaatggtgtcatagttatctagtaaatgaaaactaaggcaacttttaatactcagctaaacaattatactagaaaagaagcataattatattatttggcttgatagtgaataatagttgtgtagtaatatgatgtaaacattaactactaattttacttttttaaagtgtgatataagcatgtcgagaaactgatgaaactgaatgaggcaggaagagaactaaattcttatctactatgcctgtaatcccagcactttgggaggctgaggcaggagggtcacttgcggccaggagttcgagaccagccatggccaacatggtgaaacccaactctactaaaaatacaaaaaaattaaccaggcatggtggtgcatgcctataatcccagctactcagggagctgaggcatgagagtcctttgaacccgggaggcaaaggttgcagtgagccaagatcgcaccactgcactccagcctgagcaacaccaaaaacaaaaaagtcatgattaagtctaaaatcacaagaaatagtagtttaccaatattatttagaaaatagatgtaaataccaggaggacagctggaagaactaaaggtggtcacctatagagaatgggacttggaggtaggggtagttagaacagaggattatgagaattattcatattttacaattaggttgatttagtctagtaaatattaaaaataatatattttaagattaggaagaaatgaaggaggcagagagagaggagcgcaggaaagaaggacaatgtcttgatcctgtacctttccaaacacattcggattgctcacagagctgcatttttccattagcctgctgaaccacgttctgggttacaaagagttgttttaggcatttctgaaaataaacacacataaggagaatatttctttaaaaacatacatgtacaactaaaatgtaatgtataatatagaattacaactggtaattcactaaggagttcaaagattccacattgtcaaagccaacaccacaataatcgctattatttattaactaaacaatatattatgaacagtgctgagcattttacatatattatttctcaactatggagttcaacaactccatagagcaggtattttttggctagaataaaatctttttttactcttctagcctaaaaatctgtttagcctatacaccataggccagtgatatcagcaaagcctgccacagctgaatggccatcttaaggtccttttttgttaacaccttcacagagctcttaagtaactttactaaaattccatgtgcacaaaaatctgggtcccatccctttgggccaatatataaagagcccttctgacactcttacatccaacttcaatcaaaaacacctgggaaaattagtaataagtggaaagaaaaataactgttggaatttcctaaaaacatagtgataaatgattaaagcagagaagattctgttttgcttcttcacaataaaatatttgctctcccaaatatgacaaacactgtgtcaggttcagaactacgccaaaggtcatgttgaggtctggagggagtgggtggatgagcagaaagaacactttggggggccgtaggcaggtgaatgattttattcagcagcagctctcatcaacagctttcttacactagctctctacactgttcacctttatcttggctgcttaattgatgacccacacacacagctgcaagactggctctcccttgccttcagggtcagcagcttaacactttctttctctgggcacgagcaagccaagctgtgtcctggctcccctcatccatctgcaaagacagctctggctttctctttctccaggtgccagcttctgcacagtgtcaacagggcaattataccttttacggacaatagtggcttagagccaagtgatggccttcccggtgttataactatagtggtgagcttctctatgttgtgtctacatggctatgatgacaagtggagttatacgcctgtgctctatactcactgagtcacgaagaatgtaaacatcctacctcggcctatccttgaccaaagcacagccatgttccttacactctgggtccccacggttcagacagaagtctctctgacagacaacattttggtattttgtttttcttccttgatgttatgtcacataattggcattgctgtcaatgaatcgtggtttttagttattcaaggtagaacaactaactagaaagcagggtttcccaatcttggcactatgggcaacaattcattgttgtgggagctgttctgtgcattgtaggatgtttagcagtaacccaggccttcacccacaagatgctctccccctgagttgtaacaatgaaatgtctttagatattgccaaatgccccttggtgagtaaaatcaccctgagttgagaaccgttagtataaaataatattcctaaaatggcctgctcatcagtagttcaatgaactcttcacagactcacttctttagaatcccacagttaccacaaagctgatcacagcaaggtttagcaggcgcttctgttctgtgggtgcaggggtgctctttcctagatgagatcgacttactactttaatcagcaacttaatatggagctcctggaagatgaattctgaaagtctccacggctatgcaggccctcgttgtggaaacaccctccagatgatcagtgaggaccacatgaagacacacgtttactctacaggggaaagacctcgctttgagtcttcaccactctcgatgctatttgacttctaactaatcatgacaaaaaatgctctccttaacaccatagaacagcttccattatcccctgcccaggttcttcagtgatgctgggatgatgttccagctggtataacaattgctaaggagtatcttgccaacaccatcatgagcccacagatggagccactaaccttgctgccaccagttaccagaaaggataagaggaaggaaaaggaagtcttaaggggtagggcagcaaaaactccaatcagcagtagagggtggaaaacacaggagtgtcaataatctggcccatgtttgaggccaccagtgcaccctaattatctcagtaggactccccggccattccctatcccccaaacccatatccaacaataaagcacacatcaaaatacctgctctaaaacattcacttccaattgcatatgagttcagataactaaaatttatatgaacaatattttattattcttctagcaaaatagccaagcacagaaaaaggcatacactgaataagtaattttgcctaaattgagaatttatgacttttctagttcaaagctttcgaactgaaatatggattccttcaaagactcttcattggatttgataaattcaaaaacatgctgttgatatttaatgtgcccaaaagatttacgtcagactcctaagatcttaaaactataataaataaaagatacctaaatgtaataaatgtacttaaccaagaaaaaaacaaacaacaagaaaggcttaagggaaatatttaaaagaccatcatatagagcaataattcaacttttcctaagagaccccaaaggacagatcacatcatcaaatagttggaaatgatgacagcaagagatccttaggctaagaggaagcataccgtaataagtataatttcattatatttttaacctttacctgtttgtaaagataaaatagttattctcattttcacttttttaattaatcccaactcaacattttctcatatatttgggggatatcttctttcttttacaaagtggctctattcatatccttcaattattcattttttatcaggaatgcatcattttcttattgattggtaagagaactaagcaactcttcccttacatttgcaactaagttgtctcagcttctctagatgtgggatcttcagtttttttctctttacctacctgcccttttgaggcaacactttctttccagtctctgtccattgcatgaggtgccttgcaaaaatggagagcagagttacttgtttcagaaattcctttgctgggggtcttcagttgttctttgcgggatcctacaagaaagacatttatctttgaatttggtttttaaaacaagataatcactttgattgtaggtctggctgtggcatctttcacagaaggacagagtgaaaaagcccaggctctcgtcactccaaagtccattgcagagagcaggacagagtgaaaaagcccaggctctcgtcgctccaaagtccattgcagagagcagtacagaatcctatccagactgctgacttcataaggttgtcactcaatgagaaagctgtctcagtggcctctagagcagggaagaggtgccaagattaaagacctgacttcatttgctgcagcagcagtgtgaatgctttatctctgtatggaaaaaaaaaaaaaaaaaccagatttgcacatttgaagaatggatagaaacagttccatagttttaaatgatagtggaaagagtatctggtttgcccgagctatggtcatcctgcaaggaaaacattatgggatgcttgctttgccagcattgacattcactacataatcatgagcaaatcactttgcctctctccccctttctattgcagaaagatgttttaaagatagtttaagatggcatcagtgaaatactttctaagttaaagtaatagaagggtcaatgttacttgcatcaatattattcctatctactctcttctcaagattgagaaagccctttaccagactttcaactgccctggaaacctgtcaagtcattctctaaaactaaatatctgccatatcacttgttcatcacaggagccaagggaccattggaaaatcttagccttttgccatgtgacaatctcttcttcatttggacaaccatgagcttgataaattctcactaatgttcctagagcctagtaccttaagtactgggacattcaaaatttaagcaatatatattacatttagggagaagaaggataaaaatatgaaatgctggtcaaagttttagatcttgctctttgtcctgagaaattatgcatgcttgctttcttgtgctatttgtaaaagtgtacaggggagaaaaagccagctctcagaacttcaaatgagaaagaaaaagttgcagtcagaggctagtactgacaatcatcacagttatatacaaagaggtcaggtccatcagcctaagaaagaagggacctctcaggttctgtccacagagcatgactgaaaatgaacctctctgtaaatgtccctttggaatgggaggatcttcagtatctgctcttctaaaacaaaaagaaagaaaccccactagcaaagcactgagaaaccagtagatctgattaatccctagtattaacttcagtagaaaataaaatggtctttcttgtaaaatcctttttgttaatatctgatttctgaatttctcacacaatgtcatacttttttaaaaaatcaataaattaattaagaacctagaaagtaaaagggagcccctaattttagccagaaattcttccaaaaacaatcagcatcaaaactgtccctcaattgcaatgagatacaaaagatttctttcagaagatagtcataacaatgtttttcacaaccctttatctcctactgcttccctcctcggttattaaatactttcagtattaaagcctgtcgttacatgggaatttcattgatttgaaaaaaatctgggctccctttcaatctgcagaactgcaatgcatcatcatgtctgatgtcattgaaaagagttggcacttctattaacatttgtcttaataaatacgctgatagtcaaaagaattatgttgcctaggattctcaaaagaaagaatgggaattacatcagctgatgataggtggcaaattttgcttctgaaggatgggaatgaaaatgtctgtgcccaaatgagaattacatatttcagaaagagagtttgtgtttcggggctctggcaggttgatcatggatcctgcccatcacactggtggtttggagcccactcccccatctctgccccaacataggcatcagactgtctctcactctcctttccttccctcttcttcttccctactactcttggaggttcttctttcttctttcttcctcctcctcctcctctgtctcctcctctcttctctctttctctttgtctctctccccccatccatcccctcatccctctctcttgcttccttcctcttactttctcttcctctcattctctcctgcttctgtctttttcttccatttcacatctgattattccattactaacgcataattttttctgactctgtataccagtaaccttaccagtcattaaaattctatactttgcaaaacaaaagcacatatatatgtgtgtatgtgtacatatacatatatacatatacattcatacaatctttacaaaagtaatcatctaaccaatgcaagtctcaaaaacatattaaaattaagctaaattttgcctgaggatgtaggatgagtccctacatctcaaactgcaacctaacttgggatgtaaactaactgaaagcctaacttagctgagtctccgccaatcacagaagctgagcttcagtcaatcacaggcggccaactaatcagaccacgtgcaaataaggcgaactgagctgtagccaatcaggccggctcctacgcacttccaattcctatccataaatgctgcccgcccccacatggagtggctctctggttgcccattggccaacggttctttgcacaattaactttgtaaaatttaatttgtctaaagttttgtttttgtttttgtttttaaacacatacagtacctttcctttgtttttgtgtcatttctccccaccttggaaatttcttattcaaagggagaaaaagagaaaagagttgactcaaagtgacactccttagttctacaagacaaagattctctcaggaatatatcttttattcacgttgcaaaacggggctgtggcgtttggggcacctcacctagagtcaaggtctctttctcaggcggtgtcttcagcactgatccggaagcttctgggaggtaggtggttgactgctcttccccaaaggaatcagaggacagagccctagtttgactttgctgccaccttgtggtaatggggctactcgcaacaggaacctctgcggacagcctcttcgcaaagttgctcttaaagtcagaatacgtagcattaactgaatcgagtacctgtttaacaacaaaaacagctgtaagtccactggcctcagtgatgcaaaagtaaaaattccctataagagaattacaaatgactcatctagtacaacaccaataaaatatatataatgagatttttttaatttttgtaacctagatattattttatatatttgtatatatttttgtatatagttatacgtaaaatgttatattttatagttacatattatataaacataaatatgttatgttttatatatttatatattatataaacataaatatgttgttttatatatttatatattatataaacataaatatgttgttttatatatttatatattatataaacataaatatgttatgttttatatatttatatattatataaacataaatatgttatgttttatatatttatatattatataaacataaatatgttatgttttatatatttatatattatataaacataagtatgttgttttatatatttatatattatataaacataagtatgttatgttttatatatttatatttatatataaaatatgttatattttatatatttttatattgatatttatatacaaaagttatattttatgtttatatttataaaacatgttattttatatgtatttatatataaaaatgttacgtatttttatatatttatgtgtaaactgttacatttttatatgtatttatgtgtaaaatgttatttttttatgtttatatgtgaaatatattattttatatgtaaaatagatatatatttcttctatctaaaaaacaccaaaatgccactacttacttagagcctctgctcaagggtctgtaggtataccaatgtagtttagggagtaattacatttataaatattaccattacatatcagtgtaaaatatgacatatgatataacactatgtactgaacatgcaagatgtttgtatgaaatgataaaatttcaaatctggatataaacagcaattttctagtccaaacccttcatttcacagatggggaagctgaggcctagagaaagtaagtgatttgctcaacatctgtccatcttctctaagaaacaccaggagtttgatatttatagagcctgtagtagtgaaccatcccatgtagccatgtgaaattaaaatgcaagtgacaaactggaattatcttttaataaaatgacagacaatttagattaaaatcctagtcataaagagctcttatagaaattgacaagtttaccaactcaacagaaaaactgggccataggacattaaaaagacaattcataaaagagatatataaatgcccaaaagatatttaatctcactagcaatcaaagaaatgcaaatttaaaacagcaatgagatgttagcaataatttttttgtgacaatccctggtgttgaaggtgccaaaaacaaacactggcatacactgctgtggaggttaaattagtatctggaaaggacttttggacaatgtgcgtcaaaagccttcatatatgtgcataacttctactgacccagcaatatcacctctaagaatttaaaaaagaaatcagccggccgtggcggctcatgcttgaaatcgtagctctttgtgaggctgaggcaggcagattgcttgagcccaggtgttcgggaccagcctgggcaacaagacaaaaccctgtctctacaaaaaatacaagaatgagttgagcgtggtggtgtgtacttgtagtcctagctacttgatggggctgaggcaggaggattgcttgctgcagtgagccgcattggcgctgctgcactccagcctgggcgacaaagtgagaccctgtctcaaaataaaaacaaaaaaagaaaaaagaaatctaagatatgagccaagatggagaaaacatccagcatttattgagtagttactatgtatgaaaccatatgtacagggttttacacgtttgtatttaatcctaagaaacatctgtgaagcagatcttatttacgcccattttatcagtgaagaaactgaggcttagaggtcaagtgaattgtccaagactacacagtaagtggcgatgccacacctgaggctcacctgtctgaccccagagtccaggctctcaactgagaacatgagggtgtgtactgcattttacatgtttgtaagtacaaaaagatgtgagacagagactaagtgtttaccagtggagaactgactaggcaaactaacaggacatctctaagagggactgctctgctgccatcagaaatgacatacattagggaaatgtaaactaaaccacaccaaagcaccacttcacacccacgaggatggctagaatttttttaatggaaactaataagcattggtaaggatgcgaagaaactggaatctttgtacattgcaagtgtacagaatgtgaaaggatgcagtcattgtggaagattagtttggtgatacctcaaaaagataaacctagaattaccacatgaccaagcaagtccactcataggtatatgtactcaaactcaaattcatgtgcacatatgttcatagtagcactaatcacaataagaaggtgcagacaacccaaacactcatcaacagatgaatgcataaacaaatcatgggacgtatctacatatgcaagtgatctacatatcactcccaagaggaatgagttgctgatacatgtcataatctgcataagccttgaaagcattatgctaagtgaaagaagccagacaggaaaggtcacatattgtgtgattccatctatatgaaatagtcagcacaggaaaatccataggcggagaacacagattggtcattgtcagggattaggggaggaggaaatggggagcaactgcttaatgggtatggagttttcttttgaggtgatgaaaacattttggaacaagagagaagtggtggttccagaacattggaaatacactaaagaccactgaattggtgacttaaaaggttatttttggccaggtgcagtggctcacacctgtaatcccaacactttgggagactgaggtgagttaatcacctgaggtcaggagttcaagaccagcctgaccaatatgatgaaaccccatctctactaaaaatacaaaaattagccagccgtggtggcatgtgcctgtaatcccagctacttgggaggctgacaagagaatcgcttgaacccaggaggcagaggttgcagtgagccgagatcgcaccattgcactccagcctgggcaacaagagtgaaaccccgtctcaaaaaaataaataaaaaattaaaaaataaaggtttttttaaatatgtgcatttcacttcaataaaagaaatctttttaaaaatggtaacataggataatagtgaataaaacatgcaaatgcttacaatatattgctagctgtaaaacagggactataaaagagtattccaatacagtcctacttcctagctctaaatgaaagataggaagggaatatgctagaatgttgaagcagtaagcattggttcagtttgggttttttactaagcgtgtgtgagggtgctggcccaccctgcctgcagcccccagggggcgaggccggctctctctccactgctgctctgtgctctccccaccagctgaccaaagagaacttctttcgcagaagacaggagccaagaggctgaggccacagctgttgtaaagtgttgttgggggtcagtttttctgtcttgtagttcttggtttttgagtaggaatgggaaggatgaaaagaggctgtacatgtcaatcaggcatctcaatctcagaaaccttgactagggggcagcaggtaaggtgatgagtaatgccagcctggatgagaagcatggcccactctggccttcttttttgttttgctttgttattttgaggcagtctcactctgtcacctaggctggagtgcagcggcacaatcatggctcaccgcagtctcgacctcccagagctcaagcgatcctcctgcctcaagctcaccagtagctgggactacaggtgtgcaccaccacacctggctaatttttgtgttttttggagagacggggtttcaccatgttgcccaggctggtctttaactcctgggctcaagcaatactcccacctaagcccccaaaagtgctaggattacaagtatgaggcccctcacagggccactcgaactttcatttccccacttttttatttctctccgctaagaaaaaaaccgcagtaccagctcagaggctttggggtctcagccccagaaactgagggaatctctcaaactttaatgcttgtgttttagccacagcaagaacacattgagacacatcgtctcatttcataaaagatattagaaatttagacttttcatatgaattttcccactttttaaagtgttcaactgattctaatttttcaaaaagactggaggactcaacagagcatgtctgtgggccacattcagtgggctacatttgcaacggctccactatgtccaggtagcccttaccctcacaggtaccaagaaagggaggagacaccgcattggaagataaacttagtttgcagaaaacatggcagaggacagagacacttgctcaaaagtttccttagagcaaaattccaaagaaattctaaactttaaatatacatttttaaaattctgggtttaaaagaggaaattaaagaataataattggatgctatgtcagctatgtctgcgaaaacaacatgagaagttgcacgttaacaatatcctaccgccttagcaggtctgagtttctgtgattcgtctaccgtcactctgtccaccccaaatgtttcccacttaggatgttcatccccagttttctgccagggtaaatcccagccaccttcacttctgggttcagccatcaactccttcaggaaggtgtctctgacattcccttcctcccgattccaaactagattaggcagccaatggtagctaaataatggtccctagagagatccagatcctaacccctggaacctataaatgttacttcatatggcaaaggggctatgcagatgtaagttcaggatgaagttaagttgaggtgaggagactattgtgaattgtcaggatgagccctaaatgcaatcacatgtatccctgtaagaggaaggcagagggagatgtgactgcacacagaaaaggagcagcaatgtgaccaaagaggcagtgaccggagtgatagggccacaggccaagaaatgctggcagtcaccagaaaccagaagaggcaaggaatggattctccactagagcctctggaggaggccaggccctgctgacaccccagcttctgcccaatgaaactgagtttggacctctggcctccgtaactagaagagaatatgtgtgtctaagctacaaagtttctggtaatttgttgcagcagccctagggaacaaatactcagccctgtgcttccacactcactgtgcatgctccagcatgaccaccttgtgctaataacatttaccaaacacttaatccgtgccaagccctgggatatatgaatcggagggagtgtctattttagtttcatcacaaccctctgaaataggtactagtattatttcagaatacagagttggaagacaaatcttaatggggttaggtaattttagcaaggatatagagctaataggcagctgtacactacatacagctgtatagatcattgtctctatgaatggcaccctctggaatatgcagtgcacaaccctcacaaccaaccagagcaaccctgccacagtttgaactctgacaaatcaatctagtctaatccctatgctaaaaagcaggtctgctcatattccacttttttactttctctcctgctatatcatacactccttaagaccagggactttgtcttttatcttactatcctcgggacattggtatctagaaaccccataatgaataaatagatgaatctcttcccctagaggcagttagtactaaaaaggcacaaggcatttgagaaagaatccagaggcaaggaaataagctgttttcatccttctccattaaggagaacaattctcagggcaggcacggtggctcacgcttataatcccagcacttggggaggccaaggcaggtggatggcttgagctcaggagttcaagaccagcctcgacaatgtggcgaaaccccatctgaacaaaaaatacaaaaattagctgggcacggtggtgtgtgcctatagtcccagctgctcaggagactgaggtgggaggatggcttgagcccagaaggcagaggttgcagtgagccaagatcgtgctactgctctccaacctgggcgatatagccagaccttgtctcataaaaaaaaaaaaaaaaaaaaaaagaacaattttcaaattgtacagagtaaaataaacatttctgcagaaattagagaatgagataaatgaaacaacaaaagtgtatctgggcttttaaaacaagttcaagtctgtagggccaaataaataaaacccagagtaatgacagcactttcagaaccaatacttgttagtgatctatgagcaaaacatgacaaataagaaaaatacatgccccctgatagatatatgtattatttttcatggttctccaataggagaagcaagtaactagtaataaatttgctgccagtgtcctagatggcacaagtcagcagatccacgttagcctgaataaatccccccggggtggactgaaggtttagtctctggccttctgctattcaacttgttatcagcagcttgaatggagatttatttatcaaaattgttgattactctaagctgaaaatatagttaaaatactaaaggacagaatagaattcagaataaagtctgggacaagggccaaagcagcaaaatttaattcaataaagttgcatgaacaatattcttatttagattttttttcttcattgcacaggcataagatggaagagaatcaacatgcagtgaaaaagattggcagtgttaggcagaccccactacaatatgagcaaacagtatggtgaaattattgtaaaaaatcagtacgattttaggtcccattaacagaaaaatagtgtccagaacaggagcaatctaaactctgtgtctctgcaccgctcagaacacatctggagaaccacgtccagtcccagaactgttcttcaagaagggagatggacaagtcaggattcgaaccctgagttcatttggaggaaagagaccacagtgacaggggtcaaggtaaacaccgtaatgggacaacaccccagcacatccaagggtggaaacctggggtgcttagtctaggagaaagaagattcaaaagggtctggcgcagtggcttacacctgtactctaagcattttggggggccagtgcagagggggaatcacttgaggccaggagttccagaccaggctgggcaagtgagaccccatctctaaaataaaaatcaaaaaactagctgggcatggtggcacgcacctgtggcccagctacttgggaggctaaggtgggaggattgcttgatcctgggaggtcgacgctgcagtgagccatgatcatgccactgcactgcagcctgggtgacagagtgagaccgtgtctcccaagaaaaaagaaaaaagaggaaaacccaaaaggaactgtcttcaaatatttaaagggatgcaatttatgaataaaagaaaaacttactttatattgctccctgtgatacaaccaggacccatgaaggggtagattcaattcagagaactttgaaagagagcacagtttgaatataaagtaaaattctctcagtccctgcactagggacatatggttcatagtggtatagatgaacactaataattatgtatttaatgtcattttataatttttcaggtttgatgtaaagttttccttagaaaaattaattttagaaaaataaattgtatttaaatactcatttgttagtatgagtattaaaatgttaagcaaataaacgatatacagatatggcaaaatcacagaggtggtactccttcaatgactgcagtgaaggaaacactgctgcagattgtgctatttcatcttcagtatttttaaacttctgttccaggatctatctcctgccaaggaaatgcctgtcgcatagttttgaatgactcaagtatttattaatagaaaggaagaggaagataagaaaagtaagacaaagaagggaaaagggatgaatgactcggtactccaagcacatcagttcagcttgtttacctgtagagttcacatcatagtgacattaaaccaggaggaattcagagcaccagtgccaaaaataattagaaaaggacccagaggggttaaaaataaggtcaggaagtagcagaatgaaacaactgagaaaatagaaacaaatatgtctactgacaaataatttgacacacaaatatccagtgggttggaaaaacctagacatcccagaaaagacctgctggcgatgctagtcttgctagaacctcaagagaaagataaaagtagcaaagacagcccaggtagctctgaagcataccccaaccccgttccttaacctctgagtgtgtgccgctcccacccaccaccagcccaatgcagcagcattctgtccacaagatgtttcaaatgtagggtctcaatactatttcaaattagtcatgaagaccaaaatgttcatcgtctcatgtttgaactttcaacgccctcccatcctagtaggcaatatgacccacacactgtcaaggtcattttcaggtaaacatcatcctttatctctatcgccagcagctgcccgcagggtctacagagcatctttagcacccacccccttccttccatcatgctggccaaggctaccttcactaagactcttcgcctatcatctggacctgctgctctgcagacctcccgtggccccttccagataacttcagtacacacagaaaagccttttggtggtgttctccatgccttcccctttctgggcgcttatacagtgatttcttataaaacaaaatgcctcctcacgaatgaaaccccttgtattagtctgttctcatgctgctaataaagacatacctgaggctgggtaatttataaaggaaagagatttaatggactcacagttccacatggctagggagtcctcacaatcatggcagaaggtgaatgaggagcaaaggcatgtcttacatggcagcaggcaaaagcttgtgctgaagaactcccatttataaaaccatcagatctcgtgagacttattcactaccacaagaacagtataggggtaactacccccatgatttagttatctccatctggccccacccttcatatgtggggattattacaattcaaggtgagatttgggtggggacacagccaaaccatatgacccctccaccagagtactacagccatctcacctacaatgttttcttctaaataaatttattcacctattacacagaaacagtttcatgaagttgaaataattttggttatgaagtcgaaagttcaaaactctattcttcattgttccattcactaattctgtgatcttggctgagttaactgctccctatttcaaagaattactgtgaagaaggtaatgtgtctactaaagaagattgtgtgcagtataaagctctctaaaaacataagtcactggccaggcatggtggctcatgcctgtaatcccagcactttgtgaggccgaggcgggcagctcacgagatcaggagttcatgaccagcctgactaatatggtgaaaccccatcactactaaaaatacaaaaattagccgggcattttggcgcgtgcctgtagtcccagctactcgggaggctgaggccggagaatcactcaaacccaagagatggaggttgcagtgagccgaggttgcaccactgcactccagtctagccgacagagtgagattctgtctcaaaaaataataataataaataaaaaaataagtcatttatttagcactcagttatttactgccttgtaatccttccgtttcttgtgtgttctcatatttccaaaattgcttttacagttgcatgaggctggctccttcccttgcaccttatttgtatcctttccagtgcttgagttggttgataactgagtcaactactttatgcccttcttgacccagtagcttcctcttgccttcatcatgaactcatcaatctcttctcctcctatagaagccttccttcatttactgaaagagcgctggtggtttttctaacatactaccccttatgcagagaaatgtgccattttgatatatgtatagtctgagaatagagttagtatagacagaacatgaaaacaataatggtggatccccagaaggctgagagatgatgacatcaaaatgtgtgcagagaaagactgccaaaacaacaaagaagaggtgtgacagggccaaaatctgtgttcatccaatgctgtccagcgcacaagttctccaaagtgctgtctgaatgtttggttaatgggtcagtatgaaaatttatatatcatgccttcattatttgaagctcttaagccttaggaacattaaattaacaaactggctctgatttcatccttgacaggagatatacacgtaagttttcaaagttgtattcatataatatggaattttgtggtgaaaccaacctcaacatcaggcctgcataatgttttatttctggtgtaaaaactggcttattcagcaatcacaagcaagtttgtaacagcataattttggcattttcaaatccattcatctctggatcacttgataagagtttctgtacttataatacaatggactagaaactatcacagtgattttatcaaaataatatcaccctagggggccctgcctaagcggtggtcagtcaacatccctgccaaagataaatcactctctttccacctcaaaacacagttataatgacttgggtttacacggctcaaattacagcaggtattctatgaattaattttaaaatgcatgttcctaagccatttgcttgtacagcctgaggagttaaaatatctcgtgtattcatagagacatgaacacatccactatggaaaacaaagacaaaccaaagactcttgttgctctgaaaccaaaaaaagtttgaggtctaaaggttctcaaacttaaacgtgtgtatgtgtcatgaggagatcctgtaaaagtacagattctgactcgggaagtctggggtggggcccaaaatgctgtgtttctaacaaatgcccaggtgatggtactgtggaaggtcccagatcccacttagagagcaaggccagagagcttaagcaacatagcagtgttcatgtcatataaacacagggactttgactttttaaacaattcagccagagaacaccaaagtaaaattatcaggaagtgatacaacacatcttacatacatttttgttctttactaggaattatgtttaaaagggaatactttctgcataatcattgctttttctactgtatccattcttactgagccatgagagtaggagtcgagcggttcctctcacaagttttacacagtaggctatgggctttgctcagccacccgaaaacacacatgccacagagcgggaaccagaagagcaggcagcaccctgagcaccctctctgaagctccacaagctaacagtgacaggaagggcactccacaaacatctcagctcattccctgcactttctggaaacacatcatgatcaaatggcataatgccccttcatccagatcttgccatgagtcttaaacagagcagaattgaaagtgaatggcttttaggatatacagccctcaattgcctccccatacctacccctaaaattcatgaccgttagcaacagcaaagttaggccccctgtgccaggcaacagccaggggagggaaataaagagaaaaaacgaagcaattagatgacgtgcccaagtagaggtgggttttgcagggtttgtttgttttcagggattttttttggtagaattgccttatttaactgttaaattactactttattatcgagttcaatttttgcttttttccctcttcttcttttgttctgattttaagatagtctcactctgtcacccaggctgcagtctacaaacacgactcactgcagcctcaacctcctgggatcaagcgatcctcccacctttgccacctgtataactgggaccacagccatgcaccaccacaaccagctaattaaaattcttttttagagacaggggtatcgctttcttgcccaagttggtcttgaactcatgggctcaagtgatcctcccatctaggcctcccaaagtgctgggattacaggcgtgagccaccatgcccggcctcagttttttccatctacaggttgtagtgcatcggtgaatgatgaaatcattttgataggtcagaactgggttgtttaaaaatgcaacaggtgggggtgcatcacagttcaaaggagaagtgttgtttctcagttgtgtgttgtttgtacccagttatgttgtaaagtgcactgctgactgggggtcatgagtagaaatttgaaaaacactggactatagtttgctctatgatagagaagggtttcttttaacaccttcactgtttttaacatatttattttgactgtattcacttggtatttgattgccttagctagatgaatcagggtaaatagcctttttcagatatttccctgctctttccactataaatttcctgaactcatatagcatgtttaacccatacatgtaatagtaacgtccttcagggtatacaccatatgagtaggtcacatttaatctacattctaaactattgctgagcatcgtactccatcctctgcatccaaacagttgctcaataaatacacagcttagcatggggaatgagccctccgtagctttcgagttacaagagcaccatcttctggcgaaatattttctttgtagggagaatgtcaaagacctaccaaaaatgtcctgatttttctagcaaaaattataattacatcacaaatactttgaaattctgtagagctccttgcttcattcaggagtttcgcttcatttcccctctgagaagtggtctttctgttccttagcagtgaaagcagtcagcctgtccttcctggttttccgttaaactaagccggtttcaagtttcagctcctccttgaattccaggctgctgagacttccctctagaatcctccaacatggagcctcttgcagcttacccgctaaaatgttccgggcccagagcaaaggtatttgcagttttgctgtctatagttctatgcacagtaacgctatttcttctacaactaaaattcctcaaacctaaaatcaacagcttttatgcctttgaagtgaaggatgcaaaaggaagaactgtttctctggaaaagtataaaggcaaagtaagttgcatcatctgatttttattgttatcatttttccttgtctctgtttattcctcttaataaaatcaattttttgctgttacatggtcataagttggaatttagtcttcagagtaatggtattagtacatcactttagttattacagttctgatagtttgcttctaaataataaattccgattatctcgttttctttaaaatgctttaattttgtgctgaattgacatgtaaagttgtttggaaaatacttatagttagtaatgtgaacatgatgacatttattaataaaagtattggttctataatctaataactttaaaaagaacttatcaaggatcatagttttatctttaatttaaaaataaactttcatgagtatctaatgcttttttaatggcagtactatttcagggccttaacccaggcatctaggttacagttttcaatagaactgtgtatgtccaaaaatatgaaaaaaacatcaatcagaggttatagtcccccccaaattgtttaggattttaactacttgcagaattttttaaaatcttttgcttcactttccggttggatttttttctttttccgggaggtttcactagttgtaaacgtggccagtgactgccaactcacagacagaaattacttagggctgaaggaactgcacaaagagtttggaccatcccacttcagcgtgttggcttttccctgcaatcagtttggagaatcggagccccgcccaagcaaggaagtagaatcttttgcaagaaaaaactacggagtaactttccccatcttccacaagattaagattctaggatctgaaggagaacctgcatttagatttcttgttggtaaatatctgccttgcatatgctgttttaaattgcttttcatttttaaacaattataccaggacaatactttcctatttcatttgaaacgttgtatcgggaaagcttcataaaactatcatcaaagagccagaatctcatcctttgtaacttctaggagttatgctcccctgaaatcaatgttttagcttcttagatggtaaaagaattctattccaatatattttattccttattaccatcttcctgaagaatttacttaaagtgtgcccatggctattttcacaaaatatcttaattctcctctcttgtaactagcatctggagaaatgtcccttcccgtcattatagccacacagctctcatgaatagtgctgggcattattagttaacatatgtttgtggctaattttatgttgtctttcttatctgaaacaatattctcaaagatgaatatgtcagcttaccagatttttgctaaaatccaaaaacatataacttggttttttcagagggcagtagtgttaggctatttctccaattaagctagctacagaaatctgtttaaagacttgccaaggtcacttagcacaaaggtcatgaggcatacagacagcataggctttggcctcaagctacctgggttcaaacccctgctcttttgtttttgctatgtggcttcttaacttctctgtgcctgtttctcatttgtaaaatgggctatcaatagtaccgccttcttaagattgtttggaattaagtctgttaatagtaaaaataaagtacttatacactgcttgctctgtgccagacactgttctaaaccatattagtcaaaaaaaaaaaaaaaaaaaaaaaggccgggcgcggtggctcacgcctgtaatcccagcactttaggaggccgaggcaggcagatcacttaaggtcaggagttagagactagcctggccaatatggtgaaaccccatctctattaatagtacaaaaattagccaggtgtggtggtgggcacctgtaatcccagctattcaggaggctgaggcaggagaatcgcttgaacccagaggcagaggttgcagtgagctgaaatcgcgctactgcactccagcctgggcgacagagcaagcctgcatcttaaataaataaataaaggacattagctaatgttctctcatctaacttattctgatgacatcttcagtcctattttcactgtaaataagttgagttttgatcaaactattacctcactcaggcaatcaagcttctaatccaacaaaccaaatagtgatctataatatttcacataaatgtgaagtcagaatcttctaaaaacattatatttaatttctagggaaagttgatataatgcctaacgccataaatggcaaccacagtgaggtctttattcctcttattttgaaggtccactgaggaaagaaaagcccaagcacatgccattgaactaatcattcttcagttacagcagccagatacgtgggtgcaatagctcataggttatttctctttatcactacaaaccttctaaaacccttcttagcctgtgtaatcaaaaaggtaacagtgagttaaggtgtcattccacttagataggaaggatcatagagcccaaaggttaagagcatgagctctggagtaaaaggcccgtatatcaatcctggctcaaccactcattagccacgtgaccttgtgtctaggcttccatttatctcatctgcaaaacggggatgataataatacccacctcatagggtccctgtaagattaaaagagaggatcaatttgaagcacggagcgtacattaatctggcacatagtaagcacttcataaattttagttataattattatatttttcctcatgttagtcaataaaatgaacataaatcttgagtggtataaatagaaaaaaaatctacatttcttacataaattaagatttatcaaaaggatatcatggctgggcatggtagctcatgcatgtaatcccagcactttgggaggccaagacaggaggatcactttagtgcccaggagttcaagcccatcccgggcaacacagcgagaccctgccaaaaaaaaagttattgcttttcaaaataaggtgattattcactttgggaggccaaaaccctatctctactcaaaatacaaaaatttgcctggtgtggtggcacacacctgtaatcccagcaatttgggattacaactttgcttcattttttttggcttttaattttatttgacacagagtttcactcttgtcccccaggctggagggcagtggtgtggtctcagctcactgcaacctccacctcccaggttcaaatgattctactgtctcagcctcccgagtagctgggattacaggtgcacaccaccacacccggctaattttttgtatttttagtagagatggggtttcaccgtgttgggcaggctggtcttaaactcctgatcttaggtgatccacccgcctcagcctcccaaagtgctgggattacagactgagccacggctcccagcctactttgcttcatttcttgatactaagatcacatactagatgagtagactcataggtgaagtcatcaagtatattgaaatctggttactctaaccttgagtttcacttcgtttgggtgttttgttttttatattatgacagtcctagaacttgatactaaagttatcatttatgcagatactaatagaagtgaaaatcttgacaaagaataaaattatgctcatgaaaatatgttctggatattttagattcttcaaagaaggaaccaaggtggaatttttggaagtatcttgtcaaccctgagggtcaagttgtgaagttctggaagccagaggagcccattgaagtcatcaggcctgacatagcagctctggttagacaagtgatcataaaaaagaaagaggatctatgagaatgccattgcgtttctaatagaacagagaaatgtctccatgagggtttggtctcattttaaacattttttttttggagacagtgtctcactctgtcacccaggctggagtgcagtagtgcgttctcagctcattgcaacctctgcctttttaaacatgctattaaatgtggcaatgaaggatttttttttaatgttatcttgctattaagtggtaatgaatgttcccaggatgaggatgttacccaaagcaaaaatcaagagtagccaaagaatcaacatgaaatatattaactacttcctctgaccatactaaagaattcagaatacacagtgaccaatgtgcctcaatatcttattgttcaacttgacattttctaggactgtacttgatgaaaatgccaacacactagaccactctttggattcaagagcactgtgtatgactgaaatttctggaataactgtaaatggttatgttaatggaataaaacacaaatgttgaaaaatgtaaaatatatatacatagattcaaatccttatatatgtatgcttgttttgtgtacaggattttgttttttctttttaagtacaggttcctagtgttttactataactgtcactatgtatgtaactgacatatataaatagtcatttataaatgaccgtattataacatttgaaaaagtcttcatcattttcagtatttctctctgcattattttttagaagcaactcaaattctgtaatcataatattaccaagtaagtcagtctttatttttgcgtgaaaatcccaagtgtagaaaaaaggacatgagtataagatcatttaacttgattccttataggctgatttgggttgctaatgtattcgtactagattagccacttgggaggaattcaatgctgcatcattctgatagctgaaatagtaaaagtcaactccaaacagcctaaattctagtataaaaagggggtgatcatacaagtcctaaagtgtagatcagcagtcactgaacctcttagagtcacaaggcatttcttctcccaaagtcatgacctttatattttgttagccttataattgactaacaaagcaacctgccaagttggtgaaggttaattattgcctcatgaaatatacattcatcgcataaaagaattaaataggaagatggccaaaaatgtaaaaaagtcgtataaatttgtctaagaagaaaaagacccaatttaagtagtctgtgacttgactcccaaattctgacctgatggatgaaagtgaagatgtttcgtatggcaaattcagtaatgctacctcagtatatagttctgtatacgtatttggaccaaagttattagataaaccaaaaatatttcatgaagcatcttctgcttcagagtccatatccagccacccagctatgaatgtatttagaaagatatttggtggaggtggaatttctaccagaggtcaagaggatttgtagggatagcctcaagaatgccagatgagtgtgtcagaaagcctgctcctacctctcgccagctgcgtgactttaggcaagtcacttaagtaccttatttcagtttcctcacctgtaaattgaacaggggttgaatggaataaaaagccctttgcaactctaaaagtcaattaacacacttactaaggtgttttaagtgaccaggaaggaaatcagaactaacctggattgttagcgaagaaaacagaagccaccaacaagcctatctgtcctttgcaattttgctccaagagcctattagcaatttgaattctgagcctctaagaaaacttatgctcaggtggcccctccaagtgttggtgccagagcactcttgccttgtatcctcacctacgccttccatgaactcatagcagtgctgtggcactgcaggggtgttttatgcattcacgttaggagcatgagcagaactgcatatgccagcaccacatgggcagcagagactccccactgccagatggatgataatggagctgcactgggaacaaccaggactgtcccagtcaacatgatacagatgaacatcctgccttaagtcactagctctctccaaagccagataaagtgggtttcttcacttacatctctctaatcttggctgccttattcaacctacagactctatgtcagtgctggattttctccccttgccctttaggtaagcagagtaggcaggaggagatttgaaagcgtgtcatacatattgccttgaaagaaaggacattcaggtgtcccttcggggttctgtaacaattaggctatgtgtgctgagagagggagcggagtcatttgctgatgtgctgctacctgtaactcaaatgcctcataggaataccagcggacaaacacatagaggaaaagttgaatctttcctatattggacaatcttccttcagtcttgtttctgcatcaaaaagtctgggacacagagtgctacaggatgcctgggctaaggactgtaacagaaaaatatcaacatcagagcctggcacagtggctcacaccggtaatcccagcactttgggaggccgaggcgggtggatcacttcaggtcaggagttcgagaccatcctggccaacatggtgaaacccccatctctactaaaaatacaaaaattagccgggcacggtggcacatgcctgtaatcccagctacctgggaggctgagtcagaagaatcacttgaaaacaggaggctgaggttgcaatgagccaagattgcaccactgcactccaacctgggcaacagagcgagaccccatcttaaagaccctgtctcaaaaaagagagaaaaagaaaaagaaaaatatcaggcatcacatgaaagagtattcagctgtcgttcttgtgaaaaaggaaaaggacaaaatcaaatgcattttaactgtggtaactaattcactgacttgaagtttgctttgtttgttttctttggtgcgtagagaagaatacttcatactaactcctgatcatcttacagcagacataacaacagagtgttagagactggaataaatatgaatttggctgaaatgtgccctgaaagttgtatttcatttttttaaatgtttaacaattacactgtatcaatagtatatatacgtgtacatatatataattcttaataactgcagtgtatctagcatatatataatggtggctggtacatgtttaatagcagactctggaggaggaatcctgacatacagcatttgccagctcaatgtaaatgctcatgctccctcatggtcaatttcaatctaccactggtttagtaactaggatgcaaaatttctaaaaatgtgataattggtgatgggcatgatggctcaggcctgtaatatcagcactttaagcagctgaggtgggaggatcacttgagcccaggagttagagaccagcctggggcaacatggcaaaaccctgtctccacaaaaaaaatcaaaaaattagctgggtgtagtggcacatgcctcaggtcccagctacataggaggctgaggtggaaggattgcttgagcccaaagaggtcaaggctgcagtgagccgacatggctccactgaactccaggctgggcaacagagcgagaccccatctctacaaaaaaaatttttaaattagccaggtgcggtagcacacacctgtggttccagctactcaggaggctgaggtgagaggattgcttaagcccaggaggtagaggctgtagtgagccatgattgcaccacattgatttgtggtgttcctttgaaagaaaaatgacatgtttgggtggagctgatatgaggacactctatccatatttagtcctctgcttgattttatctttcccatcaaataaaattctaataattgttaggcctagaaactaatccaccacactccttcccactcttcccttcccctcatccagctgaactgttaaggctgtctcttgcagagcagtgcaggggaataaaaagcagcagagagagagaaattaggaagctatcactataatagtgacaggttcagagggcagcgatgggaagtagtgacattcccagcaccagtgaacagccaagagactgccccaagagaaaacacctgggagaaaatactttgccatcagcagaacctccctcctctttttaccatcccttttccctctgcttgacccttgacatcccagtgtgtatccctttctttccctctcccacctatggaaacattttctcttttaatttgtatcttcactttcctcctaacccattcatctctttaacatattttttatttctttaacatatttttatttcattccattccttccctcttttctcatcatctcgataatatgagactaaaccacaactttaaatgtcttctgtttattgaatataaagttggtttccctacagaatcaaaagttctaaaaaagaaaacttaaaaaaatttaagttggcattttcagaaacagaaaatcaattacggcatgttcctcacttctaagtgggagctaaacaatgggtacacatggacatgaagatggaaacagtagacactggggactccagaaggggtagaaggaaggaatacaaggactgaaaaactatctattgggtacaatgttcactatttgggtgataggttcactagaagcccaaaccccagcatcgcctattatatttatgtaacaaacctgcacatgtaccccctggatctaaaataaaataaagttggcattttatatcttgctctttaatttaaaaaaactaacacacaaaagccaaagcttctaaatttagtaggttttatttttatcactaggtcagtgattctttatagaaaataacatgttgaaatttaaccttaaaaaaagacaagatgaaaataatatttacatggaagatatacttaaacataaatctcctgaaagtgaataacactgggcaacatcaaaaagaggatgtgatttgaaagtagtaaaatgcgtaagaatcaaattatagatatctatttaacccatgttctagaaatatgtttaaataaggaaagcataaaaattattttaccaataacttataatccagtacagtagagaatgcgaaatatttcttatatctcatctatggcttaactaactgatggcaccaccaaagtcagttccactgactggctgcaaatgtccgcacaagaatactgcatgtctggaagccagcacatatctatgctacttcgtgggtcaaaatgcctccaaggtaatgagaatatatttaaggtcatattgtatggtcagttcttcccacttcacaagttgttagatctcatgctgtcttccaaatatttcatgaacctgtgattttacagaaaatgaagtgaaaggattgaggtagatcttccaaaaaaatgtaaaccatcccccacccaaaaaaaatccccaatattcttgatatttcaagtgaaaaatgttttagttgactgactcatctggaaaattacctcaactttcccttcagttggtacacacacagtcatggctatagaaaccaattctaatgctgtatttagaaactaatgatgcagaggccgggcgcagtggctcacgcctgtaatcccagcactttgggaggccgaggcgggtggatcacgaggtcaggagatcgagaccatcccagctaacacggtgaaaccccgtctctactaaaaatacaaaaaaattagccgggcatggtagcaggcgcctgtagtcccagctactccagaggctgaggcaggagaatggcgtgaacccgggaggcggagcttgcagtgagccgagatcgcgccactgtactccagcctgggcgacaaagcgagactccgtctcaaaaaaaaaaaagaaagaaactaataatgcagaaagaatcctaaagacttcactgaaaatctggggacacattgtaggtccattccacattgttattacattctaaaccttatagttaaaaacatgtaatttcataaatacttaaacactgtctactccgaaagactccaaagactccaaaaatatttcttaaaaatttttagttatggaaaagcaggcataagtaaatttttcttaaaaggaaaaaatttaagtaattgtaatactttccttaccattataaaactgtgcattgtaagtattactgtattataagctaatggcaataatatattatggtaaatagtggcttgcttcatagcagaaagtacacataaacacacactaattacagattcagttacactctgatgttcattgtatatgcaataagacagcagttgcatgttagccgatgccattcacatattcaaccagctaacaatacactgccagctcatcacacacaggtatccagagcacttcattgacaagaagaatttatccagaagcaagtggcagggtagttgtggctgctgacttgacccaagcagccagctaacaatacactgcctacctgattcaggtcactgccgattctcgtggcccaggcagtcactgaggctaaatttgtaacatgaaacatagtggcagaactctaatcttaatagtcacattaaagaaaacttatacacaaaatgtattacttcaagactataagaaataaaatcaatatttgcttgaatctagtcaaaaacataaaagttaaacaaaaactttaaaactttcagaatacttacatttaggttttccaaattaaatgcttggataaaaatatgttctacagtacaaatgaattttaaaagttacttaactgtaggctgggcgcagtggcttatgcctgtaatgccagcactttgggaggccaaggttggctgatcccctaaggtcacaagttcaagaccagcctggccaacatggtgaaaccccgtctctattaaaaatacaaaaattagcccagcgtggtggtgctgcctgtaatcccagctactcaggaggctgagacatgagaatcacttgaacccgggagctggagtttgcagtgagccgagattgcaccactgcactccaacctgggcaacaaagtgagactctgtctcaaaaaaataaataaaaagttacttaactatagcttttcaaatcacttctgtttactgatccaaagactacttgtctgtattagacagtaaaatatctaggagtcgtgataatacataagctgtgcacgacacaaaactgcagcagtgtttgggggaaaaaatcaacattaaagtatttaagaaatgtaagggcttaaatgcaattagttttctcctactagaaatgacattagtaatcgagttctgaaaatgcaattatgtattcaatataggatgttaccacttgaatactgaatttttttttttaagaggcagggtctggctctgtcctccaggctggagtgcagttgtgcaatcatagctcactgcagccttgaacgcctgggctcaagcaatcctcctgcctcaggctcccaagtagctgggactacaggcacatgtcatcatgcccagctaatttttgcagtttttttataaagacaaggtctccctgtgttgtccaggctggtcttgaagtcttggcctcaagtgatcctcctgcctcagcatcccaaagtgccgggattacaggcatgagccacagtgcctagttgcaaaatttatataagatctagaaaaatctattaaaatggtggtggatttggaactagaatctctgcgtacaggtcaaaggaagatgaactattgagcctagagagaagcatggtaaatggtgacagagatttaaagcagatgaaggctctttatgaaacacgtttataaaaccatttaaatttgtttccttttacactgattacaggagacactaaagacctttgggtttggtctttcaaggagaacaggtactacattggatcaactttaaattgctcacgttaagaaccatggtttatgccacttctccacattgtccacaagatggcaccatttccatttctttggggggcgtgcttctgaatgcaacagagaggagtgcaactagcaactgttaaaatcattaacagccgctagcaatacactgcctacctgacacatcccagctttatcctttgctgtggaggcagaaactagaaagtacgattcagatgcaaacgattgcattatttgtctgggatcttcagtttcataaagaaattttttttagtatgtaataagatactaaaattctcatattttcagaccagctcaaacttcctacaaatacattatttaccaagaattcgtttgttcaagatcagaattaaaacagagaacaagaacaagccctggactcacgttggcggaatcttgacttctcttctgcttcaagtctttggagagcacacgcatgatactttcctttgaaaacacagataacatattgagggagaaactatttaggaaaatcataatttcaggtgtggaatttttctagatcttgtgcttgtcagattacacttttttttttttttttttttttttttggcaactaggcaccttcagaatataactaaattacatcactcaaatttacgaccagggcttagagtttcgtaccacctcttggtcctaaacagatattatgaacggggccttcggccccgcattagagagttagggagaatgcagaaaagggtgttactcacccacagcatctcctcttccgtgcggaccctccgaggcgcggtgcgctccagtttccactccatctccggctgacttcgccctgcctggcgtttggcctctctgctcgactgcctctggttttcttcccaggtctaagtcagtcttgacgcctaatcgtcaaacccctggagtcccgtcccccaggaccattctatttcaccacctccctccaggtcccccactcctcccaccgccgctgcaaggtgttccccagggtaccatttaaaaagccggcggggcggcagtcggcgcgggaatccccctcgccggcttcttattggccggcgccgcggtgtcgtcagagcccgggtgggattccccggcgcgcgccgcggccccgcccctgccggccctctctgggccccgccccgccaccgcctccggccgaggcgcgcacccgggcgccaagctttgccgcgagccgtggcgggcctgcggctgggcctggcgccgggggctgccaccgcggcaggaggcggaggggttggcgggcgaagaagcgggttctgggagttcacgatctttccattttcagaaacaagaatgtttccttataacggccctgatccctgttcctctgcacccacttctctttctccaaccacaccctgcctttgcaggatccgagcgtgcacagctctccggcctctgtccgttggtaatcgctgtgtcagctatagatgtgaggcgtgttcgtcagctcttcgttttcagaaggcaagaaaacgtggcaagatttctatgccgatcaaaagggagagcgttgacatatttatgcaataaattattccctgctctatacattgggagtagtcaggtcctctcactcgggcttctgagccctgttccttagcagggggtaggtgagagaggtgaagaggtagtgaaagaaccagtgacaggcaggacctcataaggcgtgaagagggggccagaaagctgagcacactggggactccgtgataaagggggagaggaagatattgagggttgaggaagaggtctggcgggaaatgacagggaaccagatgggctgtgcagccttagctgcccatctgagctgccaagagagccgagttgtgccatatggcaggaggggacactgcatctgggaagcctctgacagcctggcagcctgtttgtccctcccttgctaaccccccaaccatttttgacattggattgtattttgctctaaggcaatgtgagtttgtgtgtttttctggggaaacagttcatagatagcagatactcaaaagggtcagtgatccaaaaaaaaaaaaaaaaaaaaacctaaaactcactcccctgctttccttcatactgaaagcaagaaaaaatggcattagaactaagacccaatcttagaccagttttctatgtacaataataatgctgcatagggtaacttaatcttcaaatgacatatatcaaaatgtttgatagtcaaataactagtggattaaaagatctctaagtttcacccacaagaagtctattttccttgcagtggagtactcattccaaattccagtaaatctttcagcaaacattaagactaaataaaagtaaactattattggatgagagtcagatgcattgttaatttaaatgatcagttttgcaaatgccaactaaaactcaaagtatattggaaataatatgaaggacatattatctttgttctatttttaaatatagtttacatttaaccattttgtataaacacagaataaaagcaattcaactaataagctcataaatccatgtaaattgggatttttagaatccaatttcttacaagtactaagaatagtgaatcattcatttagaatgcaattatctgtaaaaatacatttataaattccattatagccattaattccacagcatacatatacacagcctccaaatgtctttttttcccctagtgtgaagtagagaaagtattagtcaaatatctttaggaagtaattatgcagttgaatattcagattaaaacttaacttcagaatgatggaaacagaaactcgccacttggcaaatattacagtaataactgtcaagaatactaaaattaccttgcatatgatgagaatacttccccctataattaaacacaaaaaataaaatcacaacttttcactggccaaaactggcagagaccaccttaaccaagtgatcaaagttaacatcaccattagtgagacatgttgacatactgtgcctcatgagaaggacacatcacttctgtgatatttttgccccacaaaatgcataaccttaatagtgagaaaatactagacaaacccaaattaaaagactttccacaaaattggccagtacttttcaaaagtatcatagtcatcaataaagaaagagtaagaaactgtcacagattaaaagaaacaagacatgccaaccaaatgcattgcgaggtcctggattgaatcctggaccacaaaaaagaagatattggttagataactgtagaaatttgaattgatccatatctgcagattagttaatagagtagtagtaatgctgatttcctagttatgattattgtactatagctatataaaatgttaagatttgtgaacgctgagtgaaggatataatggaattatttgtaccatttttgtaacttttttctaagcctgaaattatttcaaaatgaaaaatatttaacatcatgtggtcattctattaaaaagcactttggtaagactgtttggggaaaacagaaacatcctgtaaacatattatcttaatttttatcaaatatggtttaggaacaatgtccaattcaaatatttatgcgcctaagagtagctttactatctttcaaatgtttcctctttgagaatgggttttgcagggaggatgtgacaatgagaaaggctgtgaggaagactcctggacaaaggccaataagaaggattttgaggaaagaaaggcgacaggagcgaggggaggtggactagtggaggaagggagagaaagaatttggaaaagcttcccttaactctcaaagtcgccggtgctctgagaatctcagtaggtccctatcaatgggaagcaagaggatattcaagcttcccaaatgcgatctcttttttttttcaattacactttcattctaaacatcaagaatgttaaatatctcaaaaatatgccatatacatgggctcgcttcagcggcatatgcactgaatgtgcaatataccaagtacactcccttcaatccgctctcccaacctcctccttccccgaccttcgtcagacccttttcaatgtatttgcacgtgcacacatagagtctggccctgtggatctttccccacaaatgagatctcattatacttatcatttttcaacttgttttctctaattcactgtattcaactaatttccgagcagtgcaaaccggagagctccccattcccagcgccaacggcaggtttgcgcgcccctccggcccgcggttactccccgccctgctccaggctggtgcctcgccctcagcccgctcgcgcctggctacgcccgcgcccgcgcccgctcccgcccctagcttctgcgcgccgccctgcagcccctgcgcgcgcctactgggccaaagggacggttgggagtttgctccaactgtccctggggcacgccttccccgcccagcaggggttggggaacgcgagctgggagtgtgagggaaagcgccacgccagtgggggctgatacagctccagcctgtgcggggcaggcgttagactgcagaaggggagagcttaggataaccgcactcaggtggcgcaaggaagtcagccacgaagaaaaagaaagggaaggaaaaacatcgtcccagactgataaactctctgctccccggtgtaacgtcgctcagtatagcgagagcatggatggacgaatgaagccctcttgatgcagactatccaaaaatttaatttacaaagggctccaaaaatttaaattgcaaaggttccagcagtgtaaaagcctcagtcagaagagtggtcaataaagtagcacatcacctctggttacatggcttattacttattttttcgattacaagtggttcgtgtatatgcatatttttctattactgcctgatttctaagtacagtacagggtctgtcctttaaaattatttctccattcatacccaaattaacaaggatagagggaaaggtttgcccagcttcactgcatgaaaatcttaagatcacttccaaccacttatttcctttagggcatttttcctttcacatcctccttagggtcgttcttgcatagggtaactgcccaaataaggtagttctctaccattttaaggcaatgcaaagaaaattttaaaatgaaattaattcaaatctgtataaaacaatggatgaaatcaggcatatgaaaatgatcccctctcaaagaaaagctggttcatgaatgctctagacctgaaaatctgttttcactagatattcttccagaacttcaaatgcaacataatccaaaacagaattgagaatctttccttattcccattctgcccagaccatctatctattcctccctctgtgtgccgttgccagtatcaccatcttcctggtggagcagaggcaaagtcagctttccttaactctttcccttcccccatatgcccaaatccacctatcaaatacattttcccctctgctgtgttgattacacctgccctcttcttaaacaataacgataacctgataatctccatctattccttctccagtccgttcatttaacatatgtctttgcacccagcaagtgtcatgcactatgcaaagaagtagagatccaataataaagccataaaaggcaataagctttatcttaagctaatcatatttctcccctgccccaagtcccttgaaaaaccttctttttttttcttttcttgttttgagacggagtcttgctctgtcgcccaggctggagtgcagtggtgcgatcttggctcacggcaagctccgcctcccgggttcaggccattctcctgcctcagcctccagagtagctgggattacaggcgcccgccaccacgcccggctaattttttgtatttttagtagagactgggtttcaccgagttagccaggatggtctcgatctcctgacctcgtgatccgcccgcctcggcctcccaaagtgctgggattacaggcgcgagccaccgcgcccggcctttcaacacttagaattaagttctaagtttctaattcacataaaacccctttaggacttaacttctctctgcctttctctcataatctcccacaacaccaccaacacctcctatcttcagatgtacttgatactagcactctcttgccttcaggtctttgttgaggctgccttacttttggattgtcttttttcttatctcttcctggcaaattcttactctcaaatttcagccaccttttccaaagagccttctcaaatcaaatcgtgctagttagaatttctttatcttccctctgttcccataccatattgtttgtacttctagtctgcttacttccagattttgtgtgtgtgttacatacattctccagtatattgtaagctccaagaatacaagaatcttgtgtttttcatcttgatttcctcttcagagatcggctcagtgctttgcgcataggaagttttgcacttggttggtgatcaataatttgttcagtgaaccaatttgtagatgagattagaacattttccaaatcatggaagtggcaatatagaatcacaaaagaaagactttcacatgccatatttggaatgtgataaactcagttttaagaaatatgtgagttaaaaagtatgcaggtcctaggcctgacacctgctaattgtataacttgaaacatgttattctaccccttgaagtctcaggttcctcaactgtaaaataggataattattatctactgtacagatttatgatgaggatcaagagagaaaatacaaagcttctaaaagtatacatttctttctttgagaatgaagtggtggaacttagatgactaagtaaaatgagtatttggataataaatatgtctttataaagcacttccagaagacactatccttaggtccagagccatatactaggtacgtggcacatagtaggtggtcaataaatataatatgagtgaattctaaacctccaactcagttccttaactagtaatatactaaatcaagagaaatccatatggctaatctagttagatggttatgtcaccagagaataaacatttgcatttaaatgtattccaattctgtgcccaccaggcaaccacttgatttatgacttaaggttaagtctgggaagacttgcttctgaaagggaagggtcctgattctagatagctacatacctccaatggtaagtgaattggattctggcttacctaccagactcgagcttagttaatgtaagtcagtatccaatgattgctatgtcttgataatagttctggagaagtagatttgaaccagagtggtgaattaaacaatggcgttctctccggaccagatattcttgctctgccattaacttgcagtataattttggtcaagttactcttccccagaagtctggttacttataaaatgaagacattaaacagaggaaactctaatattctttctacctctgtatcattatagttcacgaattaccaaccagagtgacctcagcatggaacttcccaactgggaagctatctggaatcacagccaatcagcctctcaacatgtctgatcatggcaacactaaagtccacagaaagagtacccacgaacacataagaagttagttttctagagcttaacatgcagtgaagcagagcaacaccaaggggcaatttggagttttaagccctaaaacccgggctcctttccagagggtgaaatgttgaagaaacagtttagataaactcatacacaaaaaagttgactaatttaaagatcaatacttgttcttttttaacttattttatgattgctcttatgccttctttttccaagttttccagggactactgatactttagatataaatcttctgcttttatagtaagcaaaagcaaggttgctctttgtcccagattacctcaacctgtaaaatggcatgctgcaaaccaattctgagcccagataaaagagtcatcaagatttcacattcttagcatgtccagcaagacatgtaggaacatgagagaccatggaggagtgtcttccaaaacaaatgttagggcttctgcccctagtgaattttacttttagtgatttttatctcctctaaactcagaatgacataaaatatgcgccctcttgcccctttgcttctttgtagcatagagctgtgggaagaacacaggctttagagtcagagaacctgttggaatcctggcttttccatctactagctgtgtgaacttagccaagtcattaacactcccttccagagcctcagcttcctcatctgcaaaatactaataatatctatttcatatgttgctgtgaagaccagatggaaaagaaattgaggccaggagcggtggcttacgcctgtaatcttagcactttgggaggccaaggccggcagatcacctgaggtcaggaattcgaaaccagcctggccaacatggcaaaatcccttctctactgaaaatacaaaaagtagccaggcgtggtggtgcacacctataatcccagctactcgggaggctgaggcacaagaatcacttgaacccaggaggtggaggttgcagtaagccgagattgtgccactgcactccatcctaggtgagagcaagtctccatctcaaaaaaataaaaagtaaaaagaaattgagagaaaactttgtaaaaggcaagaagcaatcactaaaaactggaaacaacccatatccaccaaaatgcctttcgtctgttgaatgaacaagcaaactatagtaaatccacacaatggattcaacaacacaaaagaatgaactattcatacaagcaacatcatggatgtattgggaatgcaatatgctcattgaaagaaccagactcaaaaggctacatattatatggttcaacttataggacaatctggaatagacaaaactatggggacaggaaatagataaatgattgccagggaggagctaactacaaaggagcatagggaatttttttaaatgatggaactgttctatatcttgattgtggggtggttataggactgtaggcattactgtacactcataaaactattcactaaaaacaagtaaattttactctatgtaaattgtaccattatttttaaatggttttttaaaaggaagaaccatatcaaaatttgttgtgtttctgcaacttcttacactctacacacatgttctgtattctgatttttatttcagtattcaagaccaatgaatgaaatatttgggtcaagatagaagaaaacaacagctgaattgctgtaagaatgcccatgctaactttgccatatacactgcttactggtgccatattccagaactacgttgtaaagccccaagacacacagactatttacagagctctatatgcaaccacagagggccattgccccatgtgagtacatcagtggatgatgttccctccatgtttcaagagactattctatatgtaattctctccttttgccacatcaacatccgaattacacattgtagggagaaaattcaattcaacataccatgatataatcagttcccacttatctgctaatagaggaaaattgctttagatattatatagaagcaatcctgaaatctcatttaagcaatagtttcatccatgtcatcattctaccatcatttgtcagaattccaaatgcagttgatatcttttgtataattttgcttttacctcctcccttgttcatcttgttcattatttttttggatgcaccaagaaacaataaaacactagacaggaggcatcaaaagagaagcagatctgtatatagcccacaatagataaacccacaggtacttaagtgtttacactagtaagtagacttacgagcttcagcactgccctgaacagatgccttcatttcctcatgattctacaatttcccctcaagtcaaaaaagtcagtgcatgatgttcttttagttatttttaaatgggacactgtttaaagaaaaacatactcaagagattctcacaagcctgggatttttaaatttagtgaccaaggatgaattttctctctttaactcttcatattgtcttcgtattctattattggatatttgctaaatgaccacaatgtacttagtaatgtgccaaacataaaagctttataatctaacttctgacttatcaactcagtgcaatttattattgacttttttatttttattttttatcttttatatttattttcatttagacccatcagcaggaggcagctcagtgcaatttaatggagcaagtgtaggccagctgaagccctaacttttcctatatgactttaggcaagtttcctcacctgcagggattaaatggcccatatagttatgaagttctgagactaactctgtcatatgaggggttcgtgaaagagggatagccaaggattccaacatgaatctcaagagttaaaataagtcagagttgaatagtggtcttcagattttctaaggtacaaaagaggccactattacttcattatattttagtccttttattttatttaatcctttctcaatcctcatcaaattgaatctttaaagaaaagatgctagaccatttggggttcccatacaccagtacacaataatagtggcagcttctatacaagaaagtggtatcatttcttgcaaatagtgtagaaagtatttgtgtcagtgtatcactaatacgaagaaataaggttttataggtaaattggaaatactgtattgttcatatctacagggaaaatattttgcttttttggttgattccaggttttaactctgttaaaaaatgatataagtaaatatgtacagaggcatatatgacatatatatatacacacacatatgtataaacatctgttgctggtgttattattacaatgaaaagggtgactttcaagataccttaggaattagctctgattttaagagatgacagttaatttattatttaaataaattgggcaatgcctataaatacaaatttaaactaaaactctgcttcttttggtgcttattaatcacttctgcatccataactaaaatacaaaataagagtaaagagattcataggggtcaaaatggcttattgcagtttaatattaacatttattttgctctcaaagaatctttgcctaattagtctgtttatgctactataacaaaataccataaacagggtagtttatgaacaacagaaatatctttctcacagtctggagcccagaaagcccaagatcaagttgccagcagattcagtgtctggtgaggacatttcatggtcttagatggtgccttcttgctgcatcctcacatggtggaagtgacaaggggactcttttataagggcactaatcccattcatgagggctccaccctcatgacctaatcatctctcagtggtcccacctcctaatactatcaccttgggggttaggatttcaacatgtgaattttgggagaatctaaacattcagaacataacgctaatgtaacttttatttcaatgctactagaaatatagtacaattaagaatttttgacttatgtgaatgattctcttcccacactccagtttgttaaaaggaaaactgagacacaatgaaattttaaagagtttatttgaacaaataacaattagtgattgggataatcaatatctcaaatttcacctttgaaaaagtaaaggcagtattattacagagtccacttattaaagactttcttcactagcccaatagctattatgggcttatcatttgtattttgtagttgtattagttgcttttaagatatctttctgtcatctaaaatactcaaaagatttgaaaaagagtcaacatatctgtaagcattaattccatggtatcaaaatccaaaattacccctacagtttataacaatacatcaattaccaaaataatacttcattagactacatgtaaaatctatacatattctaaaagcaaaaactcacaaactaacaaaaatcatatcttccaagtaaaggatgcttatggtggagagtgaaaagtgatgattaaaaaggaccaccagctgggtgcagtggctcacccctgtaatcccagcactttgggagtccaaggcgggtggatcacgaggtcaagtgatcgagaccattctggccaacagggtgaaaccccatctctactaaaaatacaaaaagtagctgggcatggtggcacacgcctgtagtcccagctactcgggaggctgaggcaggagaatcgcttgaatccgggaggtgaaggttgcagtgaaccaagattgtgccactgcactccaacatggcgacagagctagactccttctcaaaaaaaaaaataaataaaaggaccaccataaaataaagaattgggagttttaatttactgcaagctagtatgagtcaataggatgatgttgataaaactaccataaacattttagactttattcatagaaatgtaatgtccccaaaagagaaatgatttttcttcctttgtactggacagaccctaactgtagatattacacttgagtataatactttataatggatattgagaatctcatccagagaaacctcacaagtatattaaagtatctaaaggtcatgtcagaaaaaaaaattacattaactaggaaaaaatcatattaactagaaagcaaatctctcatccaagtactaaccaggcccaaccctgcttagcttctgagatcagatgagattgggcacattcagggtggtatggctgtagactaggaagcaaatctgaagaaaataaacccaagtctgacttctgggcaaccaaccctgtaacaccatccatctgcacttcttcctctgcaatagagaagatatccctcctcctaaggttaatttctccaagaactttaccattttctcatggtccatgctgtagtagtaccctccatctctcctcatctgcaagctctccctctttgttggattcttccaataagcatttaaatgttttcaaatctccaactattgttccaggctatcctttccacagctaagattctcaaaagatttgtctacatgcacaatctcaatttcctaactttagctcatcctcaatctattcaccatcatttccccattgctaccttcaaaaggtctcatttttcatcttacttgatgaaaaaggaatattgctcaggagagaaatgatttttcttcctttgtactagacagaccctatctgtacatatcacaattgagtgtcatacttcataatggatatcaagaatctcgtccagagaaacatcacaagtatattaaaggaattcatcatcttccttgatgaaaaggaatattgcttcctccaaaggaggaattcaccacttcttcctgcttaaaattttttctgttttttaaatcaacactacacattcccagttttcctccttctcagtaatcattactggtttatccttcttgttaggctttggaaatgtttaagttttaaatggtatgctggtaaaacagctttggggcaccaggttaggcgggaggaggaagacctgatttgaagcaattgacaatttctgtggtgtaaatactcctaccatagctgatttcaagctcccaacattatatcactgaacagagtcgggaagagaagagccgaattggctcgtggaacggtacaaaccagctacagctcaacactagagggcttttttttttttttttttttgagccggagtctcgctctgtcgcccaggctagagtgcagtggcgcgatctcggctcactgcaagctccacctcccggattcacgccattctcctgcttcagcctccggagtagctgggactacaggcgcccaccaccgcgcccggctaattttttgtatttttagtagagagggggtttcaccgtgttagccaggatggtctcgatctcctgaccttgtgatctgcccgcctcggcctcccaaaatgctgggattacaggcgtgagccaccgcgcccggccagagggcttcttctaacactgtactccataagcagtctcgacctggtgcatagtgtctgtgatccatacctaatccagaccagtaggcttcccaggcatctcaaacttctattcacactgaaccttcctcccaaatcttggcctctaatgtcatccaagctggagtacagtggtgtaatcataactaactgcagcctcgacctcttaggctcaagcaattctccagcctctacctcctaaagtgctgggattacaggcttgagccactgcatctggccataaagctttcttaagagcacatagtacaataccagacacgtggtatgtgcttagtaatctatgattatcatgggggccgcttccactataatttgtatgccctagagcataactgcccaatagaagtataatgcaagccacgtaagtaatctttcaaactttctagtagccacagtaagaaaatttaaaataaataggtaaaattaatttaaataatatatttaatttaatgtaacatatatgaaatattataatttccacatataatcaatataaaaaatattgagatattttatgattttttggcattaggtctttaaaatcctttgtgtgttctacatttatagcaaatcccgatttgtactaatctgcatctcaagtgctcaatagccacatgtaactagtggctacctaagacaatgtagccctagagagttctaggagctcttcccctcctcttcccaaggttgtttaatctgacccatgctgacttcctataccagttgttcatccattgggtactatttcaagcactagaatttattgtttagtcccatttttaattcaatatagtggataattttcttataagattggttaaaagaaccaattatcaaaggagattgttaaacctcttggagatatataaaaattccataatttacatatgatgatctaagtatggtgttgcaaaacagaataaataggaaattatatgtatttcatttctaatcaaatttttaatgccccatttcaaaatttaaaggctagcagtttgtcttctgctttgaacacaaccaggcagaaatcagagtaaacatgctcatgacagtcaaacttaaacatcgtcattaacacacctgatcttcaggtacttggcccaaccttctccaataaagatgcatttgcactaaattaaaacgaacactttctttcctgaaggtggcactgtgaacatggaaagtaattagctctcttcacattatccaggattgtgggcctattttatcagattgaaaaaaaaaaaaatgcaaaataggccaagcacggtggctcacatctgtaatcccagcactttgagaggccaaggcaggaggatgttttgaagccaggaatcaagactagcctgggcaacagagtgggacatcatgtctacgaaaaatttaaataaaaaaattagccaggagcagtggtacatgcctgtagtcccagctacttgggaggctgaggtgagaggatcacgaccctgtctcaaaaaaaagaaaaaaacaaattatatacatctcagttattctgatgtccttgataatttaaattgctattttcctttcattttgattcttcttccttcctttttgagatcaaatgtattgtctatactaactgggcccattgactttttgagtgagtttttatattaagatgttgttttcttttttaaaaaaaaaaaacctaacagctaaaatttattgaatgctgttttcaaccacaatactaagcactttaaatactttatagcatttttgtacttcagtggcaaaatgaaggcaggaactattttaaaagagtagttaattcccacaactccaactgacatgattttgctaggaaaatttagagtttataaacttgtttctctgcttttcttctgggacagcatatagggagacaagatatgatgtttgtctttattaactagagacttgactaagagcttttattttgttacctgctacaaaaaaaaagaagaagaagaagaagaaaaagaagaaaaggaaaagaaaggaagaaatgaagatctaattgggacattttctgtttttttgttaacaaacacataccaccaaccctcaccagaatcagatctagtttaggaaggcacaagccaactaaaatattttgtcatcaactgtgggaagttttgactcaaacaacctaaaagtttgcagtgaccttactgctcaataggctaaaatcttaaacatccctcaaaggttgagcccacataatttgaatacatgaatttggtgtgtgccaaaagtgtgctatcattctcaactttcctatagagattctacaactttatcgcctaaatgttgagtaaaaagcaaaacaaaacaaaatagaaacttgaatcgcatcactattatggaaaacttacccatcagctgcaccgccaaattctcagctcatcatatttaaatgaaacacttccaactgtgcttacccagtaagcaaacatacctgtgtaaatacagaagcatttagctaacatttcatacagttcaacttagccagtgggacataatttcaacacaattatgtttacattttagtaataggatacacaaggacctgatttactagagtaagacagtgaggaaaagcccttaaattcttctttataagaagaagaaacaaacagtagcatactagtaaaatggatagaatcacatggctggtaatccctttagaagtttacaaaaatgagcatagtgactataggcaggactaaactatcccggtctgctctctcctcttttgaaatgtcgtgattataatcaactttagttcagaaaacattttttctttaaacagcacacacgactggggaaatagatcaattagataacttcctctgggagctctcaggctagatgggaagaggagacatacacaataatgaccctaacactgacacactgtgagagtgatatcatgaaaacacaaggtcctataggatattctttctatgtaaataaacataaatgtagccattcttaagctttctcttcttaaggttaaataatttcaattcctatttcccaatgctttgtttactgtacacctctgaatcctcaggtttcaatatttatcttagattatagaactcaaaactgtaccaccattataaatgcccaaaggctgaatttgggaagaaatgctttacttcctttagtttcctcgcattttcttcacttttgaaataattgtagggaaagttaatgatccagtgcatatttgttaaatatccaaccacgaggtattggttgaataaattactccacgtctatataatgaaatcaagtcattaaaatatttcagaaataaaaatcataaaagaatcataaatactattagaagaaaaaggaggcacatatcaggttataattcttattttaagtatatatttgtctgtatatatacgcaaaggagcctggatgttcccattaagtgggagaaatatgggtgttttatgtacacttttgcttgcagttattcattttgtagcaagaaaaaaaataagatgtttcacttgtaatataattatcaaaattaaagcaaattttagaatctcagtttattagcataagagattttatctatgaaatgaagtataaattgtgtgtatgagagtattcttatattcttaggactttttttttttttttttttgagatggagtttcactcttctttcccaggctggagtgcaatggtgcaatcttggcttgctgcaacttccacctcccgggttccagcgattctcctgcctcagcctcctgagtagctgggactacaggtgcgtgccaccatgcccagctaatttttgtattttttagtagagacggggtttcactatgttggccaggctggtcacaaactcctgaccccgtgatctgcctgcctcagcctccccaagtgctgggattataggcgttagccgccgcactgggcccatttttaggacttttaagctaattttagaaaaaacaaaatgtacctgctacatcataggctactcgtcacaaaaatcagaacctagtctatggagtaagaaggacgggctgtctcctgaatggtgtgattggagatttgccagtcctttggattctacagacccttttggtttttaagatttctcttttaacatggacgttttcttggctgtgtcccatttttaagtgttatttattggcatcttagcagaaattaggtaaaagcaagaatcaaataatgataaaccctgggtattatggagtggaggagaggtagagagagtaacaaatacgaggagggtttcgagggccaaaaacaagctgctcaaaactttaccgaggcagaaggaatgaaaatttcccaagtacttgtgttatcaagtgagaaaatgtgtgtaagagtactttaaaaatgttagagcactctacaaataatagctaacatttattaaactctacccatgaatgtacatgggctcattcactaatgcagttatgcataaagcctatgtacatgtgcctatgaatgaagtagcttctgccagtatcttcattttccaaagaggaaactgaggcacagagaggcttaataacatacctacatcccacagctagtagatggcggacctagcaggaaaacccagtggtctgcgccagagcacctcttaaccactcggatactttttattgaatgctgctgttaactaggttttcttgtcgctttcttcaaaggcactaggttttttaaacagctttattaagatgtaattcacaaagcataaaattcacacttttaaagtgtacattttaattatttttagtacattcatagttatccaaccaccaccacaattaattttagaatattttgatcaccctaaaaggaaaccccttaccctttagcagtcactctccattctcccctctccctatccctaggcaaccactaatttattttctgtctctataaatttgtctattctgcaacagttcacataaatagaattatgcaatatgtggtcttttgtgactgactcatttagcataatgtttccaaagttcgttcgtgctgcacccaatacttcattcctttttattgctgagtaacattctactgtatggacatactacattttatttatccatcagttgatgaagattttagttgtttccaccttttggctagtatgaataatcttcccatgaatattgtgcaaaagcttttctgtggacttatgttttcatttctctcggctagatacctagtagtaaaattgctgggtcatgtagtgattctgttcaacctgttatggaactgccaagctgttttccaaagtagcggcaccattttgtcttcccaccagcagtgtatgaggattctaatttccctgtatcttgtcaacacttgtaattatctctttattgtagccattccagtgagtatgaggtggtatcttgctgtggttttgatttgcgttttcctgatagctaatgatgttgagcatctgctatggtttaaatgtgtccccaaaattcatgtgctggaaacttaatcctcaatcaacgttattgggaggtggggccttttgggaggtgtttagggcatgagggctccaccctcatgaacggattaatgctgctttaaaaaggggttacaggggcagtgagctctctctctctctctcttctcttttgccatgtgaggacacaatgttcttcctctctgaaagacagagaaccaaagtggcacctgtgagccagagaccaaacccactagcaccttgatcttgaacttccccagcctcagaactgtgagagaataaatttctgccctttataaattacccagtttgtagtattctgttaatgcagcataaaatgaatgaaaacagcatctttttcaaagacactatgttttggttatttccaaaacatggcaaacaaaacttgaactgataataatatgggaaagaccctaacctaggaaagatcaagttcctgacactaggatcctggtctctttcatcttggagacattctcagcacaaagcaccatttgtacacagtaaaattagttattccttgtttgttgaattatactcctgatgttcttttgtaagtcaattgcactttcctacacagttcattttaagtagtacttaacttctgaaattagtccacaaaagcctttttaacctataatgtagcagagccatggtattagtaacacaagtctgagtcctaggtcctattaacagagcaatgcagtataggagagtgcaggagaagcagaactttttcaaacctctcctaccttgggcaaagggccaaccctagggggaaatactttgacttttttactgatgcataaaatacataaagtgcactaatcttaagtgtatagcctggtgaatttttcatatgaatacacctgtgtaatcatcttccaaataaagacatagaacatttccaccaccccagagagtttcctcattctcttttcccagtcactacctctcaccataggtcatgcgactctgagctcaacaccccagcgaaaactttatatatcatttatttttgccaccctcccacctctgcttctggacccctttctgttgttatcttggaggatagaattgtcatgtttttcacagctctgtcccgacttgtcctgtctcccaaagtacttcaggggccaagtgtcccgtctcccttccctttagtcaaaactctcatccttttggtgatacagtttttcccaagcagactgtgagctcctcagggccagggactctactttccctgacttcaggcacagacttgtttagtgtgcctgtcaaataaataaacaaatgcatatgaccttgggtaggtagaagcaggaaagcaacccagcatatcaaaattgcactgaatcctgaatgctacactgtcctatattcatcccagaaatcatcaaagaagctgcttattcatggggagggagttcatgttgaataagtggaataaaggagtcaaatgctatgaactggatgattataactatgagaaaaattaaaccaaaggttataaaaaagcagaataaatccaccaaagtatgaacaatggaatatttggaaggtaaaactacaggtaattctcattttctaaaactaaattaatgaacacttacaactgatataataggaaaaaaacatattgtaaatgaggctacttattaacccaaattattctctaatcaaaggaaggtcagaccatgtatctaagtgaaatgaaaagatttgggggaagacataggagtagggcaggagacttccctggtttgcatcagctgtcctaatctaattctgttttttacagttctttgcccaattccatttttgaatctgaaaatgaccaaatgcccacctgtttctgcacatgaattcattttacaagttgaagatgccctgggctatagtaataatagagatattctatacttttatttaaaagataaaattagggcagggcgtggtggctcacgccattaatccctacactttgggaggttgagggggacagatcacatgaggtcaggagttcaagaccagcctggcctacatggagaaacccggtctctactaaaaatacgaaaataagccgggcatggtggcgcatgcctgtaatcccagctactaggaaggctgaggcaagagaatcgcttgaacctaggaggcacaggttgtagtgagccgagatcatgccgctgcactccagcctgggtgacagcaagactccatcttaaaaaaaaaaaaaaaaaaaaaaagagagagagagagaggataaaattagaataaataagttaaaatccatttttaaataccttagatgttctctttgtatagaaagttagagggatcactaaagcaattttcagaattttgtacatcaaaaattgcttttactggaaacatccagaaaacaaattgcctcaattctcaatttcactttgcatgcaaataaatagtcttagtctgtccaattttacaatgaatttttttttcttagacagggtcttgctctgtcacccaggttacagtgcagtggtgcaatctcagctcactaaaccctcgacctcccagactcaaacgatcctcctgcctcacttgcttccatcagttgttctagtgcacaaaaataaaattgcctattttgaaaataataataaaatcttaaaaccaagataaccacgtattttcaaatgtcgttttacttacttacttatagcaatcattagtttgctttgaaagaaaaagaaaatgttttctgctttctaataaccctaccgtcttttagattcataaggattttctatgaatttatctatgatcatagaagctgtaagcctagaagggcccagcctctttctgtcctttcagagggaacaaacccaaagaaggagtttactaaagtacatgatctcctaaataatgaaaaagaatatttcaggtaatgttgagcctgaaagattctgtttttctgaactaaagccaagacaatttataaaacttcttgtcatgcagcagtgataatatactaaggactgtgttatagaagatatacataaatattaataagtacttccaagtagaatacaattaaaggattgggaggctgaggtgggaggattgcctaagcccaggagttcaaggctgcagtgagttatgatggcaccactgtactacagcctgggtgacagagcaagagtctgtctctgaaaaaaaattgattaattaattaaaggagaatcacatcacctaaatgtcctacatcataccaatttacataatagaaagtgagaacagaaacagcccacaccacggattataactaatgaagtctccctagttgaggtggaaagtctgtatttgaaagactgaaccatagagcaactgaccacagaccaaaaatccagcaattggcctatcaattcagacacaaataactagtcaatttcaaatggtctatcagagaatacagaaataggccagggaatggtattgactaaagaaatgtttcaaagaagaggatcgatcaagagcaggtgatattcagcagttctggtccagggctttgtcatcaccctcatgggaaataactggttaaataactgcaaacacacactgaggctatcagcccttcttcatctgctgtattcatgcatctacttgtttgtaaattatacatgatttattttatagagtgttattttccagtcaatcagccttctttataatctgtcaaggtaaaacaatctcttcggtatttttaaggagaagcatttgaaatgagttgactcaacaagtattcatagatactatcctaggcaagaccttatgttcagtcaaaatcttcccactataactgtacctccaaaaattaattaacctaagctgagagactattagacctcttaataaaccactagttacccaattaatttaaaaatcacctgtcaacaatacagtagatcccataaactggtctgataaaaatgtgacaccagtaaatataatacattttgtttgtttgtgttttgagacagggtctccctctgttgccaaggctggagtgcagtggcgggatcatggctcaccgcagcttcaacctctccggctcaagcaattctcccacttcaggctccccagtaactggggccacagatgcatgccactacaccccactaatttttgtgttttttttgtagagacagggcctcactatattgcccaggctggtctcaaactcctaggctcaagcgatcctcccaccttggcctctcaaagtgctgggattataggcatgggccactgcacccaacaaatataatacatttactaggataaggacattattgtttatataacaaaaactagttcacatttttacattttgacagtgtgataatgatgttttaatttgacattcttctttgatctagttccatttagttgatggtttttcaatctagctataaaatttttacctattaaatctttctgggccgtgcatggtcgctcatgcctgtaattccagcactttgggaggccaaggcaggcagatcatgaggtcaggaattcaagaccagcctggccaacatggcaaaaccctgtctctactaaaaatacaaaaattagcctggcatggtggcacgggcctgtaatcccagctactcgggaggctgaggcaggagaattgcttgaacacaggagaggaggttgcagtgagccaagatagtgccactacactccagcctgggcaacagagcaagactccatctcaaaaaaaaaaaaaaaaaaatctgtgccttcacagatctagctttagggtactttatgttctttgttcaaaagataaaatgcttcttgggtaaataattttctacactaaattcagatacaaatgtcattctcctgttatacaggtggctttagatgttcaaatttattcatatcacagttacataaaacactttttaaaaatgtgtaggctgggcacgatggcttactcctgtaatcccaacaccttgggaggccaaggcaggctgatcacttgaggtcaggagttcgagaacagcctggccatggtgaaaccccgtctctactaaaaatacaaaaattggccaggcgtagtggcacgtgcctgtgatcccagctcctcaggaggctgagaccagggaatcatttgaacctgggaggtggaggttgcagtgagccgacatcgagatcgcaccattgcactccagcctgggtgacagagcaagactccatctaaaaaaaaaaaaaaaaaaagctattttcattattcatttaacaactttgaattcatttaaaattcccacagtagtaagtttaacacatagctccatttcttcaaccttcctttttaccccaagctcctctgccacttgcacttttctctccctcctctccacgtagcagagtagatactccattcctggtgtacacctgttatggttaagccacttactgtggagtatttactttcaagactaggtatcagcaaaactttccaaatttaaatgcaaacatgtcttgttttcaatccagagagaaaagaacttaaagctaaagttcctctaagtagtaacacctgtactttctctatttgttgtcagatttgtagttgccatttgctttgttcaatactggtgctcatcctgctttccaactaacatactaattttactttgtagtttttgctctttggtggtttcctaagcattgcagaaaaccctagctgtaatttctccccttcagtctaaagtatgtataatgttcattatgcaaagacaggggaaagtttaaactagagatcaaaaacgagaaaaaactaggggaatattttttcttaaaagtcttacaatttacaaagagataattaaatgtaacaaggcccagtgaagtgggatcaaagctaagaatcaattgtagaggcagctcatccactgatctgctgtaagaacttagtaagggctcttaaccaccttgttccttcatctgtaaaacaaggctaatggccatagcccacaggctaaactacttctttataacaaagaagtatagagaatttggcatttaagtaaaagccaaatattagtcaaaatgaaagcaaataaaatgaacatcattctgcttaattaattgtggcataaagaaaagacatatcactttagatttagaaataatattgaaccttacagagcaagatcatttttactgctttattgaacctaaaaagaaaagagcagttatagaaagatgacagatagatagatagacagcattacaatataaatgttatggggaataagacacaaatttcccttgcagaatgccaaacaatttatgtggacattctgctccccacaaatgcagggtgcacatagtgacctccttccaaagagtacagtatggggtgtggggaggagtatttttatggtggaaaatctgacaaatattatatcacctatgtcacatcagccaggtgatcaaggtcagcatcaagtcataaatcgtgttgatgtaaccttgctataatatgattgttctccaaaaaatatataatctcactccaatcatgagaaaacacatcagacaaattttaccagaggggaatcccacaatatacctgatcagtacttttcaaactgtcaaggacaacaacaacagcaacaaaaaagtgttagaaactgtcacaaccaagagggtccaaggagacatgacaactgaatgtaattggtatcttgggtgaaaacccagaatacaaaaggacattgggtaaagactgaggaaatctgaataaagtatgggcttctgttaataataatgtataaatattctttcattaattataccatactaatgtaagataagtgtttatattagtacattactaatacaatgtaataatatgggaaactgtgtgcaggggtatatatgagaattctctgtgctttttgtcaatttttccattaatctaaaactgctctgaaaaataaagcctgtttaaaagtatatataaatgttatatgtgtcaaaccaaactaaattatgtcaaaatgtcatagtccaaattctacagataatgtctatctattcagctcatttatgtctgtatgtagttgataccaaagtaaagtaagagaatattaagtaaagcaaaagattattaagttaaccatctcagtcagatgcaggatgtgcactaaacatctgtgtgactggctccttttaaaagttttcaaaagatttagccaggcacagtggcttgttcctgtaatcccagccactcagaaggctgagatgagaggtccacttgaggccacgatgttgagactagccgggacaacatagcaagacaattgtctgtaaaaaaaaaaaaaaaaaaaaaaaaggtttcaaaagatttaatattgtgtttagagaaattagcttggctgaaataagaataaaaccacattcaccagttttctttcttcttcctttctgatctttatgacttttatttcttttccttgccttattaaactggctagaattccagtatactgttggctagaaatggtgagcatgggtatcctttcaccattagccaccgtgttagctgtattttttttgtaaatgctgttcatcagagtgaggaagttcccttctataaatagttttctgagaatttgtatgggggggataccctggattgttgggtttataacttacaatgatgaaatatatatgacaacggtagcagaaagatgatgggatgatcaatagaattatagtgttaaaagttttgtagattttgcctgaagtcattcaatatcaactctaagtagattgtgagaaattgaagatgcagattttaatccctatgtcaggaaccactaaaaaagtgatgcaaagagacataactgaaagatatgcatatacaatagagaaattaaaatagaatgctaagaaaacattttattaaaacaaaaaaaaaagggcagacaaaaagaaaccaaccaattgaaagcaaatggcaaaatggcagacctaaatctacctataacaagttatattaaatgtaaataaactaaacactacaattaaaagtctgagattgccagactggatttaaaaagctgtaatcccagcactttgggaagccaagccgggaggatagcttgggcccaggagtttgagactagcctgggcaacacagggagacaccccatctccacaaaaaatcagccagctgtggtggaacacacctgtactaccactccagaggcaaaggcaggagggtcacttggaggctgaggccacagtaagctgtgactgtaccactgcacttcagcaacaaaatgagatcctgtctcaaaaaaaaaaaaacacctcagtatgtgctctctgtagaagtactttaaatacaaagataaattgaaagtaaaacaagagaaaaagatatatcatacatacaatatgcataagaaagcagagataactatattaataccaggcaaaataaactttgagacaaagatattactatagacttcataacagtcaataccttaaaatatatataacatttataaataaatgtgtgtctaataatagactttattacaatacatgaagtaaaaattcatagaacaaaagaaagagacaattccacagttatagttggggatcttaatagtatttgataagacaaaaaagtagtaagaatatagaaaatttggacaataatatcaaccagcttaatctaattgacgtttaaagatgactataccttgggcctggatgtggtggcttacccatgtaatcccaacattttgggaggccaaggtagaagaattgcttgaagctagaaattcaataccagcctggacgataaagtgagaacctgactctatgaaaaaatttaaaaataaaaaaattagttgggtatggtggtggtggtggtggtggtgtatgcctgtagtcccagctactcaagaggttgaggtgggagaatcacttgagcccagaggtttgagtttacggtgagctatgattacaccactgcactccagcctggatgagagagtgagaccctgtctctaaaaaacaaaacaaaacacaaaaggcagaaaaagaacggaagaacaaagtggaaacaaagaagaagggcaacaaatagaaaacagtaacaattacagtagctattaatccaaccacattgataatcattttaaatgtcagtggtctaaatacactaattaaaatatagattgtcagagtggatcaaaaaacaagacctaactatatgttgtctacataaacctactttaaatataaagacatatatagattaaaaggggatggagaaagatataccatgctaccacaatcaaaagggagagtatagtcaaccaatatttgacaaggatgccaaaaatactcagtggaaaagaatagcctctgcaataactagtgctgggaaaactgaatatccacatgcaaaagaatgaaatcagactcttaccttataccactcataaaaattaactcaaaatggattaaagagttaaatgtaagacctgaaagtctaaaaatccttttaaaaatattggaaaatctccttgatattggtcttggcaatgactttttggatataacaccaaaagcacaggcaacaaaagcaaaaacaaataagcggggactaaaaagcatttgcacagcaaaggaagcaatcaacaaaatgaaaaggcaacctatggaaatgggagaaaatctttgcaaaccatatatctgataagggattaatatccaaaatatataaagaactcatacaactcaataacaaaaacacaaataatctgattttaaagtgggccagggatctaaaaggacatttctccttttcctgtccaacaagcacaggaaaagatgttcaacatcactaatcaccagggaaatgcaaatcaaaaccacagtgagatattatcaaaaagagaaaagataacaaatgttggtgaggatgtggagaaaagggaacccttgtacactgctggtggcaatgtaaattggtacaggaattatggaaaacagtgtggagaggtcctcaaaaaattaaaaataggccaggtgcggcagctcacgcctgtaatcccagcactttgggaggccgaggcaggcggatcaggaggtcaggagatcgagaccatcctggctaacacagtgaaaccccgtctctactaaaaatacaaaaaattagccgggcatggtggtgggcgcctgtagtcccagctacttgggaggctgaggcaggagaatggcgtgaacccgggagacggaggttgcagtgagccgagattgcgccactgcgctccagccctggtgacagagcgagactccgtctcaaaaaaaaaaaaaaattaaaaatagaactacatgtgattcagaaaccccttttctggatatataatctaaaggaaaagaaatcagtagctggggccaggtgtggaggctcacacttgtaatcgcagcactttgagaggccgagggcgggtgggggcaggtggatcacaaggtcaggagttcaagaccagcctggccaacacagtgaaaccccaactatactaaaaatacaaaaattagctgggcatggtggcaggcgcctgtaatcccagctactcgggaagctgaggccggagaattgctggaacctgggaggcggaggttgaagtgagccaagactgcgccactgcactccagcctggatgagagagctagactttgtcaagaaagaaagaaagaaagaaagaaagaaagaaagaaagaaagaaagaaagaaagaaagaaagaaagaaagaaagaaagaaagaaagaaagaaggaaggaaggaaggaaggaaggaaggaaggaaggaaggaaggaaggaaggaaagaaagaaagaaagaaagaaagaggaaagaaagaaagaaagaaagaaagaaagaaagaaaagaaagaaaggaaagaaagaaagaaagaaagaaagaaagaaagaaagaaagaaagaaagaggaaggaagggggaaagaaagaaagaagaaaagaagaaatcagtagcttgagaggatatcggcactcccatgttcattgcaatattattcacaatacccaaggcatggaaactacataagtgttcatggacagatgaatggataaagaaattgtggtgcacatatacagtggaatattattcagctgtaaaaaagaacatcctgccatttgtgacaacatggataaatctggaggacattatgctaagaaataagccaaacacagaaagacaaatactgcatgatctcacttatatgtggaatctttaaaagttgaacaaattagggaagaggaaacaaaattgtctttgtttgcaggtgataagattatctgtgtagaaaatctgaaagaattgacaaaaaaaaccctcttgcaaccaataaacaattatagcaaggctgcaggatacaaggttaatattcaaaagttaattgctttctaatatactagcaatgaacaagatgcaataaacaagtggaatttgaaattaataacacaatatcgttactttagcacccaaaatacatacaagatcttcaagaggaagactacaatacttggatgaaagaaatcaataaagaactaaataaacagagagatatcctatgtttaaggttaggaagactcaatattgccaagatgtcagttcttcccaagtactgagaagattcaactattaatctatagattcaatgcaatttcaatcaaaatgtcaacagctattttgtagatatcaacatactaattataaagtttataaggatacaaaagatgcacaacaggcaacacaatattgaagaagataaagctggaggaccaacactacccatattcaagacttactataatattacagtaatcaacacaacgtgggctgggtgcagtggctcatgccggtaatcctaacactctgggaggccaaggctggaggattgcctgagcccaggagttcaagaccagcctgggcaacatggtgaaaccccatctctaccaaaaatgcaaaagttaaccgggcgtgctggcaagcatgcctgtaatcccagctactggagaggctgaggtgggagaattgcttgaacccaggaggtggaggttgcagtgagccaagatcacgcccctgcactccagcctgggtgatagagtgaggcttcatctcaaaaaaaaaaaaaaaaaaaaaaaagacattggaggtattgattaaaaaaatagatgaatagatcaatggaacagaatagagaacctaaaaatagatccacagaaatatagtcaactgatctttgacaaaggagcaaaggcaacacaatggagaaaagacagtcttttcaaccaatggtgctggcacaactagacatctatgcaaaaaaagtaatctagtcacaaactgtacatactttacaaaatcaattcaaaatggatcatacttctaaagtaaaatgcaaaactataaaactcctggaagatagcatgggagaaaatctaaatgatattgagtttggcaatgatgtcttagatacaataccaaagggatggtccatgaaagaaagaattggtaggttaaacttcattaaaattaaaatttctgccaggtgcagtggctcacgcctgtaatcccaacattttgggaggctgaggcagatggatcactgaagtcaggagtttgagaccagcctggccaaaatggtgaagccctgtctctactaaaaatacaaaaattaggtaagcaactgtaatcccagctatttgggaggctgaggcaggagaatcacttgaacctgggaggcagaggttgcagtgagccgagaccgtgccgttgcattccagcctgggcaacagagtgagactctgtctcaaaaaaaaaaattaaaattaaaattaaaattaaaattaaaatttctgctctgttaaagacactgtctacagaataaaaatacaagtcacagatttggagaaaatgtttacaaaggacatatcggataaagaattgttatccaaaatataggtagaactcttaaaactgaacaataagaaaccctaatttaaaaattagcagaagactttaacagacatctcagcaaaaaaaaaaacacagatggcaaatatgcatataaaaagatgctccacctcatatgtcatcagggaaacacaaattgaaacaataatgtgatacaactacacacctagtagattggctaaaatccagaacactgacaataccaaatgctggagaggatgtggagcaacaggaacaacaggaacactcatccattgctcgtatgaatgcaaaattgtagagtcattgtggaagacagcttggcactttcttacgaaactgaatatactcttatcatacaatccagcaatcacatttcttggttttattcaaaagaattgaacacttatgtccacacaaaaacatgcacacagatgtttatatcagctttattcgaaatcaaaattgccacacttggaagcaaccaagatatccttcatttggtgaatcgataaactgtggtatatcttaatgggataatgggatattattcagcactaaggaaatgagctatcaagtcatgaaaagacatggaggaaacataaatgcatattactaaatatgccagctgtggtggctcacgcctataatcccagcactttgggaggccgaggcagacagatcatgaggtcaagagattgagaccatcctggccaacatggtgaaactccgtctctcctaaaaatacaaattagccggggatggtggcaggcgcctgtaatcccaggtacttgggaggctgagacagaagaatcacttgaacctgggaggcggaggttccagtgagtcgagatcgcgccattgccctccagcctggggaacaagagcaagacttcgtctcaaaagtgaagaagaagaaagaagaaaagaagaaagaagaaagaagaaggagaaggagaaggagaaggagaagaagaagaagaagaagaagaagaagaagaagaagaagaagaagaagaagaagaagaagaggaagaggaagaggaagaggaagaggaagaagaagaagaagaaggtctgaaaaggctatatacactgcatgatttcaactacctgacattctggaaagggcacaattatggagatagtagaaagatcagtgattactagcagttaggcgagaaagaaggctggataagtggagcacagaagatttttgggacagtgaaaatattctgtatgatactataatggtgggtacatgtcctaatacgtttgtccaaaccaatcaaatgttcaccaccaagagtaaactctaatgtaaactaaggacttcaggtaataatgatgtgtcaataggttcatcaactgtaataaatgtaccactctggtgaggaatgttgttaatgggggaggctatacatgtgtggggtcagggaatatatgagaaaactttataccttccactcaattttactgtgaacctaaaatgactcaaacgtaaagtctacttttcaaatcacaaaatatctccaagcaaaaaggaatttggaaaaaagctatagaaacaatatagttaataacattatatgggggttctttccgctcagagacccctctctctatagagagagctgtttctcattctcttctcttctgtctatgaaacctctactcctaaactccctgtgtgtgtccgtgtcctaaattttcctggcgcgagatgacaaaccccaaggtatacatcccagacaacgtagccccttcatcttgggcccttgtccgggataccaacgtacaacattcatccaaatggtgagtagagcagcggactccaactctgtcatttcactttaaggttctcggcctccatttcagaaccaaatcaaaccaaatactgggcccccttcagccatttaaaaacgattagcatggctgccagccttgaaagacttgggggacaggcttgctggggagaacatgcagaatccccagcacccacggcttgcagggcatgttggccatgtttgaaatagcttcctttcacggaggacttagccctcgtgtgggtctggaagtagtcctgaggcaactgagggtttctggcgggggctaccccgtggcgttatccaaaggcttctggactgacctcagcctctgaccgcccaatggcgtttcggcaacaggatctccaacttttctgtataatttcctcctttactgtccgtgatcttcgaataaaatccagtgcatccactgccagccgggtcctttccgctgcgagacccctctatacagagagagctgtttctctttctcttctaaagatctcccgtctctttttactaggaaaaagaagaggggctgtatgctccttagttgttggagtccttttgccctatacccttccccacctgacaaaatgactgttcctttgcatggagagttttagttgcttctcttatacacacgcagctcttccaaggttcagggctcacttccctgatggtcactcaccacctggaatgctcctccatagcccccaccctgaatgatgcttacttgcaaagttttcatcatgttttcaagttttggatcatctcccagaattttgacattaaaatgactacaagtcactaaacctcagttccaagtcagagttttcccaggaaagggaattactaattggtttatcttgcatcaagaatctcctggatccaaaaatcaatgtaatataatgatagcataaaggagaaaagcaacacgattatctcaatagatgcaaaaaagttggcaaaatccaacacgctttcatgtttaaaaacacttaataaaccaggaaaaaaaggaaactttcttaacctgataaagggtatccatgaaaaacccagagcaaacatcatacttgatggtgaaaggctgaatgtttccccccaagatgagaaaaaagacaaggatgcctgctcaccccattgctactcaacattgcactgtaggtatgcacatgggcaataaggcaaagagaagaaagaaaaagaaggaagaggaggtgggcaagaggaggagaaggaaaacaaggaaaagaaaaagaagaaggaggaagaggaagaagaagaagaaaggagaaagagaagaaggagcagcagcagctatttagattggaaaggaagaagtaaaattattttgtatacaaaaaatcctaaggaattcatttaaaagactacaagaattaatgtactaatttaacaaggttgaaggatacaaaatcaatatacaaaaatcagttgtatttctatgcattaacaatgaacaatctgaaaatgaaactaagaaaaccattccacttacaatagcatcaagaaaaataaaatgcctagatataaatttaacaaaagaggtgtaagacttctacactgaaaactacaaaacattattgaaagaaattaaagaaaatctaaataaagagaaagatataccaaattcatgtattagaggacttagtattgttaagaaggcaatattgcctacattgatctacagagtcaatgcaactcctaccaaaaccacaggtgacttttttttgcagaaaaggatatgttaatcctaaaatgtatgtggcactatgagggacccaaaattgctgaatcaatcttgaaaaaaagaacaaagttggagaattcacacttcctaatttcaaattttactataaatctgcaataatcaagacaacatagtactactttagggatggatacacagatcaattgagtagaattgagagctcaaaaataaactcttacatttatgttcaattgattttcaaaatgggtgtcaagacaatatgcggaaagaatagtctccaacaaaccatccaatgcaaaaagataaagtcagacatcccatactataaacaaaaattaattcaaagtgtatcataggccgggtgcagtagctcatgcctgtaatcccagcactttgggaggccaaggcgggtggatcacttgaggtcaagagtttgagaccagccttgccaacatggtgaaaccccgtctctactaaaaatacaaaaattagctgggcatggtggcaggcgcctataatcccagctacttgggaggctgaggcaggagaatcacttgaacctgggagaaagaggttgcagtgagccgagattatgccactgcactccagcctgggcgacagagtgagactctgtctcaaaaaaaaaaaaagtatcatagacctaaattaactaataaaactataacattcttaaatgaaagcataagaataaatatttatgactttgagtgaggcaataatttcttagttatgagatgaaaggcacaattagcaaaataaataaattggactacatcaatatgaaaacattttgctgtaaatgataccttcaagaaagtgaagaacaaaccacagaaaggcagaaagaacacttaattcaacaatgaaaaaaagacaaaagaaaaaagaaaaaaactaaaaacaagagaaaaaggaaaaaagaaataaaagaaatttaaaaaaattttaaagaacaaaaaaaattcaacaatgaaaagacaaactaatttctatatgggcaaaggatttgaaaagacatttctccaagtaagatatacaaatgaccaataagcacatgaaaaaatattcaaaatcattagccattagggaaatggaaatgaaaaccacaataagataccacttcacactcactagcatggctgcaataaaaaagacagacaataacaagtgttgttaaggatctggagaaattgaagccctcatacactgctggtgagaatgtaaaatggtgcagctgctttaaaaaatagtttggcagttccttaaaatgttaaacatagaattactatatgatccagatattccactccaaggtatataggagaggtattttgtttccaagagaaaaatatatgtctaaatccttaactgggggagaatatatatatatatatatatatatatatatatatatatatgcactcacacacagacaaaaaaaaaagcttataccaaatgttcatagcagtattattcataatagtcaaaaagtggaaacaactcaaacatccataaactgatgaattggtaaataccatatggaacgtccatagatgaaatattatttggcaataaaaaggaataatgtactgaagcaggctataacatgaatgaaccttgaaaacttcatgccaagtgaaagaagtcagttacaaaagatcacgtattatatgagctcatttatataaaatgtctgcaataggcaaatcaatagagaaagaaaataaattagtggttgcctagggctacaggatggggaaggagaatgagaaatgattgctaatgggtacacaaatttctttttctttctttctttctttctttctttctttctttctttctctctctgtctctctctttctttctttcacttttattttattttatttgtcttactctgtcaccaggctggagtacagtggcacaatcataaatccctgtaaccacaaactcctgggctcaagtgatcctcccacttcagcctcttgaatagctaggactacatctggataattcatttttcatttttgtagaaatggggtttcactatgttgcccaggctggtcttgaactcctggcctcgagtgatcctcctgcctcagcctcccaaagcactgggattatatgctcactccaccccaaccagcccaggttttcttttagggaggacaaaaaattataaaattagattgtggatatggttgcaaagccctgtgcaaatactagaaatccttagggcgaaaaaaattgaattgtacactttaaattgataaattatatagtgtgtgaattacttctcaataaatctgttttaaaaagtaatctcctggctcaatcagctattggtgttgatggggacgatggggaggtggtaagaggaaggggggtgacaagtccaaaccaaacaaacccaacccagaaatgggggactcattataagtttggaagcaatgccaagaagtatcttctacattgggaactttcattttaaagaaataaatgcaatataaatcttgaaaccttaggagctaggcatgaccttatgcaagtgctcaaagctattattatcacccacagaatatggtattcatctgtatttgctttaaaccatggcatggcttagaaataatcgaattttccacattctataactaaatgcaatttctaattattacttgactgctcatataaatcctaagtaaatctgtggagtttcttttcccagtacaatacaaataaatgtaaataactgtcatgtctgatttacctagtattttgttaaccagctaaaagtaaatattgaaaatagctgttagctatgcaagtttgaacaggtgttttcctaaggaaggttatacatctttaaatttaggaatgattgaatcaaagcaaattactaccctgtctaaccatgctgattttcttacattcaatagtactcattttaagtgttttgtttcatgtaaatttttattacaaatggtttcagaattattttggatgtaagtggcaataaaatgtaaacaactagatgaaaataatatacattgccttgataaataaatgagtgaatccaagttcactacagacaagaatgaggcactggatgaaaatggcattccttaatatgagacaggagttttcaaagcaagatctgttaggtagttaagagggcaataaaaaaaattgttaaacaaatgagtcagaaaaaaatgtaaatcttttaaataacattttttaataggctggtggtgacattataagaatgcatttcaggccgggcatggtggctcatacctgtaatcccagcaccttgggagaccgaggcgggtggatcacttgaggtcagaagttcgagaccagcctggcctacacggcgaaaacccatctctactaaaaatacaaaaattagcccagtgtggtggcaggtgcctgtaatcccagctactaaagaggctgaggcaggagaatcgcttgaacctgggaggtggaggttgcagtaagccgagatctcaccattgcactccagcctgggcaacagagcaagactccatctcaaaaaaaaaaaaaaaagaatgcatttatagactgggcactgtggttcatgcttgtaatcccaggactttgggaggccaaggcaggtggatcacttgagatcaggagtttgagaccagcctgaccaacatggtgaaacccggtctccacttaaaaaaaaaaaaaaagaatgcatttctaggcttggtcagatttcaagacattgagatgtgcataaaaatactctcttctcggctcagtgcaccttttccaaaggtagagttttacacagcatcaagaccaagatgcctccaggactctggcgtcttttcttccataatacagtctgaggtaccttgaggcaaggaattccacagggaagcgaaaactggatttacttccttgtttctgggttttctctccacagttgcctaagagtgttaaactgttgtaaatgtcttctagcacttataaataaagctactctttggatttcctccatctgacaagctccagaatagagctgtgggcaaggacaccactattgctctccagctaacccatgtccatacctttgacattagactcatacctgtatttttagttttgagcgattttctccacttggaggcaaaggggagatatagcacaaggaaaaggaagtcagattccaggcctgagtaagatttgacacaccgctgctggcttcagaatacagaggcccatgtgcaaagaccagaatgatgtctctgggagaaaagacaggccctaggcttacaacaagcaaggagatggagacctcagtactacaacagcagggaacaggattctacctaccaatgaatgagcttggaaatggagtcttcccagagcttcccaataagagctcagccacaccttgatttccaagaaacccagagcagagaaaccagctgagccaacataggcttctgacctacaaaactgaggtagtaaatttgtgttatttcatactaaaaagtttatgttaatttgttacagcagtcctacaaagctgatacaaacagataacaagtgttgagtcccagataattaaagaaaatacaccaaaatgttaacagtagtatcttcagatagttaaaaaatatataatagttaaaaaacattgttactttgttagacttttctgtttgtctgaattatttttacaatgagcatgtattgcttacataaaatttggatttccatttttaaaattaaaaggtcaaaatgacaatgtatcaaggagaatgtaattagggtgccaaccatttcctacatctcattcccaggagcttccacattcaaagactctcattacatacacaggcctctggctccaggctgcagtacgtggctgtgagttcttccttccctgttggtctcccaggtcgccaagggaggccctgaacctaccctgaacctctctaaggatgaaagcccacctcactccctgctggggaggccaagctctaagagaaggcctcttgtcttttcccttcaggcttccatacctattgagaccaactaaacctctctggcagacactgttaatcgaataacacaagagtttttcccagtctccttttatcttgcctgcctcctatggtaatggcaaaaagagtgagactctagattccctgccccccttgcaggtagggataaatatgtaactcatgagactggagtgagagtccacggggggcttcctgggaaaatgtttcgcttccctaataaaagtgacagaaggccaggcgcggtggctcacgcctgtaatcccaacactttgggaggctgaggcgtgtggatcacgaggtcaggagttcgagaccagcctggccaatatggtgaaaccctgtctctactaaaatacaaaaaattagctgggcgtggtggcacgtgcctgtagtcccagctactcaggaggctgaggcaggggaatcgcttgaacccgcgaggcagaggttgctgtgagccaagatcgcaccactgcactccagcctggtgacagatcaagactctttctcaaaaaaaaaaaaaaaaaaaaaaaaacggacagaaatagtgctcaaagctccttcccccttctttcttcctactttgaatgcaggcatgatgtctgaaggcacagcaccaatcttctgatcatgaactattaagcatgaggataaagggctaacaaggtaaggggataaagcagaaaggtgaaggctggttcaccgacagcatcattagcagctgaatcaaatgttagcaactcgtgtctcagtttaccattagacacgtgtgaaaaataagcccttattgttctaaaactcaagcaaatgcagttgcctccatccatacctcaactgcctggcacagaatttcagagtactggtgctgttttctgtgagatgcagagatgaagaagggaaaacaggggaggtaggaggagaaagaagtatttgagaaaacttgtttacatgtgttttccacaggtagatgccttcacatctctaattttgtcaagtcccataaagctctatgctgaagctgagacatcatcacttatgacacagatttcagcccaaagcatgcacttcaaggaggacacaataagattaacaagttatatgcaatcatatggggtacaggatcccccaaatgattcttcttacattttgctccaaatagcttttaattaacaattattttactgtcttagttctcatttaggtaaaacatcagagcacaaaagtatcattagttattattgtaaattaattattcaaccaaaagtgttaagtatacagtattcttcttcttcttccttttattttattttattttattttattttattttattttattttattttttttttgagatggagtcttactctgtcacccaggctggagtgcagcggtgtgatctcggctcactgcaaccgctgcctcccgggttcaagcaattctcatgcctcagcctcccaagtagctgggattagcattacaggcacccaccacgccaagctacactggctaatttttatatttttagtagagacagcatttcaccatgttggccaggctagtctcaaactcctgacctcaagtgatctgccctgcttggcttcccaaagtgctgggattacaggcgtgagccaccccgcctggccttactcttatctatgacctttcagttaatgagaagaattagaactagatcctaatctctttggccgcatataaaggtcagttggattgagcttcctgaacacattccataaataattttattcagactcttcacatgcatctttaatatcaatactttcatcatcattgaagcccctatcagagtcatttaacatcattttcaaagcacactattgtcactttcaactgtttgaaatatagctctttttcagatcacctaaggtcaggagttcgagacctgcctggccaacatggtgaaaccccatatctactaaaaatacaaaaattagccgggcgtagtagcaggcacctgtaatcacggctactagggaggctgaggcaggagaatcatttgaacccaggaggcggaggttgcagtgagccaagatcgcgtcattgtactccagcctgggcgacaagagcaaaactccatctcaaaaaaaaaaaggaaaaagaaaagaaataaaagcccttttttggatctgaatatgagtttattattaaaaacttaatcctaaatcacaagaatctttgaagaacattaggtcagttggtttttgctttaatctttttttgtttgttttgagatggagtcctgctctgtcacctaggctggagttcagtggcacaatcttggctcactgcaacctccgcctcctgggttcaagtgattctcatgcctcagcctccccagcagctgggattacaggtgcctgccatcatgccttactaattttttttgtatttttagtagagatggggtttacgccatgttggccaagctggtctcgaactcctgacctcaggtgatccacccgcctcagcatcccaaagtgctaggattacaggcatgagctaccagggctggcctgctttaaccttttaaaaataatctttaaaaggcttctttacaacagtgggtctcaaagtgtggtcccagaccccagcatcacctgggatcttgtgagaaattcacattcttaggccttactgcaaaattactgaatcaggaaatctggggatgggcccagaaagctgggttttaataagctctccaggtgattctgatacacacagcagttcgagagccactactttacaataacatctcactgttgcaattatgaggccatgtcattaataataatctagttaaaatgtgtgtacctcttttttttttttttttttgagacagggttttgctcttgtcacccaggctggagtgcaatggtgcaatctcggctcactgcaacctctgcctcctgggttcaagcaattctcttgcctcagcctccagagcatctgggattactagcatgcgccaccatgcccagctaatttttgtactattagtagagatgggtatttaccatgttggccaggctgctctctaactcctgacatcaggtgatcacccacctcggcctcccaaagtgctgggattacaggtgtgagccactgtgcctggccactgtacctcctttttaaaactgattttactttcatagaaacttctagaaatactctgtgttagctaaaacagtaactcctgtcacatcttgtctctataccttgctttattttctttataatgtgttaaatatcagacatcatctatctgtttagtatctgtcttcccccactagaatgcatgcttcatgaggcaagcacttgttttttgttcctggttgtcttcacaacaactagaactgtacctggtcctattggaaatgaagtgattattgaggtaatttcaggctaacacatattcctgaactagggtagaccacacaggcccaaagactacctactatcgcgctgagctatttttgtttacaagattctgacaccaaatatgtcgggggtttttccacaccaacaaccagttctccaattctccggatacaactgggtatcctgtaattcaattcaattctgacactacctagagttattgtcagattccacacatttaagggcttagtccacaaaacttccttcacttcagatgccagtcaggtgcctagcatgcccacatttctgacttggctacaaagtctagggttcccataacaccccattagatttaataacttgctagaatggctcacagaactcaggaactcatttttttactattatttgtttattataaaggtcacaactcataaatagccaaataggagaaatgcacttggcaaagtatggtgaggggggcacagcttccatgtcctctctgggcacaccaccctcccagcacctagatagctttaccaacttggaagctctctgaactttatcacttagggtattttatggaggtttcatattgattaaataaatcattggccattgggataactcaatctctagcccctcccctctgcccagaggtggggacaagaagcagaggccgaaaggctgaaagttccaaccctctaatcatgactttttttgttttttagatggagtcttgctctgtcacccaggcggctggtgtgcagtggcatgatctcagctcactgcaacctctgcctcccaggttcaagtgattctcctgcctcagcctcccaagtagctgggactacaggaactcaccaccaagcccagctaatttttgtcttgctaatttttgtctttttagtagagacagtgtttcgccatgttggccaggctggtctcaaactcctaggtgatctgtccaccttggcctcccaaactgctgggattacaggcagtggccaccatacctagccattgcttggactttctaaagactagcccccatcttgaagctctctaggggctctcagacaccagccatctcattagcacatacaagacactcttagctgtgtagtggctcaggcccataaccccagccacttgggaggctgaggcggaaagggaggattgcttgaggctgggagttcaaaaccagcctgggaaacatagcaagatggcactcatcactggttagagtccaaggattttagaagccagaagccaggaaccagagacaaagaccaaatatgtatttcttatcatgccacacacagaattatctaattctctatccttactcttcatagcatgtatatatttatttgtttggtagttatgtcttcccaggagaaagtaagatccatgagggcaagatttttgtgttttgttattttgctgtttacttagtatctgtattactaagattctcggtaataatcaataaatatctgttaaataaacaaatgaatctaatttgtaaattctactactgctaactaatttagtcacttgtgccattagtccacaagatgacgccccaacctccaacctcccaccccaacccctgcctcagaagtgaaagatacttaagcagttcaagttaccaatggctaacatgacaattacagggatataatcttaaaggcaggaagaaatgtaattttaaaaactccagtcataagacatacagaaaaaaacctatatattgaaaactttttggttatttgttattaaagcattataagaatactcattaaggagagaggaaaagacatgacaagctgattgttttgggggacaggttaagaggttggagggaagtgattttttgttttttcttatcccgaactgtggtaactttatatttgagctgatgaaaaaaaattctgggccatccactgtactttttaagagtccatttgttagacaaaatatgaggaaatatggtctattttatcagctttttttttggtttctaaatggctatttaaatacagatagcagtacatacatgacaaactggaagagcaggttctgccacgctgccaagtcacctgttacctgatatctcctctcagagggcagaaccagcaatgcagtgtggcgtaacacagctggaaacgtgcccaagctgggccgccaagtgcaagaagtagacttcatgttaagaactgtgaaggtcaggacaaatcactacttgacatatgccactcatataatttcagaaatgagtaggaaaaagaatcccagacaaaagggaatagaagtcaagtcaaagtgaaggcacactgactttttatagttaactttttcttacaagttatataaatcaagccaagaaatgtaaaatatgattgtgcaccccagttttatctgtgcagttcaaataggtagttttactttgatcaagacttccacacttgatttctggcaaaaaaaaaaaaaaaaaagggaacactctttttcatgcggtatatgctattttcttaaaacaatatatatttctcattaacactgtttgcttataggtggttattctatttgcacaaatagaactgtatggataatgaatataaactgttaccataaatcttctaaattatatgaatgatcattacaaacaaatgtgcttagcacctattttgttgatagcccattgcctctgagaatctgccttttcctaagacaactgtttgggttacctctcccgatttcgtattctggccaccaaaataaaaattttcaatagtaacaaaattaggtgtccttttaggacgagggaagttgagtgatgtataaaaacattcacccagaaaccaggcttctgggcctagagtccttaagtgactagttaaagtgattgaaaggttccagtgtttcccattgcaggaaattacttaatctcttagagccttcttttccttcttataatattagagcattacataattataaaagtaactatggtttctaaatccttccctgctctaaaaatacataattcaaagctgctaaaaataaatacttttaaaattggctgtgacatatgtgacatatacatatataaacagagtttcactgtgacaaggggaggggctatacaatgttttgtagcagaaatttacaatgcatcggtatcaagatgcttttgttcctgaaaaagtgtttcagggtggcattcaacctgaaggcaaagttctgggaagcccccaggcacttcagtggaaacacagggcagtgttttgggggaccacatcacagctcaactggggacccagcggaacttgtaacccccgttggctgttctgatggtgaaggcattgccctgggggaaggcgagggtgcggatggtgctgtggctgcggatgcgggtgctgaaggagccgccctcctccagctcactgtggctcaggttcaacgcgctccggctgcagtctgtgcgcagcccccggaaggcgccatgcaggttcccgggcctggtgtcagtattcgcgggctctggcagcagtcggggccgcttgggatcgcggctctgaagggcttcatcgcagcgctcggaaatctccctcaggatggcgtccacttccgcgcaatcctgccccgcagcgctgaccaactcctccaggctccttttggccttcgccttgagcaggaagggctcggccgccgccccacaatcccgggactgtgtgatcatcagcttctacgaaagacagggaagagcgccgccctggggcctgccggaccctccgggttcggagcgtgcaaaaggtgacctaggcgcgctacgcaccacgcactcagcggtactctcctctcccgggcccccacgggtcccgatgctgggcggggatgcactgaactgttcagttccgacgtgctgcagttcccacacgcccgcgccccacttacatccagcaccgaggccaggtgccgggttcggctggcgagttccttcagctgcacgttccgctccttgagcgaggcgatctcctcctgtttctgggtcaatgtcacgtgcagctgcaggaggagacccaaacattcaggggtaggtactgtgctgggtctcgtctgcatatctggcatgaatcaaacccagatcctgacgtctcatcaggaactggggacgcacaggcatttacgctagtgagaataataatcaatttactttttttttaaaacaaagcacttggacaaaatttatctccattaatcctcggtgtagcgtgctgataaagagtactgacttgggcaacaggcagatctaggttctgtcaccgaagttcaacaatcctatgtcttgatttccttgtaaaacggggctagtaagagtatctagctcaatgattgtgagcattaagtgggaagaaaaagtataaattggtaagtccagggccagacacatagaaagccttcaaaaaatattggcgtccctattaaaaatctggcaggcactatgcaatatatgtatgtaacacaactgcacttgtacctctaaatccccccaaataaaactatttttaaaaataaataaaatggccaggtgcagtggctcacgcccataatctcagcactttgggggttgaggcagacggatcacccgaggtcaggagttccagaccagcctggccaacatggtgaaaccccgtctctactaaaaatataaaaattggccaggtatggtggcatgcgcttgtaatcccagctacttgggaggctgaggcacgagaatggcttgagcctgggaggcggaggttgtagtgaaccgagatcatgccactgcactccagcctgggcgacagagcgagactccgtctcaaaaaaaaaatgaataaataaataaaaattaattaataaaataaaataaaaatcaggtggggtagaattattcccacttaaccaatttggaaacaggtggagccaccggagcaatggcagctacgtgaaccaccagtcagtccactggttccgactcacaggacctcatcttctcccttgcaaaccccacttccaccctctatatcctgtccctgccccaggattcctggtcgccagaccagtgtccctacttgattattctcaacaagcgcgtctcccaacgctctctggttctggtccgccacctccttccagtattgctcaggcgggggcacgtctggagggcgcagcggtggtgactgcagggcccgtgggtccagtggcggggagaggcagggcccgaatggtgatatgtcgcaaggagagaaggggaagtctccgctggccagggtaggcgacatcatagaggatgagtctggagaagagcaggagctggatttgcagcctcaaattcatgcccagctagttacaggagcaaaatgccactctgggtgtagggtgtatgtagagatttttctttattaaattaagcacccttactcctaaacgcctgattacgaggcccttcctgatagcctgtacatacacagcaggtatccaacatatgcctgttaagtttacctgaattcaatcaagaacacttccctgggcctgcacgtcacacaggccttcgataccctgcacactcgtcactcaacctcccctgccacaccacagcatagggctccctctcccagaactcacaccgatcccagataaagcgctatgtagatccagcggttcgacttctccacgggggagagaaatgtcctaaatatggaaaaggctgactctttgatgagttgctggagagtcgttgacagttggctgggtttaccaccttcacgaccacgaaatctgaactagtctgatttgggagtgggggacacccccgctgttatttaactgccaggagactgcacttgcctgaaatgagatcatccaccgtgtctctgaaatcttgcagattgaagtctgcttccgtttggtgggaatggttctgaaaaaaaccagaggtgtacactggttaacgagtctggcgttagaaagccttcaataaatattggcgtccctgttaaaaatctggcaggcactatgcaatatatgcacgtaacacaactgcacttgtacccctaagtccccccaaataaaacaatttttgtggcgggtccggaaccctttctagaccaacagacctcctcccgggctcggcggcggtctgctcgcacttacgtcgccagcccagtctcgtacccgaaaattcaagccccatccgagacagggaacccagcaggcttgcactgccacggtggggagcgggacgcacggagcacgacactgactgggggaagggggcagcagttcgcggctcctgcagagcagctgcgtggcgggaatgggtccttccaccggcggtgcggcggccctgcgccggctccgggcagccgagtagcccgccacccaccaactagctaagcagccgcctctgtgaagctcggcggttccctgtgcgcctgcgaaattttgactccgactcaccagcgaccggccaccgagccgccgctgtaggagctgagagcacgtcttgaacaccggatctttccacccaagacccgacagcgtgcaggggcctcgagcagtaatttgaggccgcgtttcccgccaaggtttggccccagctaaccgccccacccatgcaaccgagcgggaagaaagctgtgattcgaggggccaggagaatacgggaaaagcttctgttctgcgcacagccagtgcggcctccattgctctttcagtttcccaaaaagttgggagtactcttttctcgtacagccggtgcacctccaacattatgaactgtactctcccggcctcctgcagagtgtctgggtgtgtgagaggaaaggagaccctaaggggctggaggcgcataggccttcttgttcccttaattcatggacatttagagttgataaaaacgcttttacacagtctctcagttcatcctcataccagtgtgggaagcggcaggggcctaactgattcctctttgaggaagaatctgaagctcagagagttacccagtcacccagctctgaagtagtggaatagggcctcctgcctccatacttcatttcctctagcttttctctctttttaggaaagctggcttccaccgaagacagcactgggaaggggacaggagtctcaagggccatggtaagagaagatgcatccaatagcccaccagaaagaccttattatactgaatgcactgttgattcattcctttgcgctcatcatactgttatccccaaagcccttctttactattaaaatatttctgggaagaggaacttactctgcccctaacttcaaagaatgtacaagtatcagttttcccttgggagaaaagagtcaagcagggaggcctctagcacctctgccactagttggatgctgagactataagagaaaggagatgagaaaggaagggctgagggccccagacaagtcctggagcatgagtgctgccctggttgaaggggctcattcttcaataactggaaggtctcctcctgggtagggatttgagaaaagtctcatgaggagactggaggccaactcaggaactggggccctggaaatgctacctcttatgccaatccaggtgttggtccattctgaacctcaaacatttctagagcacttcctctctctgtccacctttcccagcaggaaaggaatggggaaatgtgatctgagtgtcccaggggtctccctgagtgtttctcccctgggggcctctttcctctgaactagctctgtctttcccaggaaaattcctggattttttggtccatctgatgtgagctctgtccttgaaacttcgaggctgggcatagtggctcatgcctgtaatctcagcactttgggaggctgaggcagacagatcgctagagcacaggagttcaagaccagcttgggtgacatggcgaatccccatctgtacaaaaagtacagacaaaccaaaaactagctggccgtggtgtgtgcacctgtagtcctggctacttgggaggctgaggtgggaggatcgcctgagcctgggaggtccaggttgcagtgagccatgatcatgtcactgccctccagtctgagtgacagagtgagaccttgtctcaaaaaaagaaaaagaaaataaacaaaatgaaactttgaattctacctccccaattagataaatctggcatttctccaactacaaatgcaagaaaaaaattctaacaaagagcatgatgccaaatgtagaatctgtatacttagacaaacatccaatgagagctgcttgggttttgttacttgcacaataaacatgctggggtaagggagtgacctaggcctctgggtcagttggaagatactcaggcattatctttccttatttgatcatccagatctaaaaagaacaattaaatgtcctctgcagtgcagtgcccactcccaactcttgccttaacaatctctgctctcagcagccacctaaactgagtgtctctgggctctagcccaaggttctaggaggcccttggaggagggctgagttttgctccaccagcactcccagttctgggaggtggtcaattctttgtagagttccatactgggcctgtctgcaaaccccagacctattgccagcaagctgaaactggcacttttcctgggggttgcatctgtttaagacctcctgtccctctgggcacttcatgtcctacccatgagccaggcttctggcctcccagacaccagtgctgggagactcccttctctgcctgggaagcgtcagcaccagcaagtggcggaagtgggatgggagcaagaagacaggttttggggaaaagaaaaaagtcaagtgcctttttgccccatcacggcaagtgactagagcttttcgaagggctgaacaggactttgaaaaagcgcccaattgctgaaggactgtctctgcagagaagaacattttctgcaagattacttccagagtcctttgtccttcctgcttcttccaactgcaaattctcttgctcttttccagtcctgatagagaagttatccatcaacctccactcttcttatatacccacggaatgaaaatggccaggaagggggtgttgggagaactgataggaatgcaacaggttcccagtgcgcaactttgctcccacccacccgcctggtctctcagtgcgcaatcttgtcacagctccaaagagtagatagggtgggaaataggaggggaggcctccagatgagcccgactgtatcaagttggtcaaatcagctccagtggatatgtggtcttcataacatactaggatgcaagtagaagttctgatctgggaggctcaggtgcctgcacaatgcttcccctcaccagctgagtgtgcctgcgctcccgacccgagaggagcttttggggaattaaaaccaccaccccggaggagggtttgggttgcgtgaaaccacgaggctccacgagaaggggaggtacctgcgaggcggccaggtcaccaccaggcggcgcgtcggacccgagtagcgaagagcagtcagcgaggtcctgcaggtctatggtggtgagggctgcgcggggagaccgggagacacgcgccgggcgggccctgagcctctccgccaggctcgcagctaggacgtcagagcccgggggagagaagctcctccgagctgtgcgcgccgcaccctcccggcgcggggaacccgaggggtagcgtgggtgccacggggctcacctggcagcgctgtgggctcggcgtccgggggatcctcgtacaccgacaccgggctcccgcctgtgcatccggggaagaacttccgcggaggagcgaactggccgggcacacaaacgttgaacgcgggtcagccctcggggcaccgagcgcgcagaccccgcccggcccgaatcaaccgccccaccttcctctccggcttccccggcttgcagagcagcgcccggcccggcagtgccagcattctgttggggcagatgctgtcgaaggcccgacggccggccgcgccgcccccgcacgcctgcattgtgcctcctgcctccgggtgccgactgctcggaggcggcggcccgggctggggcagcgatccacaccctgcactcccttcagtgcctgcaggctccgaagccagccagaggttggggcaggcgcgtgaccgagaaggagccgaggggctgccgaggaggtgctgagagatggcgggggagggggaggaccgccgcgcgggaggggtggcttgcgcctgagcgccagaggtggcgccttcagcccgggacaatctgcgcgcgggcggaggcgttaaacccaacctggcaaccgggcttcccccgggagccgccagcgcggggccccggcccgccagcgccgtttcggcgagctttggcgccgccgcctcccggacgcgccaggcgaagagagggagaaggaggggcgggcaaacgccggtctccctcgccctgggtaccgtcttcccgcttacagacagggggaatggcaaagttaacgattatttccttttcttcccactccagccacaaggcgcacgaaataaacgtggagtgacacccgccagcgctagactccggcctttgcgctcctgcaggatttagtaaggatgtagaataccggcagggatgccctggaacagcccccttattacagaagccccttccctcaaacctgaaccttatcctgggtcctgacttatggatttccacgtggtctcttttggcctgacgccaagagcccgccccgctccccaagccccgcactcttctcggcagtggcgcgtgagcacagcctttaaaagaccgtccgttaagaaaaagtgacactacgaaccctcctccactttctgaaaacgccacagtggaaagtaccgaatccccgaaaaccctgttcctgtctttcctagtggcctcagcggcccatcgccacgtttggctggtctcttcgcagtcgtagttgccattcccaagccaacacctctccaaggaatgggcattttcctgagtccgaggcatctcctagggaggggcatccttaggcgagggacctttctcagtaccactcatattcatccaatttgaacagtcgtctgaaattggaatctttgtgtacccacccccctatgttgggcaccttgttttccccttatacctagtagtcgtagtgaaagagcctctagtaagaaacaagataccctaacagcggtggaaggtaatccaatggtagagctggaatagagtgagagactctctgacccaggagtagatgcagaaactgaattgatgtgaggtcagccagctagagttggtgtggtatggctcatggtgaggagctctggctttagggtcagagtgcctgaggaccaggtccatgagccctaggtctttaggaaaaaaagttacactggcctcaatagagttgctgtgaagatgagtgagattatttatgtaaagtgactggtgcttagtatgggtaaattagtgattttttaaaagccttttcagctgtatttccagcttcccacaacttgttcctagccctgtctcctgtttcctctggtttctgagtagcacgaccactagccagtccatctccatctccatccccatcctcacccactttccagcctttaaaatgagtagggaagctcttagctgagttttggggcgatctccacacatgcagatcgtcacaaaatttccaggataggcccattttccaaatattcgtcaatgagttctaagttggagtagacaaaaatatgggcattgcacattatctgttgtaacaggaactggaatagcatgattatatgactcctagtgtggatgattctggaaccagtaactcatagcagtcttggctgattaatggagcagatattggtgaagacaactccgcgcaaagtcactcttttgcctggggaccagaccccaaccccttacaaccaagcagagggccctaataatttgttatttgaaacaggtgatatgatcttcctcctcccttttcaccatcacagagcagcttttacacaaatagcttggggatcaccacgtccttcttccacagccaaggaggagaaagttcctagaaagtttagcatagcaatatgtcagaagaggcattcaaggggcccagagtaaggcactcctggctccgagaacacctggaagacacactttgagagaagtgcaaagaagtttctctaaatttgagtttgctttttatttgtatttgtcatacattttgatataccctaggtgcaggggaacatgacagattttcccccaaaaaattatcacttttttcaaccatacagaaaatttgaaaaaacagtacgatgaacaaccatatgttcaaccccacacaaattgttattttcccatatttgctctcgtttctttgctccaagtttttctgcatagcccctgtcctcccatcactgtgcaggttaccactagcctttatttcttgagggcttcctatgtgctgggggaccagtatggaccatctcattagagctatacttccaccctactaaataggccctattgatattcccattttatttttttattttgagacggagtctcactctgtcgcccaggctggagtgcagtgttgcaatttcagctcactgcaagctccgcctcccgggttcacgccattctcctgcctcagcctcccgagtagctgggactacaggcacctgccactatgcccagctaattttttgtatttttagtagagatggggtttcaccgtgttagccaggatggtctcgatctcttgacctcgtgatccgcccgccttggcctcccaaagtgctgggattacaggcgtgagccaccgcgcccggccgatattcccattttatagatgaaacgtaggcatagatatgtgacttgcttaaggtcacctggcaaattggatacagaacccacttactgaatcactatactaccttataacacgtaaacttaatctcatttaagcttttcaatctcatttagactgacaacaaccttgatatcaattgtagagctcagagaggatatgaaatttgctagaggtgacagagctgagagattcagtgcctgcatcagattcgtaacagtgagactgaagacaatatgacaggcggagtcaaaactccggcaagcctctgtctcatttctcaatttggttttctcatctgtaaaacgattcctgtaacgtgactgaggtacagactgcgctggctctccagatgtgttctctatagtccctactgaatggggagcactgagtaaataactgccacctatctcaggaagagggtgttttgagaattaccagaaacctgtaagtgggggacatttagcagtgtggctaagagtgggactctagactcagatcccggctactccactgttgtttaatggttctgtgctccagcatcctcctctgaaaaatgggataatagactctgctccatagagttgctggaagaatgaaataaatgctgaacacagtacttaggacatacttaatgctcaatatagccattatgactattatgccagttactttgggctcacatgtcgtagcatgaacagttggaccacgtgattgcagggtaaatgggctcaacctgcaatggctgtgaccacagtcaaatccttggtttccaacatgctccatttgaacacgggatttctcatgcctggatatggctttcccccacttctgcttgtgtgcctgtgtggtccccaaagcttcccagccccacatctgcctcaccagcaagtgcaaccctctggacagcatagaggttctattcgagggtcacaggacccaagccatcaggtaagcctgactccactaatctctggaattcagtatccaggacctcacctgacctggtgtttccacagagatcccaattacagagtggacccagagggaagggaaaatcccgcaaacgttgccaaccaccattcctgagctgaattcaccttccctccccgcagacagacacttgcaggatttagacaaaccacaactgtttattggtgaaagactcagcttcctcatgtgctcgctgcaaaataaataaaataccagatgctagtatcgtacactatttacaacctgcagctgaccaagcaggtcctgaagccttctctgtggaccagtactgcactcttctgaggctacgggagaggtccagcagccgggccagggactaaaaggaaacgaaggatctgttttatttcgagctcgggggcaggctgcacttctcgcagatctgaacgggcagcatgtgagtcaaggaagtactgtttatggccaccagcagctgcaacttgcccatacagtcctccagcgccgcctccgggtggtctcccagtcgcaagtccacgggccgcgagacccgcagcatgcggtccgccagcgccaggcagcagatcgccaggagggaaggggagtagctggtgaaggcatagtcggccagactcagctctgccaccccccgcgccagggcttgcgcttccagagcttcggaggcctcagcctgccccgcctccacgcgagcgtgcgtgaaatgctccaggaagaagctaatggtgggcgcacccagggtgaagtgcagcttgtgcagcacgatgcactcgaggttgcagagctgctgccgggagaaggcgccgcagcagagggccagaagctgcttcacgcgcggcgggtgcacctccacctgcaacacagggcgcactcaaccccgctttgcggcttcccgggccccaggcccaccccagtatgacgcccggactttccccatcccttccagagagacagccggggctctgcctctccactgcttccacgtaagtgacctagagcgtacttccagcgcagttgatctaactactgtccaactaaaaaaaaaaagcttgggaaattttgaaggctttttcggaggctagactagaggtgccaaaagagctatttgggactgattacagctattagtctattaggctatttctttggaagccgagtgacaggatttttcgtttgtggagaaattgtgaagttaaggctaagggatatatgcgtatgcaaatgtctgataaaatgagttctgggaacccagcactgaatcgtgcgcgctggaaagacgggcggccagggagtggcgggggagtttggctgcgtccccagatgccgcgtgtacctgtttgataccccaggtacctgtttgcaagcgatgagcaaggaggtgaccccaagcagctggaagcagtctgcagccaccggcgtggtggtgaggaagcggtccagagtgttcaccgtcaggcacagcgactcgaaggagaggccgaattggcggtgcaccgggatcagccagctgagcagcttacagcgggattccgccgtcacctgccgggaaggaggggggaggcgggcccgctgggcttagggtggagagggactgtggaagggaaggaagggccaagaagaatcggggagcttcccaggagaggggcaagaagatttcagaaagagaaacgcaatggaaactgggaaacgcgtgggccgtgctgagccggaacaccgggattgggacctggcgctgtgcagagagcgtcgtacacgttacctcgcgtaatgggctcagcaattcaaaggaaggggaggggttccattttgcagatgaagaaagaagctcaggggtgttaaataacttgcccgagttcggtaggagtccagactcaacccggaaacgaattcctctctaccgtgccccagtagccagcttgggacggggcaagtccctcaagccgtctacgccccacttttctccatctgtaaaatgaggccggtgacgcccctccacggccccttgtgcttcgactcggggcgggacctgggctgtcgcgggcccgggcgctcggagggccgagccggcaggagaggagagagcctgggaggagaggaagagcggcggcgtggagctggctctaccagcacctcacttgtggctgccgtgccagcgcctcccgcgggtggaagtggctctcctgcgccttgcggaaggcgtagcagctctggccgtagtcgcggaaggtctgtagatctagctgcgccacgggctgggccgggccgggcagggggctaccaccccgcgccgcagaggggctctctgcgccgtctgagccggagctgggggactcgaacaggtcgcaaatgccggagtctcccgggagcgggcacgggttcaggggatgcagcggctgcttcctccggaggcgcggacgcctgctcttcttcaccggggcgcgaaggttctggtcgttgtcccgcctccccgctcgggcggcggggctcgaggggctggtgggacagggggtcaccatgatgcggccgggtggccgctttactaccttcaacgcccgggctgcggcgggcagcaaacgcgcactcgaaagtgcgaaggaggccgggctcagaggctggcgcggtcctaagtacccggccggctccttctctctaccacacccccggcctctcactggctgagcccagagcggcaccggagccgcgattttccggctggagaaccactcgcctcagggcgcaggcagcgcgtcgcctccgcggcccgccggggggagggggagctgcagcgcgcgccaggcacccgcctttcgcgcctgcgtcctgcgttacctgggcaaccggagcccgggtcgctgcgggagcccgggtcactgcggagcccgggtcactgcggagcccggtgcacggagtgggagtagggctgcggcgggcgcagccaagcggctccgctgcgccggttaaaacattctcccagggggcatctctctgtccttggccagatggtctcgacacgtgcgggcacctctaacccaggtcggtaattttgtaaaggtctgatcctgagttccaaacgaaagtcgggctagaattctgtcgacacgggaaaagttttcttcagtgacccaaacaagcaatagtgttaattcggttgcgtttgtcggttttgtttcggtgggtaccggagtagccagtgcccttccttccgccagcctcggggagcagagcctcagaagggccgtttgtgctgcggaatagattggagctccaccagccagccacgctttcgcgctcaaaacaaaacggaaaactgccggatcaacctcagtcggcaagcaagtctgcaggccgtgaagactttctcccacacttttcaccccaagccaagcaagctggggctacagcggtttaagaacattgttggaaagttgcatttcgagtttgatcgaattgctcacagcctgttccgttttaggtcattagcttctggccttctgccccgccggcagcccagtccttggtttttccctgcttcctgcgtccgctccttcagggtgataaactcagggaaattaaagctggaatggggacgcccaggccgaccgggcgtggcagtttcctcaaggcgcctcgggtttagtccacagactcccgtcctggtagaagctggagcccttctgtggcctgagtgaatcttcctgagggtctctgaccctataggagaaggggctgcaggagcacaagtagcccataatcaacctcacaggcacttagcaacggcagaaagctcaggtaccctcaaccctggtgttttccagaggcgaggctactgggtgccaaaccaagagcaggttcagccacctaacctcattccagaagaaagctgataaatgtgtctgctcaaagtacaagtttctgtctatgaaaatttagtagatggtgggatggtgtctcctagagatgcaggtgaaagaaaaggaatggattttgggttctgaccactgttcctcctatttccccataactctgagcaagctctctattctgccctaaataatgtcatttgggccgggcgtggtggctcacgactgtaatcccagcactttggaaggccagggcaggtggatcacatgaggtcaggagtttgagaccagcctgaccaacatggtgaaaccccatctctactaaaaatacaaaaattagctgggggtgatagcacacacctgtaatcccagctacttgggaggctgaggcacgagaatcgagaatcgcctgaacctgggagggggaggttatagtgagccaagatcatgccactgcactccagcctgggcaacacagcaacactccgtctcaaaagaaaaataaataaataatctcatctctaacatgggagacgagctaagaaacactgggagtggtgccaggccttactgtctctcagactattgttgggaggagcaacattatgggaggagcaattgaacctgtggagaggactcagataccagacttcttcctagagaagctttctgggtgagaagaaagaatccaggaattctgattttttcatattggcccaggtggccagtgtggtaaagtgaaaagagcaggaagtcaactcctttttcctttttttttttttaaatctaattatgctttcatctattttttttttctttttgagacagagttttgctcttgtttcccaggctggagtgcaatggcatgatctcagctcaccgcaacctctgcttcctgggttcaagcgattctcctgcctcagcctctctagtagctgggattacaggcatgcgccaccgcgctggctaattttgtatttttagtagagacgggggtttctccatattaggctggtcttgaactcccaacctcaggtgatcctcccgccttggcctcccaaagtgctgggattacaggcgtgagccaccgtgcccagccatctatttttttctttttttaagacggagtctcactctgttgccaggctggagtgcagtggtgagatctgggctcactgcaacctccgcctcccgagttcaagtgattcttctgcctcagcctcctgagtagctgggactacaggtgcgcaccaccacactcggctaatttttgtatttttagtagagaccaggtttcaccatgttggccaggatggtcttgatctcttgacctcgtgatccacctgcctcagcctccagaagtactggaattacaggcgtgagccaccatgcctagcctattttttcttttttttgaaaatctaattagtgaagtcaactcctgagggtaaaactgtggctctcttattggttatcttaggcaagacatttccccctctgagtctccatttcctcatctgttaaatatggatattattatttgccttgagggtcaagtaaaatagatgtgaaaattcaatgtcctttttgaacgtaaaatattcgggtcaccttaaagctgtcattggggagtcaacagtattatcacactggagctattctttttgtttgtttgagacggagtgttgccctgtcccccaggctggagtgtagtggcatgatctggggtcactgcaacctccgcctcccaggttcaagcgatcctcctgcctcaggctcctgagtagctgggattacaggcacctgccatcatccctggctaatttttgtatttttgtagcgacagggtctcaccatgttggccaggctggtcttaaactcctgacctcaggtgatctgcccgactcggtctcccaaaatgctgcgattacaggcgtgagccaccgcgcccggccacactggagctattctgaaaaaaaagcaccatcatttgatccgtctgtggacgtgagactgtctttgcaccacgctgaaaatgctttgcactcccagggagtttgcctatagttagagtcaattcccaacaggtggtacttgagctttggcttgatggacgtattcctcagtcttctggaatgcctgctgtgccaggtgctgggtctaaaactgtaagactgcacggccctgccctcacagagctgcatagtagttgggggaacaaagaaccacttgttgcacttgtttaaatgattactgcgtggtaaaggattactgatagaggatttactggatttagggttgatagataaaatacaggacacagggttaattcgaatgtcaaataaaaaaatgttgagcattgagtatgtcccaaatattgcatgggacatatttataagaaaaaactattcattagttagtatataatagcagggaacatattatactaaaagatgatgtgttgtttatctgacattgaaatttaactgggcatcctgacatctggcagccctgatgtcacagaaacccatagtaggagcaattagcctggcctggaaaggcttcccaaagcaagtcgtagttaactacgacttcccaaagcaagtcttttatttaaaaaattactttaaggctgggtgtcctggctcacacctataatcccagcactttgggaggctgaggcaggcggattgcttgtgctcatgagtttgagaccagcctgggcgacaaggtgaaaccctgtctctacaaaaatacaaaaattcgctgggaatggtggcatgtgcctctagttccagctatttgggaggctgaagtgggatggtgacttgagcccgggaggcagaggttgcagtgagccaagatcatatcactgtactccagcctaggcaacacagccaaatcttgcctaaaaaaaaaaaaaaaaaaaacaaaatatcaaattactctagctgatatgtggaaaagagattggagaagcaaaggtcgaagcccagttaggtgcagtaattcaggcaagagacaattgtgggtaatgaggatggagataggatattagattctaaagatttaggaaatagattacaaagggggctccatgttgaaggttaggtgaattcaaggaggtctgtgagtctggcttatgtacttaggcaagtgggttggcagttaaaacagtgaaacctgtcagtctgtttaaggtcaaaaagaaagttccatgtttccattcaattaagtcttcaatgtaaagatggagcttaatcaggatgcaagtaccaaaagacattatttaaataatgaatgaacatatgtaaataccagtggttaccttttgttctcaaatgttgcttagttaaaacaatatccccaagattttgactgattaatgaaaatattcaatataaacttgtatatggctccactgtgcatcatggaatttagcaaaacaaaccttgaaaggagcttttcttagtatagcatctcagttgtaggcagtcttttaattcaggggatggtttttacatttttttctaactcttaatattggataaaacctattttaattgatttaacttggatataaaagccttcttaaatttaccttcaaagctcagggctaggttttatatctaggactcctgtccactgcttccaagaaaaggcatagtttatttccccttggtcgtttctcctctatagatagagtaggaaaggaaggaatctcagccatgtcttcattaaatggtcatcatgacatccttacctctttcctctgccttctgatgttatagcttgtgctcattgttaaaagcagtgtttacttttagtcatttgttaatttattcatcaaatattttttgagttcctgctatgtattaggcacttttctaggtgctgggaataccacagtgaataaaatagaccaaaattccttccctaataaactttatgttttagtgggaggagacataatagtcaaataaatgtatgtttatgttagatggtaaaaaagagctaagaaaataaagcaggaaaggggaatgggaactttagggcatggggttataggaattttaaatagggaggtcaggaaaagcctcactgagcagttgacatttgagcaaagacctgaaggagttgagagagtgaatcatgcttattctggggaaagggcattccaggcaaagggaagagcatgtgcaaaggccctgaaacaggagtgtgcctagagcagagtaagggggcagaagagtgggagatgcagacagagattctgacaagaggtgtctagattttataaattaaatatattattacaattaacttcatctatttcttttcagtttttaaaatgtgatttctgggcctgggacagtggctcatgcctgtaatcccagcattttgggaggctgaggtgggcggatcccgtgaggacaggagtttgagaccagcctggccaacatgatgaaaccccatctctactaaaaatataaaaattagccaggcgtggtggtgtatgcttgtaaccccagctaggggagctgaggcatgagaatcacttgtacccaggaggcgaagtttgcactgagctgagattgtgccactgtactccagcctgggggacagaacaagactctttcttaaaaaaacaaaaagtgatttctggaaattttaaatttacatacgaacagcctgggcaacatagtaagatcccatctctactaaaaaattagaaaaaaatgaggcatggtggctcatgtctgtagtcctagctacttgggaggctgaagtgggaggatcacttgaacccaggagtttaaggttatagtgagttatatgatcgtgccactgcactccagcctgggtgacagggtgagaccctgtctcaaaaaattaaaaaaattacatatgtggctcacattgtatttctgttgtacaacactattttagaagaattgggccgggcgcagtgtcccacgcctgtaatcccagcactttgggaggccaaggcgggcagatcatgaggtcaggagttcaagaccagcctggccaaaatggtgaaacctgtctctactaaaaatacaaaaattagctgggcgtggtggcgggtgcctgtaatcccagctactcgggaggctgaggcagagaattacttgaactcgggaggtggaggttgcagtgagccgagatcatgccactgcactccagcctgggcaacagagcgagactctgtctccaaaaacaaaaacaaaaacaaaaaaaagaaaaatagaagaattaatcaggctgagaatacatgtgggtggcaggagaaggacgcaggcagaaacagaaaacacttaaactgaaaacagaaaacacttaaattgaaacttaagaaactattaaaataattcaggtgagagatgatggggccttgaaccaggatagtaggtagtagagatggtgagaagtgattagattctggatatattttgaatataggccaacagaatttggtataaagatataggggctgggcacagtggctcacatctgttatcccagcactttgggaggccaaggtgggagggctgcttgaggccaagagttcaagacctgcctgcgagacactgcctctacaaaaaatccaaaaatcacaaaattagctgggcgtggtagctggtgcctgtaatcccagttgcttgggaggctgaggtgggaggattccttgagcctaggaggttgaggctgcagtgagctatgatcaagctactgcactccagcctgggtaacagaccgagaccctgtcccaaaaagaaagatacagggtatgagagaaagagtcaaggatgatcccagattttctgacatgaataattgaagatatgaagttgtcattagctgagatggaaaggattgagggaaggaaaaggttttatggagaagataaggagtttgagtctgttatgcttgagacatcttccaggcatccacatggggaggtaaaacaggtatttgaatacacaaattgagagttcaggtgtgaagtctgggatagagatgtgaatttgggtgttagcaatgaataagggtaaataccataattgacattaaacaacgaattttatgtctccctccatctcaccacagtgtttttctcatgttccactgcctctttgtagaatgcactgttgaaacccaattcaatgtagttttagacaggacatataatgaagtgatattcctgcacatctcttggtcctgtgctccaccttctagagattttaaagcaagactgtcagagatatcagtgccacgttttcctctcctcagtatttgtagttggtatgaacaatatggtccaagttaaaagcattttattttccccatgaaaagtctttaaaattaatttctgtttactaatctctctgggacctgggcccagtgctccttaaatgcactaggtaaacctaaaatactttaaaaatgtaaaaccaaattaaactcaggcttctacatcaaaagctgcttaaccacgatttgacctgtttgttttcaggtatggtttatgaaatctgcaaggcagtattaacatgatggaaccagagggttttttttaattccagtttggcacttcagtttgagacaaaagcccccactctcaccgtgttccagctctatgatgggggctgaagtaggaacaatgcatttactgacagtgccttgttttagcaaacaaagtaggttgccatctaaatgtgaacgtttgctagcaccttaaaataatgtttaaactcagttttgatgtcactaaaaattctaatatttacttaagactctattttctattaatgtatttaagcatcaaaattgagacatataacttgaagtcagacaagttttgctggtatttagtacacaaagggcaggcatttttagcacattttaaaaacccggacgtttgacttacatgtctaaatgtccacctgggaaaaaggctatctctttgttacctgccttcctggagttttgccaatccccagttcactaaaagttcagcacacatgctcaagtgcactgcttctctcctcatgcatagatgtgctttttctcccaactctcctcagattccctcctatctgtggcaatctgcccggcacaggcagtactgtgcagtggttaagagctttggctctggagtttgacttctggagttcaatcctgtctgcagtatactagctctgtgaacgtgggcaagttattcaacctttttatttctgttgctctagtgtttaaaaaattgggatagtaagggtatcctataacattgttataaggattaatgaagacatataatacgttcatgtagttttcaatatcagttgctgctataattatggttttttttctagctaaggtataaggtatatgtgtctttgtcatccagggtggttggaaaactaatacctgttttttggtttcttgtagggagtatgtgtatttattatagttgcaaagaggctactattcatattatagttccactggactttgagatctgaagctggtctttgagtactgaactaaaggtctagctctccaaataaacatcacctggtgtaacatttaagttttacttcttttttttttttttttgagacagggtctcaccaggctagagtggcaccatcagggctcactgcagcctcctcacctgctccccccaactgggctcaagcaatcctcctgcctctggggactacaggcacatgccaccatgcctggctaattttagtttgttttttttttatagacggggtcttgccatgttgcccaggctggtcttgaactcctgggctcaagtcatccacccacctcagcctcccaaagttctgggattacaggcatgagccactgtgcctggcccaagaaattttacttctgtaaaggttaagtctctttgccatattcagatgctgggtggaaaggtctccagcagcaacctctgtccttccagggtctggatcagaagagcacatcaagaactaaaaggtagtaagcactgcagcataattatgcttgaagccagcccaggcctcaactctgttatggtgtgggatactaagtgacttgtttcagtgggccttgcaagcatttcgtcaaactgtgatggtagcctgatgcttactctgctggattccctttagatggtggtgttgcccatgtagactcagggctgtgaggagcaaggaaccttcctgatactgtgtgtgtaacatttagtgtgttgcaatttacttatgatatggtcaagattttgttacactatcaaacttgttttgggtattatgtagcttcattataccatacaccaggatatagggagcagaatctcatctgaagaatgaggtcattcttggtgtcatttgcttggagaaaaagtgagctttctagaaaaggagccagaataaagggaaagatgttggtaatttgcaggaaggaaatctctttcttggatttgccactcccctgcatccccataccctaccctggtattggggtatccaggagatttgctcttcattgtcaatggtgagtttgaaagtgataagctgcagattttgtgatattctcagaatagggaagtatgacacaaaaccaagagactgttaaaaaaaaaaagatttagctgggcactgtggctcaggcctgtaattccagcactttgggaggtcaaggtgggcagatcacaaggtcaagagattgagaccatcctggctaacacggtgaaaccctgtctctactaaaaatacaaaaattagctgggtgtggtggcgcatacctgtagtctcagctacttgggaggctgaggcaggagaatcgcttgaacccgggaggtggaggttgcagtgagccgagatcatgccactgcactccagcctggcaacagggtaggactccgtctcaaaaaaaaaaaaaaaaaagatttgtaaatttgattatgaaaagtaaaaaaaaaagttgaaactagaaaaataacttatatcacagatataggcataattttctttaccttgatcttagccaaaaggccgagaagcaattggcataattttcttaagatataaaaagctcttataaatcagtatgaaaaagtgtgacactctaacagaaaaatgaacaaatatttgaatagtttacaagaaaaatgtcctatatgaaaagatgctgaaactcagaaaaatccaaacttttatcataattgataacaatccaaacatttgataagaggatataggttatcaatatgttgttggttgcaatataaattacaaccatttggaagacaatttggcaagatctgtaaacatttaaaatgcacctagtctttagctcagcagttctacttctggatagttagtatacatcaatgcaaaatgactttataaaactatatttattgcaacatccttgttagaagtaaaacattgattgtcttcaataagagacatccaaaaaatagaatattatgcggccattgaaaagaatgaggcaaatgtttttgtactgatgtggaatgattttcgtgaggtttttggttgttgttttgttttgtttttgtttttttgagatgaagtctcgccctgttgcccaggctggagtacagtggtgtgatctcagttcactgcagcctcactgcctcctggcttcaagcggttctcctgtcttaggctcccgagtacctgggattgcaggcaggcactactacaactggctactttttgtatttttagtcaagatggggttttgtcatgttggccaggctggtctcgagctcctgacctcagatgattcgcctgcttcggcctcccaaaatgccgggattacaggcgtgaactaccgtgctggccccagagtttcaaaatagaggactgaaataaagtaaggtgcaaaatagcatgtctaatatgttgtcacttgtataaaagatatgtatatatgtgtacatgtatatacacatatgcacacatccttgcatgtgcgttgaatctctctagacagatacacaagtaactggttacactggctgtctttggagagaagatttggcagattaggagacagaaataagaggaagagggactttttactgtgtaccttcatctacctttttaattttgagctgtatggatatgtcatttgttttaaaaatgacactgttcatatgcacctggctgaaagttagagagcagggaccctaggtgaggcctttaaggtggtaatacctattatatatggatatcagaaaatagtggatggaataaaacagcccctgggcaccccaggagcaaaactgtgtaactttgtatgcgagactgtgctatagtgtggatatttgtccctgcccaaatatcatgttgaattgtaatccccagtaatagagttggggcctggtaggaggtgtttggatcatggggggaagatctttcatggcttggggtgctgtctttgtgatagtgagttctcatgagatctggtcttttaaaagtgtgcagcacctcccccactcccactctgtcacctctctctcgctcgctcgctcgctcctgctttcaccatgtgatgtgcctgctcccctttgccttctgccatgattgtaagcttcctgaggcctctctagaagataagcagatgccagcaccatgcttcctgtacagcctgcacaactgtgagccgattaaacctcatttctttataaattattctgtctccggtattttttgaaatagcaatgcaagaatagcttaatataagctggttttcctttttgttttggaacttggattatatcaatgaatagaacagacaaacatctctgcctttgtggagcttatatggggtgacgatgcagggaaagataaccagtacaggctccggggcattgggaatgccagtgggcaggttgtggcattaaataggctagtcattggaaaggtaacacttgagcagagacccctaagaagtggaggagttggccatgtggacatctgtgggtatactagccagtgaaactagccagtgcaaaagctctgaggcatgggcagcccagggtgtggaagaccagcaaggcggccagtgtggctggagtagaagtgaaaagagtagcagatgaagtcagagaggcaatagggcagatcctgtagatgctgttatcattaacatttgctgggttctttagcttataaagttgtacatgatattttattgtagctttgcagcattatctcaaccatatgagataggtatgactattgtcctcatttacaggtgagagaacaagttcagattaaggagcttgcttgaaggtgcagctagtaagtggaatattcggtatttaaattcaagtgtatgattccagtttggacattcacccctgtgctgttctgtatttattaaatgtgaagggagaactaaggaaaggctttgagtccgtcctcaggccactgctttgaaaggagagctttgccaagggacagagcccccagaggaaggagaagccaacagggtcagagctggttgcactttcttgtgacaaatctgggaggctctgagatatgttatagcaagacaggcagaatccccttacccaagtatgtgccagcaggtaaaaattgagctagacttgggcatagagtaaaggaagcaaggctttaaggccaaagaaagcataaagctatctggagtgagacgaccacagagtgccatctaatttccatgaaccagccaccttttaggtgatgatcacataaggaagtgacagtttacttcacttttcagagagagctctggtgctgaatagatgagtttaaattggccaaagagtgcaaattcttatatctggcagtcttgctgggagtgaagagaagatctctgaaaccaggctggcctcaggagtgagagaagtttgtgccgttgttcttgaaccatggctattagcctgttgaaaaatacagcttatctttccaccttccatttctggtacaaatatatattttacatgaagtagaagatctaagatataacatgaaaggaagctcttaaaaatttctctggttactagaatgtaactgtacttggacactatagttgtctatctctgttcctccacaaccaatatttaatgagtacctgctaagtaccagtcatcgctctaggtttgcagcagtggataagacacacaaggcccctgcttgcatagagctgggagtggataggctgaaaataaaaaagtgagccatatcagacaggaatacattcttaaaatagatttaaaagtgtggtggcctagagtgtgaatgggtatctactttaaattgcatagccagggatgcctctttgaagaagttcttgtgtgttgctagtgtttgcaagtccacatgtcagtttttttcttttaatgttgtgcaaatctattccctaagtgagatttctcataatgttgagaatatgtttttgtttggggagcaacattttctggtgggcaggaatcctacaaatatttagatactgatagttaaatcctctaaaaataattacttcaaggtaacctgcaaaggagtagtagtgggaagtgggcttactgtatacaatgaatatcccaactaaatgcaagctaaagctaatgcatctctgtgttgttgttattgataatatttatgatgattttaaataatgagcatccagagatgttcaaggagaaagaactccttatacccaggggggcatcatatattaacataacctcagcagatctatcctgtcttttatttctctaccacacagaaaacaaagagggcagcaattagtatcttcagactatggtaagataaacccctgttccaaatgtaaagcaaagccgtcctattgaaaagcaacaaaaaggaaggctgaagggcagcacacaatgtgtaatgtgcctacttggatgtcaaatcatagggtacagatcaaaacagagcagctgttgagggctgcctcgtcatatgctgcttagagtttatgagaaaaggcatcaagggtctgcagttaacaaaagcactcagcgtgtggcagattgggccgctctgttgagaggtaggatttggtctatagtttgttcaactatacagatttgaaataaatggatggatggagtggctaggctttcttttcctgtggaagatctggatgttaaaggtatatcattcaggaaaaatatttcccagtaccttcagagtgactgaaaaattcctaacctgcatttccatattattatcatatctgctgtttctgtatcagcttgctggaatacacatatgaaccatttagggaactctattctgtcctgttggtctatatgtctgtctttatgccataccatactgttttgattaatgtagctttgtaatatgtatgaaatcaggaagtgtgaagtcactagctttattgttgtttctcaagattattttggcaatcagtcttttgtggttccatttacattttagaattgtttttttctatttctgtaaaaaatgccatttggattttgatagggattgcatagagtctatagactgctttgggtcatatggacaatattcagtcttctaatctgtgaacatttctgtttatttgtgtctttaatttctttcagcaatattttgcagttttcaatgataactctttctcctcccttgtttaagtttattcttaagtattttactctttttgatgctattataaatgagattgctttcttaatttcctttgtggattgttagtgtgtacaaacaactaatttttgtatgttggtttcatatgctggaactttgttgaatgtattatttctaacagtttttgtggaatcattaaagttttctacatataagatcgtgtcatctgtcatctgtgaacagagttttacttcttccttttaaatttagatgccttttttctttttcttgcctaattgctttagctagtactccagtactatgttgaatagcatgacaagagtgggtatccttgtcttggtcctatttttacaaaaaaagtttttagtttttcatcaatgagtgtgatgttacctgtgggattttcatatattattttcattatattgatgtaatttccttctattcctagtttgccatttttaaataggattgtctttttattattgagttgtaagaattctttatatcttctgtatacaagtcctatatcaggcatatgatttgcaagtattttctcctgttttatggggttgtcctttcactttctttctttctttcttttttttttttttttttttttgagacagagtcttgctctgttgcccaggctggagtgaacagtggtgcaatcgtggctcactgcaacctctgcctcctgggttcagacaattcccatgcctcagcctcccaagtagctgggactacaggtgcataccactatgactggctaatttttgtatttttagtagagatggggtttcagcatgttgcccaggctagtctcgaactcctgacctcaagtgatccacctgcctcagcctcccaaagtgctggaattgtcagaggcatgtgaaccacagcaactccataatgaatgggtaaaatgaggctgaaacctactgggctgcattcccagattgttaaggcattctaagtcacagactgaaataggaggttggcataagatacaggtcataaagaccttgttgataaaacaggttgcagtaaagaagccggttaaaatccaccaaaacaaagatggcaatgagagtgacctctggtcatcctcactgctacactcccaccagcgccatgacagtttacaaatgccatggcaacatcaggaagttaccctatatggtctaaaaaggggaggcatgaataatccaccccttgtttagcatatcatcaagaaataaccataaaaatgggcaaccagcagccctcggggctcctctgtctatggagtagccattcttttattcctttactttcctaataaacttgctttcactttacgctatggacctgccctaaattgttttttgtgtgagatccaagaaccctctcttgggggtctggatcaggacccctttcctgtaatagaattacgggtgtgagccaccgtgcccggccccttttcactttcttgatggtgtcctttgaagaacaagtatttttattatattaataattaaattatctccagctttattgaggtataactgacaaataaaaattatatttattcaaggtgtacaaagtgatatgatctatgtttacactatataatgattaccacaatcagagtaattcatcgtttgccacacagtctttcatgtatgtgagatgaggatacttaagattgctctctcagcaaatttcaggtaaacaatatattgttattaactatagtcaccatgctgtatactaaatccccagaacttattcattttataactagaagtttgtaccttttgatcaatatttccctatttcctctacctcctggaaactgttcaactctgcctatgtgagtttgactttcttagattccacatataaatgggatccttcagcattggacaattatttttaattttgatgaagtaccattttttttcttttgtttctggtgcttttggtgtcacatctaagaaatcactacttaatccaaggtcctaaagatttactcctatattttcttctaagagtattgtagttttagtttttacacttagctcttttttgtttgttttcgatgtagttgttgtttgtttgtttttttgagacaaggtctcactttgtcacccaggctggagtgcagtggcgtgatctctgctcattgcaacttcaacttcccagggtcaagtgatcctcccacctcagccccccaagtggctgggacaacaggtgtgcagcaacacaccctgctaatttttgcacttttttgtagagatgggatttcatcctgttgcccaggctggtctcaaacttatgggctgaagcaatccacctgccttggcttcccaaagtgctgggattacaggcatgagccaccacgttcagcctacacttggctctatagtccactttaatttctgtacatggcatgaggtaagggcccaaattcattcttttgcatgtagctatccagtggttatccatagctatccatggtatccaccatttgttgaaaagattattgcaccattgacacccttgttgaaaattagcaaaccatagacacatgggtttgtgtctgaacttttaattctatctaccagtgctcctcaatttacaatggggttatgtcctgataaaggtatcatcaattgaaaatactgtaatcatactgcatatcactagcctgggaaaatatgaaaacaaaatttgaagtacagtttttactgaatgcatttcactttcacatcattgtgaagtcaaaaaatttcaagtcaaaccatcttaagtcagagactgtatatgtctatccttatgccaattaatattttacaccccccaaatacttttttttttttgagacggtgtctcaatgtcatccatactggagtgcagagcagcatgatctcagcttcttgcaatctctgccaccctggctcaagtggtcctcccacctcagcctcctgaatagatgggaccacaggtgtgtaccaccacacccagctacttttttctatttttggtggagacagggttttgccatgttgctcaagctggtcttgaactcctgagttcaagtgatcctcccacttcagcctctcaaagtattaggattatagccatgagccaccacactggctcccaaatactttttggccatatttcaagatggcaatttggaggggctgcacactacaggtaattgctctgaaaaactgtcattttatgggggagatttgcttctgtagaggaaatctatattagtgaagtaaaccccagatgcaaacaggctctctctgaggcccctccttatctgccttatccagatctaggaaagattacctcacaggaaaaggagactaaaaatctgacacttttaaaggtctgacaaaaatgttaccatgggctaccctctattctttctgagggctgctacccttgagacttcatctacatacaagatgtagcctttgctccccatgcttttcctttcctctccctcccataacctgtcttgccacattctaagcctctattcttttatactatataaacttcatctggcccccctcctctgagcctcatattttgtatagctcccatgtttatgcacattaatacatttttatgccttttttccctgttaatctgtctatagtcagtttattttatagggaaattatagaactttcagaaggatggagggaagaaaattccctttaccccacagcagtagactgcttaggttatttttgaatgaccttttcatttattccccgttagctgagtgacctttagcatcggttttctcgtttgtaaattgaaaatatattaccatcttgttgtgaggactgaacaagaatatagtaaagctcttagttcagtgcttatcatataatgctcaatttaaaaactggaaatatactttcccttggtaatactccctttccttcccactaatcctctccagtgaagacttttcgtctacttcttttttcttttagacggagtcttgctctgtcaccaggctggagtgcagtggcacaatcttggctcactccaatctccacctcccgggttcaagagattctcctgcttcagcctcccgagtagctgggattacaggtgcctgccaccatgcccaactaatttttgtatttttagtagagatgggatttcaccatattggccaggctggtctcaaactcctgacctcaggtgatccacccgcctcggcctcccaaagtgctgggattacaggcgtgagccactgcactcagccgactcttcatctacttctaaatgtctcatgcataagaacggatttcatgaaaacaggcaggcatattcctgaactaccaccaggactcaacaacttatctgaagagtgtgattttctcatatgacacttgatttttcttaccactgtatgttaagatcgagggcacccgcctccttttcctagtgactgtagcacctggcctggtcttctccatccttttcctgcatccacactgatgaacaaatatgctgttcatcctgtccctactttaaattctccccacatccattttgctatccatcagcagggaaaccctttaggtttatttattattgaaacaattacatctcaagattttaaattctgaaattctctcctctaactggcctccctaccattgacttattcataatgaatttgggattagattctgacgtctccattttcctggtccatggcctctgatctggccccatttgcctctaaataagcgatttcagtcacccatttcaatgacacaatctatttcattctaagatcccatagtcacttcaatgcaaaaaactccagaaaccaaaaaatcctatccactgtcaactttatcagcttatccgaagccagtaagcattgctggggaaaaccaaaaagcctttccaagttgattcctatgttattctgttttagttctttgttgagccctctctgatgttaatattatcctcactttatgctggttatttctatttttgcctgcaaatcagtgagggtcttcaaccttttgtgaatatattcatattcaacctattatgcattctgttcctttataacatccataaagaatattctatttgctgccccaccttttcatttttattcactccctaaaattatgacttgtactcatgcagaaaagagttaacatagcaagccagaggtctttagaagagactgcttgtagggctggcccttggctggagcctgggaacttgacttgtgaaaagtcctctgctttttgttaacactgttttgcctgctagaacacttaaatgcctgctttccttctgggagcctggaattttgttatgcctggtctttgtgcttgtatgacctgcccctaataaaagtccttgcactctgattctgtagtaggtttctctgggcagaaactgcatagcacataggaagcctgtgtatagatttctccagactccatgtgatgtgtcttttccccttgctgattccattgtatatcctttctctacaaaatcaactgtagcctctgagtcttgcaagtccttctggtgtatcattgaatgtgcatgtagttgtgggacttctgagagtccttccttcccaccctccattcaaactgatctcaaaaggttgatgtattcattaaaccttagtaatctttccctactctgtaacatctgttgacaatacttttgctttcaaaaatcttcttccttggcattaagatagccctactctggttctccttatccttcactcattcagcatttattgaatgcctatatatgcaaggcattgtgttaggtatgtatcagcgagtgaaacagtcctggtgcagcatatgttctagtgagaagaagatgaaaagcaaatggtacaagctgagaaaagtaccgtgttatgagtaaaaggggatatgcacttcagtagggtggcctgtgcggagggctttagaccaggaaagtctgcttggcaaagaaccggaagcaatgtattatggcagagaacgccatgtgtaaatgctcagaaaaaccgcttgacatcttctagcaactgaaaaggagcctagtgtggctggagcaccatgagacaaaagagtggagatgagactggaggatagcaaggtccagatcagttagagagctttggaggtcatgtttagaactttaaattttaagagcaatgggaagccaagtgacacagataccctttaaaaatatcattctttttcggattagaggtataaaaaggaggagaaagcctagttcagagattactgcagtggtgtaagtgaaagataatggtgacctgggtctgagtgacggctgagaagatgaaagacgaaagggactttgatcttcttacccctttgctgattacctcaactcccacatctttaattatcatctctgtgtataagactctaaccctatgaccttacctgatgtgagtcactgtttcacatttcaaaggaataatgattacatttcagaaatctaaatagtactggagccataatgcttctgttacttactatcagtgtgatctcggacatgctatttcacttctctgtgcctcagtttcctcatttgtaaaatacaaatagtaggttaatatagtacctacctcgtaggttgtctgtaaatgagttaacagacaaaacaatttggagtgagtactagcctccatgtgtcccaagaggaactgccttcaacacccaatctagctctttctcctgacatacccatttttattaatggcactagagatttcaaaccatggtcacatttgactccttgctctcaattcccttgccacactgcaagtagaaacctaaaattagagattgctactaagtattgtttttacttccatttgcatataaggtaaaagttacggtttaatttgttcatcaaaaaatattaaaattatatacctgttatgagagccaagcagttatactaggttcctattaaattctaatcttttgatcttcagatgcaatttctgccttttgatctaaaagggactatatttgaagtttatcaaaaatctattgattaagaaatgagaaatccctctaagtaataaaaatggaatttcaaaagattgttagtaaccaaaacaaataggaccaatgaaaaatacctacgcatactttactatctcaaagttactgaccttaccagttcaatcgcgtatataaaaagggttcaggggcagggatatcacagcggtagcctgaggaaaacagtgcaaactatccatcccaaggctgacaggagtatttattagtcaatcttgcctgtcttccagaaccacatgtttatgctttttgaatgttactgaaataggtggcatctattaatagtgcatttatttaggttctgaaattgactatcaaatactaaataactgacttctgaagttgttccttttcatggaaatttaattataattggttttggagattattttcccttctgggtctatagggtttaaattctgcagacatcaaggactgataggggatgaggcagctacacagggaatcacaacattaagctacagataccacagacataggccttgcccttattaacacaacgatgagcaaaacatgcataataccaaagaatttattgtaaatgtagtggcaaatacattcagaataatcatcattaaaaaggaactagaaaattatacatgtttaaagtatgtgcttttttcccaccacctttaagttaatggctagtaccaacattttaagtaatgaaatacttaatgtgatgacccattttcagataatttcatgactgtatcttcatcttaatttttaaagcagttgaccatgaatttcagtttcagttattctctgtttttatcaattccgtaatgatctgcagaatcttgtcatctgagtggaaggaaaaaaaaaagccacgaataaatgcaacattgtctaattttccaaggtatgcacatgtaaataagaggtatatgtcactaaaaatttttacattagaatacagaattaacaccagtaataaaactagagacacctataaaatattttttgccctacatagattttattgctgtaggttatgccatacctagtttgacaaaagttaacattttgaaaacagataacatttgtataggctaaaccccaaagagataatatgatgtgaaatgttacttctttataaggaattataaattttattctataaaaattccttgaagaaagtaagtttctcaactttttcacttggctgcaatatactgaaggctctactgactcttcagtgttcttcagagtatggcagaatttccaaagtatgagcaaggaagaaagaactgttaccagtttctccatgtttagtccaaaggaaacaaaaaattctaacagggaagcgctcttggagaggtgtcaatgcggaagtgacagacctctctacacaacaaaggaatcaaataccaattaatttgacaaacagagcaacagaggctgcattatttgctaaaggggttttgttaacaactgcttctacttaatagttaactctgaaattgtgacttcctaagaacctcacaaccactctttaggaagttacaattatcagggctgcaaaactgaaattctacatttacgttagatactcagagaatgctgtcgctttcaatagttgcaatggttacagtggcattagaaacaacaacaaaaaagtgggagggaggggaaaaagagaggtcacttgtttgaagttggaacaatggcaggtctagaaagaacgtttttcttttttattttttaagagatggagtctcactctcgcctaggctgtagtgcagtggtgtgatcacagctcactgcagctctgaactcctgggctcaagcaatcttcccatctcagccctctgagtagctgggattacaggcgcaagccaccatacctggctccaagaaccatgatttttaaattgaggaagagagagtaaaagaaagtacaagagtaagttcagttactgtttttcaaatgtttggcattctaccaactttttgttataaatccaagagagagcactaacatacttcttccttcctcccaagtcaaacgtatatactacacccaacttggtaagttctgctctctctcttatggcaaagggaaacactgatatcatttcaaaaaatcattttgcttaattaaaagctgaggttcaacctatactttataaaatgtaattctttctaatgccaaagttataatgcacaaagcttcctgagaaaagagcccacgtcttaatatgttaagacttgatctgtttccagcagtataggaaaattaatacattttaatgcttatgcattcatatttagttatacaaataaacacagagtatgaggcttcagggtagtagaactagatcagtagctcccccaacttgcctgtgactgttgagaataaactggggatactttgttcagtacaatcatactgaagtcactgatcaattcttaacattaaaaggacaaccaaatttaagtgcttcctggtgtgacgcagtggggagaatacagcaccaactagaaagtattattttcctcaaaacttattctaatcatacctccaaatataactaccagtttataggaaatacatgaacatgttaaagcatgagtatgtaactaaccaaatcctaaatgtgggacattctaccagaaaaacaactcagtttattaaaaataattaactgcatttaaaaatgggatagccttagaggggaaatgttacagaataaaatatttaaaaaataatatagccacaggcctctcccatagagatcagtatgtctggggtaggtctttggaccttgtattctttgcaactgccaggatgattttgatgatttggcaagtttgagaaacactgcactgggcaaactgcaaactcagatgtccatttcagatttctctcttattttttgatgtggggtcttgctctgtcacccagactggagtgcggatactcgcctcagcctcccaagtagctgagacaacaggtacaagccaccaggcccggctaactttttttaattgtttgtagagatggcatctccctatgttaccgaggctagtcttgaactcctggcctcaagcgatcctcctgcctcagccttccaaagtggtgggattacaggcaggtgtcaccatgcccggctcatttcagatttctgttgaaggataatgtgtttattttatacagagaaatagctctgcatttgaaagaaacacatggtggaaaaaccatgctgaaataaacctaacagaaagtccctaatcatacacacacacacaaatacatatataggtatgtgtatatatacatatatttcttagagacagagtctctctatgttgtctaggctggactttaactcctgggctcaagcaatcttcccacctcagccttctgggtagctaggactacaggcatatgacaccatgtttggcttattatttttttttaaataatagctatgttaccagtttactaaaatgctaataagtaacaaagtttactatgctcagttttattaacctttttttctatgaaatggctagaagtttagaaatgaagtttaaaagagacaggagtaaactaaaccttaagaggataattaggctgtgaataatcactaattgagtttgatggaattc

SEQ ID NO: 17 - DNA, 174607 bp, Artificial Sequence
  Synthetic BAC sequence
gctttagtagtccattttgattatttcagacaactagattcattgaaatatcatttgttaacagtgcctaagatcgtgttcaaaaatcagtcatgtcttatagatgtgttctgaggaagtttttaaatcaatgtatttggcacaatataagagacctgagcaaaaaaggggagcaaggaaagaaaatgcagtttctgatagtttctgatgattcaactggaactagttaaatccttagagattaccaataaaaagtcctttagtcttgcttaagatggttgctttttaaatttgtcagacatatgtgaattaaattaaaacaatgatgaaatcaggtaatactgccagtaaatttgccccctgcctcccctacctctaactccactaagaaaaaatgagataatgttttacagaataaagaattatgaactaaaaaattagaaatacatataaatacgattttcctcttttccttcacctaggcaaatcagaaaatagttttataatgtaagatgtcaacaaattaatatagttgctttgcaaccttgtaaattcaaaataccaaattcaattagactcctttaccactgtataatcagcttgttagccattattatcataatagattcttgaccaattttaagtcattaatattacaatttaaaacagaatgtggtacagaataaaatttctgagatatttcacaatttattaaagtagttgttacatgtgtagactaatgctgacatgactgattttcttctacactaaattatttcagaattaggttgtccaagaaagcaaaacctcacatgtgtataaagaaaaagactagtggtgctagtatctaaaacagacttgaaaccattatttaattcatctgtgcatgaaattttcaagtaatgttttattaggaaaactattatttttcaatgtcttcaagttaagaaaaagaaaatatgggttctttacaaagtaacaagtcatttaactcgtaaaaataaagaaggaaggaaaattttttacaagtaaatgttctctatactttctccacaaaataatacatgggctatacagtttgttgctataagaaaaatatttgagaactagtcagtatttactaaaatatgttgtatataacatattgtatagagtgatttgagttttctttacttaaaaaagcctaactaaacaatttttacctcctttataagacataaggaattttagaaaaagaagaaataaataaacaaggaagagaaaggaaagaaagaagaaaaggagaaaagaaattcaaatatatactttttcaatagagatgttatcttttcatctacctactcaatgtgtttccatctttaaatgatcttttttctgagaactatttgtaggatataagatcttatagaaaataatccaattttcttaatacagtaatttttaaatgctattggactaatgaattaactaaatagttgtcatttcataagcatggaagcccctcaactacaatagtggtatcatctataaagcgatgtcttttacttctcatggatgcagaatcaaattgataagacattaattcaactaataaatagtatagttttttttgtatgtgggttacagtcggatattgccagtcttgctgtgatcctattttgatatactcttggggtttctttttcccctaatgtgagcatctgatttgtagcacatcagtaaaattaacatatgcagttaaattatacagtaagtactaagtccatattcctcctgcctcaggccagtgatcaatcagatactcttcttcaagaacttcaaccaagagccctggagagaacaggctcagagtcacattaacgatggcacaccagagggacagtccttcaaacaccactgctcactcacctggctgaaattatcactgctagtgcaaccagacatccctggcattcttcttggttattctatttttgttcaaactttgtaaaacacctaagtaccgttccataaacaatatatattactaaaaaccagttttcttggtttgaaagagaagaattacacaagtatgaaggaaactggaaactatatactttaaaacctaggttagactcttagaaactttcatatatggatcttcatgttttctattataatatgggcctagatatgtctgtagaagaaaacctattgtcattcattgcataaattttgtgtaaagagtatattttttctgtaagaattttttaatttttagtctatataaatatagccaaaaatctcattaattctaagacaagaaagtactcattgtcaactagaaccacaacattcacagcatcttttattctgtttgttattttggagagtcaaatacctaacatgacttaaaaagttttttatttttgtttaaagcacatgtatccttctctttcaaccaatatgcttatcaagaatccaaatcaagagctaaatcaagctgaatcaagaagctaaatatttgtgtttggttttgactaataattaaaataaatataaattttaaagttaatgatatagtggaattcttactaactccagaaaataaaacaaaagttattgatacagtggaattcttactaactccagaaaataaaacaaaacatgaaaacacacagaaaaacaaaaaacttggattgttacatgacagaatcattctctgtgagatcaatagttcccacagcttctaccaggcagggtaaatggttttaaaggaggatcgtgcttaaataaatatattctcagccacccaatggtttgctgatttctgaagggccagaaacacaggcgaatgtttggcatctctggtttctgacctggattgaactggacatgctgaaataatgtgagaaaagactgttttctggctagaactggaagtatatctgccagcattcctgtgaacatgcttttcttctgtccagctttgactgtttaagaagtcaagttatgttagacctagattgtattccgaactagagctagactataaaacttttttgagaatgatagaaatgtttaacccaaatttgtgagggcagagcatttgggagtgatgaaatttccaaaagtcaaaaacttctgatgagtgagagaaatgaattgttaaaacatgtgtcagtggaaatgtcatcttatccagggaagatggcttgaaaatacctttgcacctagtgtataaccaaagatcactccagacaaaaagcccccagcagaagattttgagatgttagggatcgtctatcacaccatgttcagtgggaagaagaggacacattaatagttaaatctccatttaagccaaagcatgctaaattcgtattacactaataggttatttgagatggcctaattttgtaatttataaataactttaaactttattattcttcaaattgatctccgcccaccaaacattccttttcatttttagagttatgaattttctagtggagaacaaagagtgactaatgactaatccgagtttgtatgctgttgttaacatactgaaagtttttttctcctacttattattttatcttgttcaaacataacttgattctcttttggaatcatgaaatagagttggaaggcttctttaagggtcaaacatcccagaatatcctttgaggaaaggagtggcacatcattcccatgttacacaaacagtagactttgcctaggcctatgtcctcaagatcatcacaatttgggtccatttttgccttttcagtcaccggtaaagaaggagaacagctagcttctctcctttgtatattcatcttttatatacttagagatcaggcccatctctcagtgtttaacgaagactaaacatgaaaaggttctttggaacttactcatcacttttattcccagttaattaattatcatgtcgatgacccctgaaacttttccaaatttttttcctcttcagttgtaggattataagcgggcacaaaagtcttgaaagaactcagccgttactgaagaacatatgttgaaagtattttgttacatttcttaaagtttattgcacattaccctttttctaaaatgaggataacacagttgactcatatgctcaaattgggtttgttatttcacccattaccagccatgttctgtgagtaggctgatagtatatattttcctccccatgtcctctattttcagtcctagccccagttaagaagttaaatatttatgttggattttgactaataatcaatctgatgtccacaaccacctcctgtctacatgtctgtctacatatgaaaggtattaaaatattaccactacctattgcaaagatcccaaaattatctaaatttacttcaatattatctaaactatattaaagagataatttttagtgggaaaccacatttgagaatcaaatatgcaagaattaattaccctgtgactattgcttcaaatcaaattggaattaaactttcaaatgggctctactgctagataaataattgtaataagtatgcagaactaaccttcttcaagacttgttgtttatcatataacctctatctttaaagctaaattaaaaatatcagggaatctaaatgtacccttaatgaggaaatcattactatttaccttgttttttgtggggggatatttaatatttcaataatcctatcaaatactattttctaaatagctgtgtttgttaagaaagatttggcagcaattaacacactacctcaatgacagtggcttaaaccataaaaatatgtattgttttcttagtttaaaaccctcacaatctcggccagggagctcagtgatgtcagcaagaatccaggcttattcttcctgctttaccatgttttcattttttttgcatcttccaagttacaggtgtctgtcatagctcaaggcaggttatagtcatcttcagagcaggaagaaggggaaatctaacattagtctcaagactatctctttcactgggaaataaatttactttttagaaccacctccactgagcagaatgtctctgtgatcacttggttactcccacctgcaagaagtccagaaaaataattttctatcagatgagagttaaagttaccatgattggcataaacaaatcacagctcatttaatgggtttggcagattgccttattttctagagatcaagggctcttagaccaccacttaaacaaaatgggctccattagcaggaaaaaaacatttggggagtggctttcggtaggcagccaaaagtgtctagcgtagtagccattccccttgagtattatcgtgtgcttagacaggcaccacagatcaccaaacatcttgggagaaatatgtttcaggaaataacaaaagatagttttacctaaaagtatggagccatgtagaagagacaaaactgttcttagctgaagaaaggctgaaatgtagagatcaaaagggctcactctgtcttcaggccccacgtcaatgtcttacctgaggtgagggttaatggaggactgggcttatgctgagaaagccctggacctaccgatctccctctggctcctctttccccacaacgaccacactgttcccacagttatgcctgcccttactcgcgctaacacctctcgtcaatccaacaagattgaaacgcgagcaagactcatcccaacccagcctcaaagagactcaaacagcaggtagagatgccgagaacacaaaggaccgtgttgtcagctgtaacaaaggcatgaatgaatatatgaaatggagataataatagtaaactcctcacagagctgttgcaaggattaaataaaatagttacacatgataagagctaaataaatattgtagtactataaaaagggtggactcatatatatggaataaaattaatggtgaatggtcactgcttagataccactggtgaaatatttgaggttcaaagataaacaatatcaaagacttccattaaaaaacaaaataaatgttacctacacaaaaagaaaaataagaatcatttcttattactcttctaccacattaaatgctaaaagatactgtaatatctactgcattttcagggaaaaggtttaagagccaacccaattctactcacacaataaaaacaatagaaagacagtatcaaatactcaaggactcagattaaaacccacatagtcttcatgaaaaaaaaattgttcaaaacatactttaactaagaatagcagtcagtgtcatccttttaaaaactaggtcaaatcatgtaattctttctgctcagaactgtccaatcatccccattcacctaacaggggtcaacacaacaaggaccaaaaaaatctggctcctatgacttctcttacctcatatccaactcccctcacccttggccattcagctgcagtcacagtgacttgaaaagctggagacattctcacctctgggctctgaagaaacagtcctttctttccctcctgttatctgaaagacactctctcatcttcttgctcaaacatctgttctttctgtggactccttgaccaattgtttatttgaatatcctcatccccagttctattttctctcttctgggcatttccagtatgtgctaggatgtgagttctctgggttttccctatctaataacttgtttcatcttttttccctttgctgtgtggtctggtcattttgctcaattttatttccaatgtgctaattctttttttaatagctctggattatttttaaattatttgctgtgtattttttattttaaagaactcttcttggtctataattactcctattctccaataacttgttcttgacttatggatgatatatgttctcaaatatctcgaaggacacattcaaattttaaaattctctacttttttttatatcatttctatgtctaagatctgctaatctgtttgtccaccttggtctttctcttacagactattagtattcttcaaatgcctagttattcttggttatacattcatatttattaacataattttatattactcagcataaattgctatcatactttttttagtagtgtaagtctgtgtacctgaataggaagagctcattgagagttccatgaaagttgatggattctgttgaaaatcaagctttcctttatagtgtataaacttggagtagggaagatagctcaataacttcaaaaatgtcaaaataaaatatgttacttggcagtagaataattctccaaaatattgttctgttaggtaccagttcttcccagaacattgtggaaatatggtttccttttaggttcttctttacttcattcaactcactatacactttatgattaactcctctccatgtctattagtcactcattatagaaggtaatcattgggtttccatctgtgaactactattgtagaattctgctcaaacatatgtgggagaacgaggagccaccttagaccacatatatttctgtgactctactcaagtctactcttttttggccttccagctccaaatttataatttctctgaggctcagccaggaagagcttcttcctaatgtgtagcttcttactcctataccatttccaaactataacttttttttcacacatctactttatctatcagtatatcccttcccactttcggagttctacaagtttgtcccatctctggtttgctggaggaatcctctcttgtttacagaattcccaaggactcactctgttttatatctttactgccattcaacggcagtggacaaacagattagcagatctcagacatagaaatgatatctggactaaagtttcatgacaaagatgcctataaaccaccaaagaaaaggatgatcctgattccaaaccaattatttaaacatgacataaattttatggaaaataatctataaaatttcatggccgagacttctctcagtcttatttcaatacatgtccttattctgacttttctgcctttgctgattttcttgattttaccctttgatttgttctttattctttccattccacctctcctgcaaagtcctgtaagaaaataattcaagatgatacagaaaggaacatcttcatttcattatgcttttcctcccttaataatcatcatgactagagaatgacagatgcaattggcccaggagtctgatactaaagctgagtttttgagaacaaaagttaaaacatcaaagccagtaggacaaatgaggaaggcataaatacgtgcattttctaatttaaaatgaataaataaaaatatttttcattttaaattgatgaatcaaataaaattagaataagagaaagtagaatgtaataggattatccagtttgatgcaaatgttaattcattaaatatcattgtctttgtacttgccttagtaactactgaaacgtacttatattgatgatggctgtcacttaaggtctcgttttattagatggtgaaaaacctcctttaggaggctttataattagcatagacgatcatcatctgttttggatgattttggagacagaatttttaggccccttccagctctgatcctgtgtctgggtctaaacaaaatgaatcatttccaaacaatgttctcaaatgcacacatcagcacttcctggtgctgccttgtctgagaggctcaactacaagcacagacttgtaaacaaccctttacttccccttatcctaccacttatcccaaaacacatttcttgttgttttcacagtgtgccctgtttccaccttctcacacctgcttctctgctctgtcctcaccccgtccacacactgtactcaaatacatatacctactgattctttccagctcatcaactaatccctcatttccctccaagtcagactgcccagctgcaagagcatcattaaattatagtttatatgctctccttcttgctgtaatatgaagtaaataattgttccaaaaagtgtttttctctggaaaagttttctcctttcagagacccaagtttttataaaaatttaaggtaattaaaagttttggacttggtagagagagacacttgctcacatttgcacacaatgacccaccattaagtaaaattattaagtacaacacaatccatctttagttataaattatacggttactcaatctcagatatatatatacatatatatgcacatgcacatataattgcaaatatttctcaataaaattaatatgtctaataaaatactttagagttaatataggtttctgaatcctatctttccattgatttttattataaaattaccaggaaaaatggaaataataatagcaatatttaatgttttttgaactcttaccatgttccaggcactattatcaacacttcaaatggaataatctatttaatcctcataacatccctatggtctgggtgttacttcttcccatattttatggataatgaaatgagatgcagagattttacatattctacccaagatcactgctactaaatgacatagtgaggattcaaatctgtagtctagttttaaaattcatggtcttaaccaacacaatttaatgcatcatgatataatgaaatagtgctaaatacaaataaggcctaaaaactatcaaatggaaaattcaatagagtaccaatgatgtcattgaacgttttaatagtaacgtagttatatgctgcacgatttcatcaaaataagttaaaatacatctttgcttgcaagaaaaaaatgtcttcttatgttaaaattatgcatatgctatgaagtgagtctttgtatacccccaaaatttatatgttgaaatcctaatccccaaggtaatggcattaggaggtggggctgctgggaggtgactggttcatgagggtggacccctcatcaatgagataagagcctgtattagtcaggcttctccagagggacagaactaatggaatatatatatatatgtatatatatatgattatgtatatatacataattatatatgtgtgtgtatatacatgtcaatatatagatgagtttgttaagtattaactcacacgatcacaaggtcccacagtaggccatctacaggccgaggagcaaggagaaccaatccaagttccaaaactgaagaacttggagtctgacgttcgagggcaggaagcacccaacatgggagaaagatgtaggctgaaaggctaggacaggcttcttttcacattttgctgcctgcttatattctagctgcgctagcagatgattagattgtgcccacccagattaagggtgagtttgtctgtgccatcccactaactcaaatattaatctcctttggcagcaccctcacagacacaccaaggatcaatactttgtatccttcaagtggacacacagtattaaccatcacaagtccaccccttgtcaacttgatcctatatacgtctcctgagatcatacataatcttcaaaaaaagacaatgataaggtcataatcacatctaacatgatacaactttcctttgtacaaccagaaatgcaccaatccccaaccccaatactattacaaaaagttaacaatacttaaatgctgatgtgaagtcaataaatcttatgtcacatgataaagaagagaggaaataaaatgaagatattttcttagtacaagtgtatacatgcacaaacatgtttttaacaaaagaagaaagaaatactcaggacccaattacagtcctcatttctgtggctggtcacgtggtcgtagctgttatttatgactaccttattctactccccattctgtattccctttgccttcagcaagcacctcagcaggtagtggggttttttcctggtggagtgacccaaaacttcattccagaagtcatctgtagtcagtccagaagtcattccagaagggaggtcatttgtagtcctccctggattgggctgttgtagtttcccattgatcttaatcacaggacatggtaatactaagagacatcctaatggatctgctgtattccatgcattctcttccttacctttgttgtggagtagtagactgatttcatcttaatagtctgggtcaatcaccccagccaacactgtaactctcttcttagcctgttgacttaaaggtaggagaaggccaaagtatccaggtggcaatctcaactttcagtttgatagaatccttgttgtatctcctggtggcagcattcctccctatggaactaagacctctaggtcagcagaatgtaatgtcatgggaacaggaagcaaaaattttgctggtggatcactaggggtgatggtgagtggtgccacttccacttccaccccttgcttcctggacctatgaatcctggctatgggagaaacagtaccatatattagatgctgattcagaacaaacacagccttctggagaactttgctccagccctgcaaagtactgtcacctagttggtggtgtaattttgatttcaaaatggcattccaccattctatcattccagttgcttcaggatgatggggaacatggtaagaccagtgaattccatgagtttgagcccactgccctccttctttagccacagagtgaatgtcttggtcggaggcaatgctgtgtggaataccatgacggtggataaggaattccatggttcatggacggcagtcttggcagatgcattgtgtgcaggataggcaaacccatatccagagtaagtgtgtattccagtgaggacaaacctctgccctttccatgatggaagaggtccaatataataaacctgccaccaggtagctggctgatcaccccgaggaatggtgccatattgagggctcagtcttggtctttgctgctggcaaattgggcactcagcagtggctgtagcctggtcagccttggtgagtggaagtccatgttgctgagcccatgcataacctccatccctgctaccatggacactttgttcatgggcccattgggcaatgatggtggtggctggggaaagaggctgagtggtgtccacagaaagggtcatcctatccacttgattattaaaatcttcctcttctgaggtcaccctttggtgagcactcacatgggatacaaatatctttacagtttttaaccactcagagaggtccatccacatacctcttccccaaatttctttgtccatgcttcttccatgtccctgactatacacccaaaccattggctacagcccattaatcagtatataataacatatctggccacttctccttctatgcaaagtgcacaaccaggttcactccttgaagttctgcccactgggaagattttccttcaccgctgtccttcagagatgtcctagaaaggggctgtaatgctgcagctgtccacttttgggttaagcctgcatatcatagagaaccctctgtgaaccatactctagccttctcttccgctgtcaactgatcatagggaacttgccatgaggccaccagtgcaggcagtgggagagaaggcagggtgacaggagtggagaccatgggcatttgagccacctcctcatgtaacttacttgttccttcaggacctgctcgagcccagtcacatacgcaccacttccatttgatgatggactgcctctgtgcatgacccactttatggctagatgggtaggaaagcatccagttcgtgataggcagttcaggtcacatggtgacttgatgacccaatcaaacattcagtttccaccaaagcccagtaacaggccaagagatgtctctcaaaaggaagctagttatctgcagaagatggcagggccttgctccaaaatcctggcagcctctgctgtgatttacttatgggggcctgccaggggctgcaaacagcatctccgtctgccgctgacacctcaagcaccattggatctgctaagttataacgcccaagtggcagagcagattgcacagcagcctggacctgttgcagagccttttcctcttctggacaccactcaaagctagcaacctttcaggtcacctgataaattggccagagtaacacactgaaatgaggaatgtgttgcctccaaaatccaaataggcctacaaagtgttgtgtctctttcttagttttaggaggggccaaatgcagcaacataccctttaccttacaggatatatctcaatgggccccacaccattggacctccataaattttactgagatagaaggtccctgaattttagtcaaatttatttcccatcctctggtatgcaaaagtgtcaccaataagtccagtatgtttgctacttcttgctcactggatccaatcagcataatgtcatcaatataatggaccagtgtgatatcttgcagaagcgaaaagcaatcaaattatctccaaataagattatgacacaaagctggaaagttgatatacccctgaggttggacagtaaaggtatattgccggccttgccagctgaaggcaaattgcttctggtgggccttatggacagaaatggagaaaaatgcatttgccaagtcaatggctgcctaccaggtacaaggaaatgtgttaatttgctcaagcaatgaaaccacatctgatacagcatcacttggttaagcttacgataatccactgtcagtctccaagatacatctgtcttccgcacaggccaaatgggagagttaaactgagatgtggtgggaatcaccacctatgtgtctttcgagtccttgatggtggcactaatccccacaatcccttcaggaatgcaatattgttttggatttactcatttttttaggtagaggcagctctaatggcttccatttggcctttcccaccacaatagccctcaccctaccagtcatggagccaatgtggggattctgccagctgctaagtatgtctatgccaattatgcattctggcactggggaaatgaccacaggatgagtccggggacccaatgggcccactgtaagtgagacctgagctaaaactccattaattacctgacctccataaccccctactttaactggaggaccacaatgacgttttgggtcccctggaatctaagtcagctcagagccagtatccagtagtctctgaaatgtctgatcatttccctttccccactgcacagttaccctggtaaaaggcaggacgtctccatggggaaggatgggagaaagattaacagtatacattgctggtaatgtagtggggtcctttctcaagggtacccggcctccccttcattcaaggggttcttggtctgtaagctggctcaagtctggaaattgattgaagggccatgattctctgtttttataattcaaattagtcttttgtccattcaacctagaagtgttctgcttttataaattaagtaggaatgcagcagccttcctatcaatttcacttctaggaacaccatggtcaattagccaatgccagagctctacatagtcagactgttctgattgccgctttgtctctgctgttcattactgtaattacacccaccttgcctttgactgttgagtgctgccacttggcctctgcctccttggaatctagttattcccaccgtatttaaattttgtaattgagtgactgcagttccctccattagatctgacctacagagaagagcaatcacagggctcttcaaagatgcaggtgctgtcctcacaaatctatttcgcaaggcattggtcaagagtatatcttctggacccttccagctgtgatgagtaggtctaaagtgactaatccactacaacataccaatctccctaagccttttgatctcttcctctacattaaaccaagggatatcaggcatttccagcttactcacagtgcgccatcttttaatccatatttcagctaaccaagaaaataaactattagaaccttttttaattccttgagctaaaacattaaatgcagagtccttacttagtggacccaaatcaataaattcaacctgatccaactggatgttccttccaccattatcccatacccataatatccattccaatgcctgttctccagatttctcttcatacaaattagaaaactcaagcagttctttcacagtgtagcccaccacctcatggatcacattctcaacctcacctctaggggcctgctgggacttttaatctagttataggtctagaagcaaacagggatgttgggggtggcttctgaagagaatcaacaaaatcttgcctggcaactccctcaggggaggccatcactgttgcctcaggcagcacagggtttatctcctcagacaaaggtggaaaggctgatggcaacatcagttggggagaggatgttgccactgctggggatggtgaagctgtcttgtctggcaaaaaggttcatcagagtttacaaactcaatgtccccagattcatcagggtccccccacacatccccattccaagtttcagggttcccttcttttccaatcaataccctcactttaacagtcgacatctggcaaggctgtgcatgcatttttagttgcaggtaagccactcgcaagataagagctcatatctgtttctccacaatttcagctctttctctactggagataagactctcactcagggcaatcttaacagacttaaggctcagtatgtgcttctgaaccctgagttcatcattttctttcatcactttgtccactgaacttaggaacagccatctttcttcattatgtttcttggttctccacatatggccaaaggtattatgtatacagttactaaactccttgcctctcacgactgatcaatcaggatttttaaatgcatttattttgcataaatctctaaatagttcattccaaggactatcagtgttctccatactattagaagcagaatccttagcattttgggtctgatcagattttagcagccaactccagaaacccccaaaaccaatgaaagaactccattcttaatatatatataaaagggagtttattaagtattaactcacgtgatcccaaggtcccacaatagactgtctgcagaaggaggagcaaggagagccagtctgagttccaaaactgaagaacttggagctcgatgttctatggcaggaagcatacagcaggggggaaagatgcaggctgggaggctaggccagtctgtcttttcacatttttctgcctgcttatattctagctgggctggcaactgattagattgtgcccacccagattaagggtgggtctacatttcacagcccactaactcaaatattaatctcctttggcaacaccctgacagatgcacacaggattaatgttttgtatccttcaatccaatcaagttgacactcattattaaccatcacagagcccttataaaagatgtttatgagagacccctctcttcttcaatatgttaggacacagcaagaaggcaccatctgtgaaccagaacgtggtttctcaccagataccaaatctgccagcaacttgatattgaacttcccagcctctagaactgtgagaaataaatttctgttgtttataagctaccaagtttatggtcttttgttataacagtcccaatagactaagatagcatatgctacatccacatactcccctagagctactgtgaaaggacagataagtatacaaaataggacatgaaagaattgtagttatgcctttgtatgttacatgattatgtgtttcctagtgcctagcagcatcctttgcacacaagtggcatccaataaatgtttattgatttggatagacatttattggtagccctgcaagggaattataaggcataaagcatccaaatgccttcttcaaacatagttaaatttaattctatgcggcagtataaattatgaaataatctttttttcaaaagtcttcagcaatatatgggcaggtaaatgctttggtcataggctgtaagaatgttgaagcacagacatcagaaatcttctagcccaaacctctcatttacaaaagagggaaatgttccaagggttcattgacttgcccacacagctggttcattgcaaaagtgtgactagtctctggatgcctaggttgacttgagaggtgcaggtatgtacacaaacgcacacaaattctatctgccataaacagtctttctcattagtatactacagttctgaaatcctagcattaaaagatattgcttttaattatgtaaataattaagtcatctggtacccaagatttgggggaaaaaaaaaggaaaaacaatggcctgacccttcacatttttcatgagttggtgctgtgctgagtgttttggctgtcaggtaactgctaattgaatgctttctgcagctccactggtagcaaaaagttactatgtacctgaggaatgctcttagtggacatctggaacttgttctccagtagtatttttatttctcattttaaccttctctattctaaagtgaggtatccaccgacccaaacctaagagagtgctaatgctgacaatgtgtataaagggaagcataatctgtctatctctcttggctttcttgcctactttgcacctcttagatgtaaaaacaaaataagacagttgaatatcgagcatgtcacataaacagaaatcacctgttaactccttaaaactatatttatttattcatacatttactagcatcgattagttaaaaatgtagttgatatagtgattattgttgactcctcaacatccagtttatcaccccaacaaatagcatcagtacaattttgtgaccaaggctggattctgatttattattattgaagatacttaaaataatccaattccctttggcagtgattgggatgagtcctttggccaacttggtcttatgagacatgagaaaatatttagagggcttctaagaagtttcctcactctcacaaacaaactacagaagaatgacagccctctgtccctttcctactggatgtgaataaaatgtatagcccttattgctactacaacgattatttaatgacatatcagggttacctgggccagataattctttactgtagggatattataggatgtttaacaacatctctggcctataaaactagatgctagtagcacccttccagtcatggcaataaaaatcatttccaatattgtcaaatgtgtcccctcgggggcaaaatcttccccagttgagaaacatcgacttagataaagctagaagagtagacagcagcagggagagattaaaggaaactaaatgcatggctatgtcattaagactctaggtcaactcattctgaaaacttctttacatctggcctatcacatgagccaataaattccatgcctttactctcttaactagtgtgagttgatttgtcgcctgcagtgaacggcagcatagtggttactgagcaaaacctggagtgaattggatagtggtaagaagagataaaaagatacaatctcaaggaaaaagcagatggcttatggcagaagatgagaaatatcgagttgggggcacacgatggtgattaacttggagaagtaagtgccaaaacaggttgttagaaataaaaagggaaagggcaaaagtacaagaaagacttactcttatagagagaattttaaactaatgctagccgcattttactatttttccccaattatttgtttcaacagcaaacgtaatacatttgcatagtacattcacctccctcttccctaaatgactacttcacatgaccaagctcttcaaacctcaaacactttctcaacatcttcacatggagagggatgtggaggttcctctccaccccccacagtcaaagttaagttgtcatcaacttaaaataacctgctataactataatatgctctgtaagcctcatggttaccacaaagcaaaagcctatattagatgcacaaaaaataaaaactaggaatgaaaacatagcactagagaaaaacgtttagatgcaaaggaagacagcaagagagaaagaaaggaagtatcaaaaaaaaaactaaaaaaattaacaaaatgaatctttacctatcaataattatattgaatgtatatggattaaattcttcaatcagaagacatagagtggctgaatagattaaaaaaaaaacaggacctagctatatactacctacaacaaactaacttcacctgtaaggacacacataaactgacagtgaagggatggaaaaagatctttcatgcaaatggaaaccaaaagagggcaggagtagctgtaattatatcagataaagtagactttaagtcaaaaattataaaaatagagaaggaaggtcattatataatgataaagaggtcaattctgcaagaggatataacagttgtacatatatatacatatatataggcatctgacagagcaagtaaatatatcaagcaaatattaataaatttgaaagaaaaaatagactgcaacatgatgattgtggggacttcaagaccctgctttcgggagtagatcctccagacaaaaaaataattcaggtaatgtcagacttaaaatagagtttagattaaatggaccaaacagacatatacagaacattctacccaacagctgcagaatatacattcttcttaagtggatatagaacattctccaggacagattatatattatgccacaaaaccagtcctaacaaatttaagaagattgaaatcatgtcaaatatctttaatgaccacaatgaaaaaaagagctagaaatcaataagagaaagaattttggaaaattcacacctacatggaaattaaatgtggtcctgaagaactaagaggtcaatgaataaattaaaaggtaaattaaaaattgtcttgagacaaactaaaatgaaaacacaacacactaaaacccatgagaaatagcaaaggcagttctaagaggaaagttgatagaaataaaaagtctacatcaaaatagaatgatctcaaataaacaatgtaatgttgcacctcaaggaactagaaaaacaagaacaaactaagctcaaagttagtggaaggaaggaaatgataaatactagagtagaaataaatgaaatagagaccagaaaaaacatagataagatcaattaaaccgagatggtatttttaaaagataaaattgacaaacctttagctaaactaaataagaaaaaaaagagaaaacgcaaatatataaaaacagaaataaaaataaagacattagaacggataccacagaaatccaaagaatcataaaagactatcatgaacaattatatgcctacaaattgcataacttagaagaaatggataaattccttgacacataccatttatcaatattgaattatgaagaaatagaagatctgaaaaaatgaataatgagtaaggatattgaatcagtaataaaaagtttcccaccaaagaaagccaggacttgatgacttcactaacgaattctaccactgaattcacacatgcatgtatatacacatagagatataatgccatgattttcatataaatcatgtgtattcttcacattcatatataaacctatattcctcacaaacataaattatgtacatattagtcttattattatgtcatgtatgtcatgaacatctttttcaactaagtacacactttctatcatttttgctagctgtgtattacatcagtaaaatttactataatgagttaatcattccattatttaaatttttattgtatttagagtaacattctacaaagaatatctttcttaattgtatgtattggtatttttgattttgctcctgtagatgagatcttttaaattttgtttaaaaataatgatttttagcataaagaaaaactattgagctttgtcttgtacctagtcacttaatagcatttattttattagatttaacaaattttaataaaattttctaggagtacattaatatcatctgagaataattatgatattgaccctccttttgtgatatttagtgtgattaattgtgcttaacatattgtatttggtagaaattccaaaaattatttgaacaatagtggtaacagaaattatcctaacttctttccaaactaacacttgtggaatacagtcatttatgtatatgtgaacaattaactgttactaatttttaattacatttaagaagttcccttttattatttcttggcttttatcaagaataaatgctgggccgggcgcggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaggagaatggcgtgaacccgggaggcggagcttgcagtgagccaagattgcgccactgcactcccgcctgggccacagagcgagactccgtctcacaaaaaaaaaaaaaaaaagaataaatgctgttgatgtttatcaaatgctttttggagggagcatttcaggatgtaattgcttactttttcttctttaatttgttaatgaaattaattaacacagtgaatttcctaataatgaatcaccctttcattcctgaaattaatctgcatggacactggggattatatgctgatttattcactttgttatacacctggattttctttaaggcctggaataggtattgttctgtatctatttggtcaatgtggcataaagggatagtcatgaaattttgactttcagtgaattggaatcaaattctaacttcatgttttagtagctgtgtgacatgggcaaattaaaatctctgagtctaaatgttttcatctttatgcagaactgctataagtttctgaatatgaatttgttaaagaataaaatgtgagaagatatataaaaccctggcatggccccaactctcagtaaatgttaatttacctgttctgtgaactaataagtaaggatgccaggacaacacatagctatgctttcaagtggattaggatgaatttcctcccgagttactgtggaaatgtccaattgtgtatgcataaatagcaaaggtgatatcaatatcatactaaaggtctttttttttctgttactgctttaataatagcagctgccagtgagtgaatctcctggctgaagtacctttacagcaatctgtctttttcataacagaactgtttgatccaaacatgtgttcttgtcaaacctttcccaggactccttatttataactacagtaaatgcagccagtggccagtgtagttctccttacatataatcactaaaacatatttgcaattgaatagttactgctgtttccttctctgaatttctttctaggacacatggaaaggcagaaggccactgtttgcatagccaaacatctctgtgtctggaaatttccttgggcagtctatgcagtaggtttctaagtatgatcagcatgcatcttacactggaaattgtgaaagcagctaccagtactatgtctggcacagacaagattttaaataaatatatgaataaataaaaggataagaatttaattaaaagataagttgtttgggaaacatcttaataacttggagtactgaaacaaatggttttaatagaaaatgtaacttatccatccattcacacattcattcaaataaatattgactgagggcttgctatttttcagacactaagtcactgcaaacattctgttcactatgacatcctggcctacatggagattacagtgcggtgaatagatggttattgaacacacacataattccaaaattactgaagattttagagaaatctaattatgaagcttgtaatagggaataaaaatatagaaagttcatgttttatctatagaaattgagatttggtgcattgaatcctccttaatctacatttgtactggtaatgtataagaatagcaattgatcatattatgatcaccttctgaatactggatgatctaaaatctgattgaagatctagtgtttaaatgagctttactataaacttatcatctacaaaatcaagagatcacatgcacagagaacaacattgagtcagccatttagaggttggctattttctttcaaaagctaaacatccttttattgcccattagcaacacagcactgagaaataatactattcaaaaatagacagctaaatctttaaatgctaacatagtataatctgtaaaatgctgactggatgaaagtaacacagaaagagagtagaatatgctcaacaaatggaaacataatcaaaaccataaaatatgttataattcaatgtagaaaaaacacataaggaaaaattacagatgaattttacataagattgaaggccctacacggatatttaagaaacaactactctttgactagtctgggcctacaagctgaacatgggtaactttcacttttggtgagaaaaagccaatcaactagcatgcaatgcactcatccctggcaataattatcaagctcctttactgtcttctcataatcttctggcaagagtctatagaaccttgaagatcatcagcttctactcacagaaattccactatgactacatgaggaactcttggttagatacccaaaagcaacacatatgcattttgtgaactttcccttactctgccctattaggtagacccctcccatcacttcctacccttatgaaattatcctctcaaggaactcagacttcatgaaaaacaagattctgaaaggcacagtcaaccatcctttgaagaaattgccaagacctggctctcttctcagaaaaggaaacagaaaagtagagtgaacacaaaatacatatcaatatctcaatattctcagcagaatcttccattcacttggatccccttcatcggaattttaaatccttaagtatttcccatcagcctaaaaacaaaaataaaaccaaaaataaattctttaccaccaatgacaactacactgtcaaatttcatgtcggactattttttttcagccctctgagttattgacctgattttgaataggaatatactccaataaaaaacacactgccgatctatcctctcagctggttttcaatatttttgattagctcttccttcttcaaaccttccccagtttttcctctataacaaacacctcttgcttataccaaccttttgatcagctctcagcctcctcaacccaactgttagatgttagagttttttatggctagactgtaagccttcttctcattctgttctctcatccaagtctacagtttcaattccaactagacaccaacatcttgcaaatttacattttaaccccagataattttactgggtttctgtgttagttcgttctcatactgcttgaataaatacctgagactgagtaatttataaacaaaaaagatttaattgactcacagttctgcattgctggggatgcctcaggaaacttaaatcatggcaaaggggaagcaaggcactttttcacagggtggcaggacagagtgagtgcaagccagtgaaatgtcacatgcttatataaccatcagatctcatgatactcattcactatcacaagaacagcatggggaaaaccgccaccatgatccagttacctccacctggtcctgcccttgacacatgaggattatgggtaatggggattaccattcaagatgagattttgtgtgggggcacagctaagccgtatcagttccaaacatgtatgtagaattatttactgaacagtttcacttagatatctcaatgcgcctcaaactcaacagggccaaaaacaaattcctgatttctccctgccaaaacaaattaacacaatgaatgaatgaacaaagcaaatcaatttctacaaaattaactacctggttgtcttctggtgtttcttatttcttatctcaacatccacatacgactggataaattagaaacctaatgcttagccttactcccatattcaaccaattttttagacttcaattcctaaacctctcttaaatgcactcactcttttttagcctgtctctcgtaaccctagtataggcattcattttccccaggcttgatttctgaattgcctgactggtttcttcgtatccactcacactgtcttccaatcctatcctcataccaccattaaagtaatgttttgaaagctaaaatttcatcatgcttttctcccttacttagaaacccttcaatagcatgttggcctatttagaagaaagtcttgtaccgtcctatagtatgcaacgccttatgctatttcattgctgcctacatttcttgctttgtcttacacagtccacccttgctgtctgctccagcttcactgacattttctcagttcctcagaataaatcatcctctctcccaccacaagtcttttgctaaaactgtgccctatactctagtgccttctcaactttgaagaaagttctcattcatgccaactttcatttcctgagagaactctcataagccataaatcaggtcaagaacttgtgttacatactctggtagcacaacacaccagttctttataacagcattgttatatatcaaatagtatttgtaataaattgattattgttcctctttcccagttcctctccataatggcaaaaatcttgagtgcttttgtcacagttatatacctagggtctggcacagaacttgtcacataattaatgtttaataaattttatggtatgaaaacccaaaggaactaattctatagagatagatattagttaatttgataaagtgggactgggtgcagtagctcatgcatgtaatcccagcactttgggagactgaggcaggttgatcgtttgagcccaggagttcgagaccagtctggacaacatggtgaaaccctgtctctacaaaaaaattaaaaaaaaattatccaggcatggtggaatgcatctgtaatcatcgctactcaggaggctgaggtgggaggatcaccagagcccagggagatgcagtgagccatgattattccactggactacagcctggctggcagagtgagatgctgtctgaaagaaaaaaaactgatatagaggaacaaataactgcctgtttttcaatcatttatctttgatcaagaagtacataaatactttttgatcagtgtatattgacattaataaaaatgcctattttcttacctgtgtataccttaataatatttttgaatgactgatcagtggaagagcaggaaagagtaaggtggaactttgcatttatttcacttctccattttcataatgcaaaatgttggctcttattatttatatataacttgaaacatattgctggtttatatctataaatatagatataaatattatatatgtcataattataacaataaagtatttaagggagctggacccttcctatcttcaatagttaaattagtcttttttaaatttaggaagagatattttttacaacttcttgacaccagtagtcacaaagtgataatgagaatttataaaaatttatcaaaaaatgaaaatgtcaggcaatgcttgactgtattgagagacctatggattttaattgcagttggtaaaacttgaatataactagctgattttccactcgccatggtggaggcaaaaaaaagcaaacaaacaaaaggaggcatccttttaagtaattgatacaatttatggtgcttattaccaacttcgagccatttacaagctctgaaaaaaattagagccactgatcaagaatatatatcccaaggctatatagctaatatactagcataatcaattcttttaaaattgctgtttaatttcaatgcatatatgctattcactaaaatacaaatgtaatttttaactatcacacaagatatcaaaattgattttacatttttattttaaagttttcattaggtgttcattgactgtaagactgagtgtctattagtcataaaattctcagctgaatgtatcctaaaatataataaattattatgtgccactttactgctaatattttcaaatccaagtttgtataacacactctccaacttctttttaaaagctacaaaaactatgtcacaggcagaaacactaaaaccagattctaagtattttcaaaggagacaaatggcaaatgcacatttagctcacaagcagaagacctctcttaatttattcaacaattaaatttgttagatactacactggtagctaagaatgttcccgacctcacagggcttaatctagttctctccaaaaattttaatcacaactttggtaaatcctgtgacatatagatttattttttaccctcaaccattgtttgtattatgattctcattatattaaaatagcatttgaagttgacatttaattgttcatattatacataccaaatagacaaaataaatattttgatttgtcaatatttgattttgtcactttttaaaaatattttttaaaattaacctcatatgtacatcaaatgaaaaacaaaatagatattatctttagaagggaaaatggtttttcaattcactttatgaccgaagacttcatattttaaattattctaggtcattttaaaaacaaatgttctcatctgttcccctttactatttatacaccttctagatcccaccccacaggttggcaggaatttgcatggctgtgttgttggagggaagtattcatgctgctagagtggagcatgaatgaaagggtgtgtccagggatctgtaaaaatgtttttcttgaacagtattgactattctttaatgccagttgagtcatgcaagatcatgcacttccagcacaatgaagggaatagtctctgttctccatctatgttaatttgagtggattttgaaaaccagccacctgtttttctctacctgttcatcacaaaattatattttgcaatcagattaaccataataccgagatgtagatagaaatgatttgtatacaactattactactgcttatgtcagtgggcaaaatgggttatgcaaaatgggcaaaatgcaaaaatgcattttaacacccctccctttgtcttataattgtcaatgaatgcctcctgatctgatcctaccatcacaaggaagttccttaaggacaggaaatacatgttacttgtatattgtaatattcctaatatttagcaaatatttctacatttaataagcactaaaatttgcaacagtagaaacaaaatgtgccaattctccatttaatgttctgataaattattcagcaactcacagtgtacagaagaaagacactggaattatatcactgataggttagattactgttaccaactctgcaacttgttgaccttgaatgaacatgtttaataagttccttttatccagaagtaggattacttgatcatatggtagtattatttttagttttttgagaaacctccataccattttccataatggctgtacaaattcatattcccaccaaaaatgtacaagagttctcttttctccacatcttagataatacttgttattgttcttgtttttgataaaagatattccaagaggtgtaaggtaatatctcattgcagttttaatttgtatttccctaatatttagcaatgctaagtattttatcattgtattagtctgttctcacactgctaataaagacatacctgagacttggtaatttataaagaaaagaggtttagtggactcacagttccacatggctgaggaggcctcaaaatcatggtgcaaggtgaaggaagagcaaagacgtgtcttacatagtggcaggcaagagagcacgtgcaggggaactgccctttattcaaccatcatatctcatgcaacttattcactatcactagaacaccacgggagaaacccatctccatgattcaattacctcccactgggttcctcccacgacgtggaaattatgggagctacagttcaagatgaaatttgggtggggacacagcaaaaccatatcaatcatttatatatgggttatttgtaggtcttccttttgaaaaatgtctgttcagatcctttgcccattgtttaatcaggtcatttgttttctttctattgagttacttgagttccttatatattttggatattaaccctttatcagatgtatagttcgcagttattttctcccattctgtggatcatctcttcactttgttaaattgcttccattgctgtgtgaaaactttttagtttaatgctatgccattggtctatttttgctatattttcatttatttgtgttttctttaatttattttatcaccattatatagttttcagtatacaagtgagttaccttcttggttaacttaacatctaagtatttaattattttgttccaattgcaaatgggattgttttcttaatttccttttcagatagtttgttatcagtatataataatactccctgtttttgtatgttgattttatatcctgaaactttagtgaatcattttatcagttctaaacagtttttcagtagagtctttagggttttccatttaaaacattgcattattatcaaataggaacaatttaacttcttacttttctattaaaatgttatttatttctttctcttggctaatttccctggctagggcttccagtactatattgaaaatgagggctgggtgaggtggctcatgcctataatcccagcactttggaggccatggtgggtggattacttgagctcaggagttggagaccagcctgggcaacatggcaaaaccctatttctaccaaaaatacaaaaaatagccaggcattgtgatgggcacttgcagtcccagctgctcaggaggctgaagtgggaggattgctggagcccaggaggtggaggttgcagggagctgagattgcaccactccactccacccttggcaacagagtgagactctgtcaaaagagagagagagagaaagagagaaagagggagagagagagagagagagaaagaaagaaagaaagaaaagaaagaaagaaagaaagaaaaagaggaaagaaagaaaaaagaaagaaaggaagaaagagaaggaaagagaaaagaaagaaaagaagtggtgagagtatctttgtcttctgatcttagagaaaaagctttcagcttttcaccattgagaatgatgttagctacagatttgtcatgtatggcctataatgtcgaggaacatttcttctatacctaatctgtgagagtttttatcatgaaagaatgatgacatgctctttctacatctattgagatgatcatatgattttcatgcgtcattttgttcatgtggtgtataacatttatttatttgcatatgttaaaccatccttgcatctcagggttaaatccattgattgttgatgttgtttgaatctgtgtccctacctgaatctcatgtcgagttggagaagcagcctggtgggaggtgattggatcatggacgcagacttccccttgctgttctcctgatagtggttagttttcgcgagacctggtggtttcaaagtgtgtggcacctactcttcactctctgtctctcctgctctgccatggtaagatgtgcttgcttccccttttccttctgccataaagtttcctgaggcctcccagccatgactctgtacagcctgcagaactgtgagtcaattttcttcagaaattacccagtctcaggtacttttttatagcagtgtaagaatggcctgacacagtcatggtaaattattcctttaatgtgttattaaattcgttttgttcagaatttttgcatctatgttcatcagggatatttgtctgtagtgattttttacttgtagtgtccttgtctggctttggtattaggctaattctggtctgacaacattaatttgaaagtgttcgatcattaaaaagtcaggaaacaacaggtgctggagaggatgtggagaaataggaacacttttacactgttggtgggactgtaaactagttcaaccattgtggaagtcagtgtgacgattcctcagggatctagaactagaaataccatttgacccagcaatcccattactgggtatatacccaaaggattataaatcatgctgctataaagacacatgaacacgtatgtttattgcagcactattaacaatagcaaagacttggaaccaacccaaatgtccaataatgatagactggattaagaaaatgtggcacatatacaccatggaatactatgcagccataaaaaatgatgagttcatgtcctttgtagggacatggatgaagctggaaaccatcactctcagcaaactatcgcaaggacaaaaaaccaaacaccgcatattctcactcataggtgggaactgaacaatgagaacacatggacacaggaaggggaacatcacacactggggcctgttatggggtggggggaggggggatggatagcattaggagatgtacctaacgttaagtgacaagttaatgggtgcagcacaccaacatggcacatgtatacatacgtaacaaacctgcacattgtgcacatgtaccctaaaacttaaagtataataaagaaaaaaaaaagttttcgttccattttgattttttggaagagttggagaagaattggtatttgttttttaaaaaatgtttgttagaattcatcaataaaactgcttgatcctgggctttttcttttttatgggaagctttttactactgattcaatctcactactaattgttagtcttttcagattttccatttttattatttaatctttctaggtgttatgtatctggaatttatccttttttctacagtacccaatttgtcaacatataattgtttatagtagtaccttattatcctttgtatttctttaatatcagtggtaatctctcctctttcatttctgaggttattttttcgagtcttctctcttctttttttcctagctaacctggataagggtttgtctattttgttaatcttttcaaaaaaaactattcttaattttgttgatcttttctattgtttttctagtgtctatttcatttatttctgctctatttgtcatttctttcctttaactttggcctaatttgtttttctcttcatagtctcttgaggtttaacattagattgtttgtctgagatccttcttttttgatatgggcatttattgctctatatttacccaataggatggcttttgatgcatcccacaagttttagtacattggttttcattttcattttactgaaggcattttgtgacttcctgttttatttattctgtgactcattggtttttcagggaggcattgtttaatttccacatatttttgtattctctaagattactcctgttattgatattttatgccattgtgatcccaaaagatacttgatataatttcaattaacttgaatttgtaaaatttattttgtggcctaatatattttctattctggagaatgttttgtgtgcaaacatgtattaaaggaagcaccaatacagctttcagcagaaagtataatttaaatccaatgtttatttattgattttctgtctatattatcttttcattgttgaaagtactgagctcctctactacaataatattgcagtctagctcttccttcagctcatttaataattgcttgacatattcaggtgctctgatgtgtagtgtgtatttattcacaattgttatgtcctcttggtgaattcatcccttcatcattatgtaatcaccttgtctgttttataatgttttacttcaatactattttatctaagtataaattaccctaccttcttcagatttttatttatatggaattatttcccttccttcaccttcagtctgtgcgtccatgttagtaaagtgagtctcttgtataaagtatatggttggatctttttttttaatgcattcagcaactctgtgtctctttattggagattttaatccatgcacacttaacataattattgataggtaaatacttgctactgccacttggtaatttgttttcttattgttctgattggtcttttggtatttcttttttttcctctctatcttcctttgtgactgtatggtttttggtagtggtatgctttgaatccttactttttatatattgtgcaaccgctgtaggtttttgctttgtggttatcataggcttattacataaagcatcttatccttatagcaggttacttcaagctgctaacaactttaatttcattcagaaactctacactttcacttcttcctctcccaaacactttttctgattttaatatcaaatttttacattttcctttcttttataatttgtttctcaaaagcaatttattgtgaccttagttgtttaaaatgatttttttttcttttaatcttcatggtgtggatacaattgtttacataccactcttgcaggattagagaattctgagcatgactacgtattatttataccattgaattttccacttttgtatgtttttgttattaactggtagccttaaagaacttcctttcacaattcttttaaagcaggcatagtgatgatgacctgccttagcttttgtttgtcagggtaagattttatttctccctcagtttgtaagtacaactttactgggtaaattattattggttgaaaattttgattgtttgtttgtttgctttcttaagcacttgaatacatcattccactctcttctggcctgcaggattcctgctgagaaatctgctgaaagctgtattggtgcttccttcaatacgtttcttacctcttgctgttttctttgtctttgatttttggtaacttgattgagatatgtcttggtgaactcctctttgaactgaattttattggccacctgagggcttcctgtgcttggattttcatcatctttccatagatctggtgaattttcagccaatatttgttaaatatgttttctaggcctttcttttcttttgttttctggaactcctgctatgtgaatatcacttcactttacggtgtcccgtaattcctatggttctttattctttttcattttttctcaaaaagagattgaataatttcaaatgtcctatctttgagcttgatgattctttcttctgcttaatcaagtctgctgttgaagctttctattgaatttttcagtttagttattgtattctttacctctaggatttctatttttaattgttactatgtctttttcaaaaaattctcattttgttcacacattgtatttcaaattgtatttacatttctatattttttttatttccctgagctgctttgtaaggattatttaaaattctttgtcagtcatttcatagatcttcatttcttctaggtacattattggacctttatggtttcttttgtggtgccacattttcctgattttttaataattcttgtgtccttatgttgatgcctgtatatttgatgagacaaatccttctttcagcctttgtggacactctttggtggtaatagttctttactatttagtctaggctgaaaattctagatgagttggctggtagcaccacaaggcagaaagatgttggtgtcagattttctggttgagctgggtcacttcctgttctctgaggtctaatgatacggttgtctatgctccatgctctggtgagacctctggctaaattctgctgtcaggcagagttgctagctaggctctgtggtattctgtgaccaagaagggctgcaggttgtcctccctggttaggagacactgttatttggaatctatagttgggcagagtcatgtgctgggatctgaggctaggtaaggtatctcaggttgctacttagccacacaaagtgggcagggtgagaggcaatgctctgtatatatgatgaacttgggcttgcttttctgcctcggataggcttaaatagagcacaaaggcttggtggagttgctgctcaacagctggggttggatgtgtacagatgtgccctcttcactttatcactgacttgaaattgtctccagatgtgagaaagacttagctaaaccacaaaggctctgtgaggaagctggctagggactcaaacctggtaaacctgtgaactatgattcctgcaatgtgatatcattggctggtcctctaatatggcacctttgttgaccagaatgcagagcgatgaattctaaaattattctccaaatgtcctattctaatatctgagaatgtgaataaaatagatagtattcccatgattagattatgctatggcacagttgactctaaaacagagattatttaagtggtcctgacctaattgtaagagtcctcaaaagccaagagtttcttatggctgattatagaagagaacaacaagaatttgaaattcaggaaggattttacatgccattgttgatttgaagatggcagactttacttgccaaagaacaagagtgacctttaggagctgagagcagttctcaattgatagtgaacaagagaatgagaacctcaaccctacaactgcaggaaataagcataagcttagaagtaatattttcactgaggccaggcacagtggctcacacctataatccctactctttgggaggctgagacaagaggattcttgaagccatgagttcgagaccagcctgaccaacatggtgaaaccccatctctactgaaaacgcaaaacttatccaggcagggtggcacatgcttgtaatcccagctactcaggaggctgaggcatgagaatcacttgaacccaggaagtggaggttgcggtaagctgagatagtgccaatgtactccagcctgggcgacaaagtgatatcctgtctcaaaaaaaaaaaaaaaaagaaaagaaaaaaagtagtatttccactgaatctccagatgagaactaaaccattcaacatgtagattttagccttgtgatactctgagcagaaaacccagcacactatacccactataccaaacttctaaatgatcaaattttaaactaattagtggatgttgtttcaagccactaagtttgcaataatttgttgcacgaaaatcaaaaagctaatgctaaccaagctggcctcatttttaaatgtaagtttaatagttgtaaatgcatactacacagaaaactatcatttaaaagataaataaagtatatttttcgtggaagagctttgatatggcatttcaaactttctttgggcaaacataaatctaatttatccctccaagtataaatgattccatttctaagccattccagaaaaccctttcccaatgtatttctgtgttaaataattctcacaactatgaaatttccttctaaatcttcatttcctcaggttagtggccgctagtgtaatatatggatactatctgctgctcctacctaggcatcttacaccttatataaaaaatgtatacatactgttgtgaaaaagtaaaaatacataaataatctccttaaagctgttagacctgggaggcagaagttgcagtgagccgagatatcgtgccactgcactccagtctggaaacagtcttgtctcaaaaaaaaaaaaaaaaaaaaaaaaaagaaactgttagagatggaagggaaggggaaagaactgcaaatgggacctagaatggcagcaagaacccagggaattttagcaaccattttgtttctctttcataaactgcaggatttttctcttcatgcatttcttaacaacaattttctctgacttctaaaaattttagcttcattttgtcataatatgattcacatgtatggcagttttttgagttctgatctttttctcaattggcaaatcatttccatacttctgactcagtgttgtaagagagagaacctggctggataagctcactttattccaccagtccacatttaaggccagtagccagtctaaggaaggctaccactggatccctgaggcaaaagaagggtgagatcacaagctctaaaattgattacctgtgcaaacaatagagatagctgcttccaagaacagactttgcccagtggtcatcagctctaataaagacttcatattggccgggcgcggtggttcacgcctgtaatcccagcactttgggaggctgagtctcgcagatcacgaggtcaggagatagagaccatcctggctaacacggtgaaaccccgtctctactaaaaatacaaaaaaattaaccagacgtggtggcgggtgcctgtagtcccagctacaccggaggctgaggcaggagaatggcatgaacccgggaggcggagcttgcagtgagcttagatcatgccactgcgctccagcctgggcgacagagtgagactccgtctcaaataaataaataaataaataaataaaacactcatatttattttctccatctctctgatttacaaactaaaatttgccttatctcttcctactgaaataacagaaaaatcacacttactaataggtgggagacgtaggtacaaaaacaaatctctgcaattgaacaattacaatgtaactaagctttccacagaagattttactcaaaaataattttctggaatgttactatagttgtgttataactatacgtctataaaggtaagtggaaaattaaactgagccaaagttaattttgaaactatcagataatcagaactgagctgggaataaagttattaaatcatgtccctcaatccttcaaaaaatatcagccaataaataagaactttggtttgacattgcttatattaaagtgaacattctggtcctaattagctaacagtaaacaatgctccaatcaaacagttctttaatttcaagaatgtaataaatgttatacaagttccaaggagatgatatcacctttttcttatataactaaaaataacctgtaaacttaatcttgcctttggataattaatgattcccagacacatacagaacaggagagaaaggcacagctgaaggggataatagtatgagtaagagtaaagcaaaggtgaaaacggataatgccagttgagatactgcgaagacatggaacaaaccattaataaagtgttttaaaagttggtttgtagtagattaagcccttgatatacaggatgtatggatagaaatgtgtaaaatacactgctcataacaatctaatgagtataagataatacatttgatggccgggcatggtggctcacacctataatcctagcactttgggaggccaaggcgggcggatcaccagaggtctcgagttcaagaccagcctgaccaacatggagaaaccctgtctctactaaaaatacaaaattagctgggcatggtggctcatgcctgtaatcccagctactcgggaggctgaggcaggagaattgctcgaacccagacggtgaaggttgtggtgagccgagatcgcgtcattgcactccagcctggaaacaagagcaaaactccatctcaaaaaaaaagaaagataatacatttgataacaataactgaggtttgtccggcctttagttaactttatgtcaggacctgttcatatatatatatatatattatatatataaaatatatatatatacacacaaacacatatatatacatatatatacatatatacatgtatatatatatacatgtatatatgtatatatatgtgtgtatatatatatgaacttagttttcacaataatcttttgatatagatgttattgctattctccattttacaaatgaggaatttgaggcaaagtgattaaatgacttgcccaagctcaaatagctaaaagagaaagttaaaaccaaaaatatcttatatgctaatatctactttttgtcactaaacctactttttctaccctgtgtacttttctcttttgtgtgttttaagaaaattagctacagtctgtaaagaaatcaattatatacatgtgagtatgtggagctatagatgagtatgtttctatgttaactatttcaagagctaatggcaacatgaaatccaagtttggcttggattagaacaagcacaaacttgttgaacctaaaatgtatattcattatattcattttttaaatgcatttggaaaactaataaacaacaattattttatgggtaaatttcctagtaagccattttaaactctgaaatgttttgactatccaaggcaacattcaatatgccatttatttcaaagagcatatagtttataactccgagttgttatttatccccagctcccacagtttatccatttggagactacaaatttgaattcctttttcagaatttaactatgttttccttcatctagtttataaaattgagatctatggaagtgtattagttcttgcatttgtataaagaaatgcctgagactgggtaatttataaagaaaaaatgtttaattggctcatgtttctgcaggttgcacagaaaatatggtgctggcatctgctcagcttctgggcaggactgaggaaacttacaataatggggaaggtaagggagagtgagcatttcacatggctggagtaggaagaagagagatgggagaagatgccacacacttaaacaaccagatttcatgagaactctatcaggagaaaagcaccaaatggatgatgctaaaccattcattaaggactcacttccatgattcaatcacctcccaccaggctccatcttcaacaccggggattaccattgaacatgagattagggtggggacgcagatcaaaaccataccaggaagcttcttgtcaatttattcttcggaggccaacaatttgtgataaatactagtcttaaaaataaaattaaaaagctgattttcataagaaaaaaaatcctagcattttttgtggtgtctgtttatgattgttgaaaggactgatatagaaaagaaaacatcaaatgaattatcaattagtgatttttttctctaaatttgcacttagctactaatatttattgatcttgcccttttgtcagtcaagttcagggaggtggagaagcatacttcccgaccactccatttagcatcttcaggcactagagccctatgtattattgatgtattttattccaatgataggctaacactcttggttgaaaaagttttcattaatcaactactcatatactgaatttaactgaagcctggaggcatcaagatcctaaagaaacaggatcaccataagcttgcataaaaatgtagaggtactgacctgttcaaatgacagtggttagtaaattagtagttaatagtaaattagtttcattttaaataaaattacattagtagtacattaatgttatttttaaacaatctttgaaatctttgagtaattggtttggattttccaaatgaaagttctttgcacataaaaacttctacaacttactgaaatgtgatggttttcctttgattcaggaaactcttcatgtggtcttttcatgttttcattgtctctaagttaactctagtggtctaactgacccaaaaatttcagcaactttgaaagaaaccactgaagtttatatagttacattagacatttctctaaagccatttcatttcaagctattttagctgtatacagtcactttcaaatggcatatttgttttcttttatctttctttgtcctgtcaaaggtcttaattactttctaagtggatatctagtaattaaattataatctaatatttatatgaaagttgaagactttattgctttagactttcaatctcctgcaaagataaaaatcaggtaatttctttaccaagtaacatctgatttgtatatgcagtgtttaatgaatatcatctaaatggtctctcaggtgttcatgcatacgtaaatcacctaacaaggaaagcttactagtgctcagctacatttgcagtttattccagaatttttttcctggaatttttcttctaagagcagactttgggtcatattttctttatcccatgaaatgtcatcagaggtggcatgccaattaccagtaggaacaattaagagtggtccaggctgggcgcagttgctcccacctctaatcccagtactttgggaggccgaggtgggttgatcacgaggtcaggagttcaagactagcctggccaagagggtgaaacaccatctcaactaaaaatacaaaaattagctgggcgtggtggcaggtgcccgtaatcccagctacttgggaggctgaggcagagaattgcttgaacccaggaggcggaggttgcagtgagctgagatcacgccactgcactccagcctaggtgacagagcaaggctccaacaacaacaatagcaaaaaaaaaaaagtggtccaattctctgtatcatcttcacctaacctagagaaccctaaagttaatatgacagcagagcctattgagtgacccatagtgatctgtagtgatatgtagcataaagacaaaataaatctctgttattttaagagttcttggtatactataaatacaagtcttttatcagatatgtgtaatttctcccagtctgtggcctgtctcttcactgttatcagtgtcatttacagagaaaaactttttaattttaataaggtgcaaatttttttttcaatgcattgtgcttttggtattatatttaaaactaatacctgaacaccaagtcatgaagattttctcttatttttcttctagaagttctatggatttgcattttacatttatatctttgatccattttcacttaattttgtgtgaggtatgagatttatgtgtaggcttggatatccaattatttcaatggcatttcttgaaaagactgtcctgtttccattgaataaccttcgcaccttgtcaaaatcagatggctatacctatatgtgtttacctttgggctctccattttgttccatgaattaatgtatctaatttttttgtgaatacaagactgttttgattatagtaattttataataaattttgaaatccagtaatgagattactccaattgtttgttttcagaattgcctttgtttttccagtctctctgcctttccatataaattttagaatattttttatatttacaaaaaaaggttgctgggattgtgattggtattatatttaatctatagatcagactgagaagaactgacatcttaacactatggagtctcctaatccagaggcatatcttttttcctatttagatattgtttgatttatttccatagtaatttgcagctttctacatacatattttgtacacattttgctacatttacaactatttatttcatttttatttttggtgctactacttttttttaacttcaaattccagtttgtcattgctggtacacaggaaaacaattggcttgtgcatcttgctttaaactcttgaaatttttgtttctttaacaattgactatctcttagtgattataaaaatagaacctaaagcataattattccctttaaaaaaatcctaaaatatgtcatgctctcttagggacacaatagctggtgttgggaaaactgaatctggaaactgaagatagtgatgtttgccctacagcatggagataaaacatttgctgaagcctataataacatgcaagacagctcatgttcccaatgcacttgtagctctaggggagcatattggaaagcaaatgttggttgtgtgtattggttaccactggatagttttgcaatacattgcaaaaaaaacagaagaactcaggaaagaattagtcagtttccaaagaccaggagaaaggaaatagaataagtccagaaagtacttttttcatcccaaacaaccaaagattgagaaatactttgtgagtccaacattcactaaaatcttttaattgattaaattacctctgggcatggagcagattagggtatacaactctgtaattttgtttttagttttttcaaaaaggattcattattacatgctcaagtctcaaaggacctaacacaaaggacagagtgagagtgagaaagagcatgagagagaaaacaaagaaatgttagcagttctggcaactgtatctcagaaaatagtgtcagtctagttacagacccatgaataaaatcagatagataataagtttggtgagtctctgagagagcagtacttccaaaagaaccaggagtctgtttctccagactttaaatgatctttgagcacccaaccatatataggcaggaaatgagttaagaaagcagcacagagtattccctatggcctactttagatgtggccaagaaatatattggaaaaagcaaactctttcagagggtgtagctagcgacttgcaaaacaatgaacaaaggagctcttcccaaggaatagaatcagagcataaccaaggaacattccacacctccaagatagtgaagctcataatatcttcccagtgaaattttagaattgatgtgaatcagggcctgtagaaagtaagtcccctattcttcccgtttctgaaggacagtgtttattatcttccttttccatcattgcatattgtgggtctggggcagcacagggtgggtgagtgattgagtaggtggtgcaatttagcttgatttaggtcactcttccctagatcaaagcaagccaaattcagacctaatgaacagaccagtgcacatcgttagagacggcttgaattttaagttctataccgtgactggaatgactattgagttgtctctctctaagcggtattgagtatgcaccgcctgtgggaaggagagtaatcagaatacttagtgatcaaaaaagcaaactgtaatagatgttattataatattccaagaattctaggtctcctctccttccataatcattcactttttatgtctaagtatagtcctaagacttactttggttaatgaaatgtgagtgaaagtgatgtgtcactctgcacagaagcatttaaaaaactcaattctccatgtgtttgttggtttgttattttatcctaccatggctaagtctgaagcctcacttcaaatgacaaaagaacctgaatcaaggtagtctttttagcaacccccttctctgccaacccagattgtaaatgtattatgagaaagaaggaaaaaaaaatgatattgtaaaccacggacatatgggagtttttgttttacagcataaggttatcctgattattgcaccaggcactttggaagattaaaactcaacaactttgtagccaaattaagatgttcagattatgcatgaaattatcaaggaaaaaatcgagattttacatccttccaaaatgcagtagtcataataaacatgtaagaagaataatacatgcagatctgaagctaggaaaccttgtgaagtttgttttttaaatccttctacttcccttttctgtggatattctgtctccagagagccctcatctctatccaccaaccctaacctctaaatatgtaattatacacaatttagaacatgatggttttggagaatatgcaaaagcagtgccatttggagttagcaaaaattatctctattatttggtttggaaattggagaaactcatataggatataaaaaataatgaaccggtttatacacatttatccctaggtgcagtagtcaatcatactttcccttctcttctttctcttaccttctcttttttactgttatatttttcctataaataaaagaaacatcttttccccactttgtattattagtatatgcttttaaaaaggtagttttaagataaaaagcaacaatttggtatgatttatcaggataatatatgcaatggtatgtccacttaaggtaatttttctcagaaatctgttttaagatgtcttatctacatattatacaaagtcagaatgtgtttcattttagaacttgaaaattgaaactcagagaagttcatttatctggaatttaatgataacagggaaatttaggtgttcttgctggtggaagcaattttgactaaatggtaatgtaggatctcaaatttcataagcatgaggtatgctattcattatattgagaagttttactaaatgttcaaagatatattataattttattataaaatgaagggagatgccttatggaatacatcctagttctcctatcccccaagatattttaactattatccagcaaaccattttcttatacatttcttaacacctagatatggcctaaagtttccagtgtcttacagctataagaaattaaacatataatatactaagctccagggacaagaaatcaacaaatacctatttgcaaacagcatttttccaatattatttcaacattaaatggaaaacatgttggttttgataaaatattatttaaaaagtgtgaatttataaagctataaagtgtcaacacaaaatatacacgacaaattaagtctgttagtatggaagacattttgattctctcaggaatatgttctcgggatcagaccatttactgaatgctgttttccatgactgtgatgagattcagctgggccactaacaatcttctccagggagctggcaagtcgaaagggaattgctacaattagcgtccctgctccccactcccacttcactgccctcagtgaaattgactgtctgggaagacaaaagcatacagacagagaattcaacatcaagtctaaagcagtgccaaaacccactttatttaatgtagacagtgagtttccacccacagcttccatgtcctgtaagtgttccagtcctgtcggctcatgaataatcttttcctgtggacaactgccagttacttgattattatatttttctttctaactttgaacttgaattatctttcgccacttgaaagtctttcaaaaatatcccccaataaaagttaactctttcttttaatttttctttttatttatagaaaatttaagaacatgagcctcactagcagcactaaagaagaattagtcaaaaaaaaatagaatctacacattttattggcaaaaaagaagaaactggttgataaagggaaagtagttgatctttgatattgtatattatttctttcaatgaaggtctcaacctcttcttctgtatctttttttttaactttttggaaacttgcattgaattttttctcatattcattagtatggccgtactggctgggtttctccaatctaatatttttcctcttagcattcttcattatagctcctcctacttgagaataaggcactatatgtgactttatatataatccattatggctatattaggcaaaagagaattaaaaacttaaccaagctcattatactcttagtacactgacatttttaccaataaatatgataacaagcaatatagaaatggtaataattgcctcaaacactggacataactatcaaatcaagagacaacacatagatattcttgaattctcatcttctatgtaaaagtataataaatattaagcactaggtctggtttacctagaccaactaaagttttctataaattacaaaattttaaactatatttcattaggaaaataatgtgtgaggcttaaatctcatgagggattggtaaggcttggtttttttatttgtatacatacattggtccatatatgaatatgaaatacctaatatgaaaaggaatataaacatgtcctaccttctacagaaaaataacaaacttaagagactttaaaaaatgctattttcctcaaaaacactctttctttgttacatcctcaggacacacaacatttccagttcccgggtaaatgcttccatttcatttgaggacaggtgccatatgaggtcaagagtacagtggtagaacacgtagtacacgttggcagtaggagacatgacttttggatagaaaaatgagaaactaatacgtttccatccagagtgtcagttaaaaactcagtatttggtagtgatgacgggtgggtggggagggctttgtatgactttctttctcttgatgttttttatgatgtttcaaaaatatgtacactgttccaaaataaaccacctagttttaaataataacgtaattggagaattgtacaaatttgattggtgctaattggtttgatataaaaaatctgcaaagaataaaatggctttccataagtaattgtagtattcgatagtaataataataacacaattagcaaagaaaattatctatggaagttctaaacaattgccatatgaataaattcctatccagttgggaggtgacagaaagatttatgtttttattaaaatccaagatttccttccatcttcactacaacacctgttgtcaaaatccttcaaaacttttaagcaagggcactagctataaatcttcttgatatttagtaaattagtttttgaaataatatgattacttatcatttgcatctcctctattttcctacctcataacttttaatttgaagtaactagtttaatctttacaggtgctacatagaaagtatttagtttattacaagatttgaggaaacctctctttccatacatttgttcacgtaagagtccaggatagtaatttccattggcttgtaacttcctgtcagggacaaccatagtcttttatattgattggaagcactgagtttacatcagtttcctttcgttgttgtaaaaattaccataacattgtggcttaaaaaaaaacacatatttattatctgataattctagaggtcaggagtccaaaatgagtttcacaggctaaaatcaagatgtcatcagggctgccttcctttcaagaggcttagaggagagtctgtgttcccgccttttcctgcttttagaggctgtccacattactccactttacttagtttgttgtgtcctcccatcttcaaagtcagcagtagctggttgagtctttctcacatcatatcactctgacactgacgcttctgcctctctcttccacatttatggacccttctgattaccttgaccccactcagataacacaggataatcaccccattttaaagtctattgataagcaacctcaatcccatctgcagctttaattccttttgccattgaacctaatatattcacagcttccaggaattagaatatgtgcacctttggcaggctattttgctgtttgccacggggtgttctttacacatgtgtgaaattgagcatcctaaggaggtgattttcaatatgaaatatttggttactaatgtattttcatgaactttcccaaaagctaaaaacatcatctgcttcttttcttaaggtcatattttcattatatttagcactttatttctccagaaaaaaaaaagttcagaaatccgtatttcttaaatgagtcagttgctgagattatattcaggcatgtaaattaactaaaaccttagtagaatattatgtaatttctagattttaataactacatgtggctcagcaatagtttcaatagagtaaatgagtctttaataatgactaatttgtaagaaactttccaagcttacacctgtcttcaagattgtcttatgtactaaaatattttatacattaagaggactttacttatatgcataccttactttttaaatattgcataaagcaaatttaagataaaagcactgctttatttattgttccatattctctaaaagtgttgtacatactttattttaacaaatcaagacacaaccaggcaaacaggcgtgttagtgtgtctggaatgggtgggtttttggtctcactgacttcaagaatcaagccgtggaaactcgtgctgagtgttacagttctcaaagatggtgtgtcccgagtttgttccttctgatgtttggacgtgttcagagtttcttccttctggtaggttcgcagactcgctggcttcaagagtgaagctgcagaccttcccagtgagtgttataactcttaaggcggcgcgtttggagttgttcattcctcccggtgggttcgtggtctggcttgcctcaggagtgacgctgcagacctttgcggtgagtgctaccgcccataaaggcaacgctgtggactcacagagtgagcagcagtaagacttactgcaaagagacaaaaccgacacaacgtggaagggaacccaatcaggttgctgtggctggcttaggcagccttctttaattcccttatctgaccccacccacatcctgctgattggtccattatacagagagctgattggcccattttacagagagctgatttgtctattttacacagagctgattggtccattttacaaggacctgattggtctgttttgacagggtgctgattggtgtgtttacaatcccccagctagacacagagtgctgattggtgcatttacaatactctagctagacataaaagttctccaagtccccactagattagctagacacagagcactgatttgtgcctttacaaacctttagctagacacagagtgctgattgttgtgtttataatccctgagatagacacagagtgctgattggtgcatttataatcctctagctagacataaaagttctccaagtccccacctgactcaggagcccagctggcttcgcctagtggatcctgcgccagggccacgggcggagctgcccaccagtcccatgccctgcgcctgcactcctcagcccttgggcaggtgatgggaccaggcaccgcagagcagagggcagcgcccactggtgaggctcgggccatgcgggagcccacagtgggtggggcgaggctcgggcatggtgggctgcaggtcccgagcccggctccgtggggaggcagctgaggccccgcgagaattctggcaggctggcactgctgggggacccagcacaccctccacagctgctgaccctgggtgctaagcccctcactgcccgaggctggcgggccagccggccactccgagtgcggggcatgctgagcccacacccacctggaactggtactggcctgtggtgccaacgccggttcccacccacgcctctccctccacacgcacccccccacacctctctgcaagccgagggagccagctccagccttgagcagcccagagaggggctcccacagtgcagcggcgggctgaagggctcctcaagtgtgtccagagcggacaccgaggctgaggtggcactgggagcaagcgagggctgctaacacgttgtcacctctcattactattctccttttgtagatgagaaaacaaggggctcaggtaaactaactgctttatctaacatcactcttctagaaaatggtacagaccaaccctcaactcaggggttctggtgacttatagtaaagggtactttctaccacggcatttgttatagaggataatatagtaggaaacactcatatagaaacacaaacaagattagcatccatactcaaacaaataaccaaaatttagagaaagaaaataacccaatttaaaaatgggcaaaagatctgaatagacatttctcaaaagaagacatgcaaatggacaaaagctacatgaaaaaatacttaacatcactaatcatcagggaaatgtgaattataaccacaatgagatatcacctcatatctgttagaacagccattactaaaaagactcaaaataggtattggtgagggtaagggagaaaagacaaccctagtacactgttattagaatgtaaattaggccattatatgatggtgacttaaaaaataaaatttagaactaccatatgattcaacaattccacatctgagtatatatccaaaggaaatgaaatcagcatgtcaaagagatatttgaattccagtgttcattgcagcattattcacagtagccaagatatggaatcaacctaagtgtccatcatcagatgaaggataaagaaaatgtgatatatatacacaatggaatactattcagccttaaaagagacagttctgtcatctgcaacaagtatggatctggagaaaattatgttacgtgaaataacccaggcacagaaagagaaataccacatgatctcattaataggtggaatctaaaaagagtcaaaactctcaaaagtggagtagaatggtggttacgagaggatggagagacaatggagagatgatgaaatatcacaaaatttcaattaggtataaattctaggatctattgtacaacatggtaagtgtagttaataataatgtattgtatacttgaaaattcctaggagagtagattttaaatgttttcataataataagtatgtgaagtaacaaatatgttaattagcttaatcattccacattatgtatatatatcaaaacatcgctttgtaccacataaatatatatacaattttgtcagttaaaaataaataaatttaaattacagtagcattcacaataataaatttatgaacactcagtggaaacaaatttatgaaagtaagtttcagcttcacaaggagaaattgtgattttgtcttagactatgttgccactcaccactaggattttactttttcactcatcattgtcatttccctctttaagaatgtacgtcaccaaaatgaaatatttgaccaataattatggtcaccaagcttcctcgtctttgtttatttgctagaaagtgtacaagttgaaactagaacattgagtgacaaacagaagctgaaagaaggaactaggaaaaacctaggatgagattccaataactgttttcaaagacatgagaggttcactgtaaattactgacttcatgcctcaggagaaaccaattaatctctaggtgcctcaatttcctcacttatgaaactgggataaaatatttcccacaaaattcacaagaataaaaatacaatgtgtaattataattaatttttggctaatgcaagggtataataaactcaagatttttatttgagaaatttcacattgttttgttttgttttctgatactgtaagtcctccataagcatatttcaaagcacttttctctgtaattatcaaagtcaaaaattaaaaaaaactaatcatggaaaatgagttttactttcctttacttctttaccagacatcttacatttttcttgacataatcttatttgttaggtacagattgccaatacttattaggtttggttttaattttgaaaatgctgtgactgaaccccaaatccatctattttgtaaccataggtaagtctttcatgctgtatctataaactggctaaaaacagatattacgatgagataaaaattaaactttgaagagccccatgtgtgatagaaatgtacccatgtatttcttcttctgaaggtaaaatttcatgtgcatttaactatcaatgtggtaaaagtaattttttctttttttcttttttttttttttgaaacggagtcgtctccctctatcacccaggctggagtgcagtgacaggatctcggctcactgaaacctctgccccctgggttcaagcaattcttctgcctcagccttcctagtagctgggattacaggtgcgcactaccatgccctgctatttttttctttttttaatttttagtagagacggggtttaaccatgttggccagggtggtctcaaactcctgacctcaagagatccacccgcctccacctcccaaaatgctgggattacaggtgtgagccaccgcgcccagccgattttttctttttgtgctccattagttgctgtaaatcacgctacttttcgatttgattcatgacttttcgtatatttcttggagtgtctaaaatgtctttatatttttgttgttgaccaaaaaaaaagatgttctctcaatccttaaatttatcaatttttcaacaaaactgtctgattttcctgtggatatatgtcctggagccctcaagcttgtgcagcacttgtacacacacgtgcaaagatcttgaattgatctgcctcatatgagcctcatgtgtcactctcctctttatatttgcaagcactgacactgaaatgctccctcaataccccttggacaattagactgtcatcatcatcagcatgcccaattctactatttttggagtcctgaccaagacaataaacagaggctacatgaatatggctaaatatttaaaggctgtaagttaacaagctgctaataaagtttgctttatctttgcttcttaacaaatgtattcattaataaattcaaaagtcttaataaattcaaaattcttaataaattcaatttcttaacattcagaaaaacataatttaaaaatagatgtgtaaagccatagtttgtatattactgaaagtcaaaataatatcaaggatgactgaattgaatcattattgtacatctaggcattctatcagtgacccgacattttttagggaacaggactaaaatcaagatatagataactcacaaattatcattcacttagtctataaaatttgcttttacttattcccatttcagtataatacgtgttgtgtaatatagaaacacaaaataaaaattaattgtattaaaatacacataatttactatttgtattaaaaatataaatgtaaaaatcaaaatgattgttatatttgcacagttttccaaaaaagatttttaatttcacaatcatctattagaattttgagaaaaaggaattataatcaacaaatatttaatatttaaatcaaaattatttaagtaaaactaaatttttaaatatcaaacttacagaaattaaattgtattttattatatcaatatctatctagttgccaatttaaaaaaaatcaataacacacttcaaatatgtttggtctagcgtcccagagaaacaaagtaaaagtaatatgaattatttaaaattccaaaatactcttcaactgccatgggcaatacttgtgaatataatgctaatttgttaatgtctccaaatccacaaatggaaacaaaatgaaacacaataaatggatcttagtactgctgggaaagaccgttaggttaggcaagaatctcttatgatactgtactggaagaagatgatacattaattattttgaattttgtcttgtctaagctctgctaccattctaatcctctggacacttctaagcaccgtatgtaggtccccaactttggcatcacacaaaccaaaattttcaaggtattaaaactggattgatttttgcttctagaacatagagcaggagaaacagtttccttggggtctgaatggtgttaatgataccggaagagggcaaggaaatactaggtagaaaagagcgaggtccctggtgagggctccaccctcaagtttgtacctgcaaacctaaatgagaacaaggactcttgttatcgcacgggaatgttgcgttttccaagaccactctgtcctgccacgccccctatcctgtgccatatacaccggaagccttagctggctcagacatagtgactggatgtcgagaggaatagaggagcacagtggcagagaagagaagggcagagagctgcagaccagccgaccggcacgacagagaaggagagaagagaagaggtgtctgaattccaggggaagattttctctgcccccaccctccaccccaccttcccacttccagctcctcatcccgttgaaagccacctctactgctcaataaagtcttcacattcttcatctttcaaatagtttctgtgacctgatttgtccaggacagccagacgagaacttgagggttaacactcagccgtccccgacggccgagcaagggagcgttgtaacacacccctagactctgctgtggggcgggaactcaaaggtgctcgcccctggctcctgcactggctcacctgcatgctcccccttccgaaagggttctgagctgtgggctgagtgaaacgaaccactccagttccctcctgcccgccaagggggtcacgggaatgctccccgctcatcagttcaaattacagatgtttagagtaatgatgcgttgctctgttttggtgctaagtgctagatcctgagtgaaggatataccaaatgttgtacatatagaaacatcacatagtacaagaactcataggttccttagtgtacagtgaataattaactttactcaaagaggggtctggcctttgtccttaactactaggaggtgatctctaggttccttcaatgtcttaagagtgtttttgtttaccgggggcggggcggggggctttggccactaggcggcctaacaatgtaatttatggtggaggctgtggaacataccacatactgttccaacctctggagaaaatggagactaaccaaacttctggataatggagaccaaaagtcagctatgtgggcaaaatgtaattgaaacccaatacaaactctgaacaccaatgactagggggagcttccctggttggcaatacagtagttggcccaccatttccatgaattccaccaactgtggatcaaacttattaagaaaaaaatagcaatacaataataaaaataatacaaactaaaaaccaataaaatataacaactatttgcatagcatttacgttgtattaggtatttataagcagtctagacatgttttaaagtatatgggtggatatgcataggttatatgtaaattctatgccattttatataagggacttgagtatctatgcattttggtatctgcagaaggtccttgaactgtttccccacagataccaatggacaactgtattctttgagtattgtcacacttcaataccaagaaggtaatgtgtccctgataatgacagaaacttcattttcagaacccgcccagatttgccctatgttctgttctttcagctgtttctaatttgtatactttcattataataaaactgtaaacataagtatacaattttcttgagttctgtgagctattctagcaaatgactgaatctgagggtggtcgtgggaactcccaaatttgtagccagttggtctgaagtaagggtggtcttgggatacccaactttgtggctagcatctgaagcaagggaaatattgtaggaactattctctcactgtttgcctaaatgccattgcatttaacactttgcattttgtgtggttgggatatgtgagccctctatagcagactgccaagtttctctgtaccaaacaaagtgtgatcctttttctcagagcacctctgtatttattttgtttaatccatgagtactatttatccacatttcctcttgcaagaagtctcctgtctactgatcatccccccattttcttcacttgtgtatattgtttttgtttacttttttaaacagcttaatttatatacagtaaacataaaataagctgcacatgattaaactaataagatttgacatatgtatacacccatgaaaacatcaccacgatcaacataataaacatattatctacagaagtttcctcaagtctctgcaatcctctccctgcccctcccaatcccctccaccacagaaaatcatttatttgcttctatctataagcaaactgtctatagataagtttgaattttatagaattttacataaatagagtcatatagcagtactccttttagtctggtttctttcattcagcgtaattattctatgagcctcaagactgatgagtgattcaatagttattgctttctattgctgagtgatattccattgtatacaaaattccacaatatgtttcccattgacctattgttggagatgtggattattttcagctttggttgttataaatagagctgctatgaacatttatgaataagtatggacatatactttccttgctgttgagtaaatactaaacatagaatgacggggtcatgtggtatatgtttaacttcttaagaaactgaaaagctgtttttcaaagcagttgtatcattttacacattttacatttgtactaatagcatataagagtttcagttgcaatgcatcctcatcaacactttacactttaattttagactttctaataagtgtgtagtgttatgaaattgctgttctaatttgcatttctccagtgattaatgatgttgaagatcatttcaatatacttattaccatcaatttatattctttaataaaagtgttcaaatattttgcttttttttaattgggctctttgttgtcttactgagttttgagagttctatatatactctggatacaagggttttttttattagatatacaatttgcaaatattttctttcgatgtgtgacttctcttttcaattccttaacaatgttgttcaagagccagttttttacttagataaccttccattttacaacactttcttttatgtattatgattctggtgttgtctatttagtcaacccaaggttaaaacaatgtgttctcatattttcctctagtgagtttatggtctggggtgttacatttaggtctatgacttattttgagtctatttttttgtatctggaggtaggtatgaagaaaggttctgttttttaaatgaatatccaatccagaacaattaaacaattatattctttttcatggaattaacttcacacttttgttgaatatcaattgaatatgtaactgttcgattaatctacttgtttatacataaaccattatcaatttgtgttgaataccttaactttaaaataagtcctgaagccagatagtttgtcttccaacttgaatctttttttcaagttcttttgtctattctaagtgctttgtgtttttatatgaaccttagaatgagctcgccaatttctgaaaacaaatcatgctaagattttgattgagacggcattaaatctatagttcaacttgaggagaacagatatcttaatattattatgtgtttcaatttataaagaagatatgccttttcatttatttagatcttttattattacattttacaatttttagtgcacaggcaagccttgcacgtgtttgcttttcagacttgttcttaagtattttatattttaatgttactatagatggtatttatttaaatttcattttccaactttaagttgctgacatatataaatacaattaattttagtatatttgtcttttaccctgcagtgtgctaaactcacttagtagttccaatttcttattttctagtctaaatgactttattttcttagcttattgcactgtcaaagacatcctgcatgatattgaatggaagtggtgagagtgaacagccttgccttcttgctgatcttagagaaaaagtattcagtctttcatcataatgtatatttaactgtagatttttcatgatgactctatcaggttgagaaagtttccttatatgcttagaaagttgaaagtttatggatggttgatgtcatcaaatgctatttctgcacctattgggattattatgtatttttattttttagtctgctgatacaatgaactacattgattttcaaactttaaacaaattttgtattcttcagacaaaactcacttggtcagtgatttttatgttttatgaagtattcttggattcaatttgctatcattttgttaagaatttttgcacctatgttcacaaggcatgtgggcttgctatgttctatttgtgtaatatcttaatctgattttaggatcacagaacacaagtctcataagttttatttttattgatgagttgatatagtatggatattatgtcttctttatttaattgaattcatcagttacctagaattaaacttctttctgggaagatttctttttatctgcaataacattgtttttaatagacctatggctgttcaggttgtctgtttcttcttgagtaaagattatagtttgtggtttttaaggaatttgcctatttcatgtaaattgtcaaatttactgacataaagtttttataatatctgttaccatcattttaataactgtaatatctgtcctaatgtcacccttctcattgctgatattggtaattggtttcttctctcttttttccccctgatcagccagactagagtgttatcaattttattggtcacctcacaaaccagcttttggtttcattgttttccctgtggttttcctggttgatattgcatttgttgttgcctttatatttattatttctatcttgtgaatttcatatatgcagcatctagttgagctcacttatttgtccagtttgataacctttaccttttaaaagggtgtttagtccatttatatttaaagttattattattaaaattagccttaaatctatttctgtaagtttttatctatctattaatatatattttttctgtaccatttgataacaaattacatactccataaaactttgcccttagaaactttgatgtgtattttctaaaaataaagatgtattcttacgtaatcccggtataattatcaattttgtaagtttatattgatacatttcttataactattttactgtctataccttaattttatcagttgatcaattaatgtcttttatatcattttctgctctcagacaggatccagtatagagtaaaatagtgtgctatctgccatgtatctttattttccttcaatctggtacattttcacagttttttaaaaaatctttcatgacattgacactttgaagaataaaaatcaccttttagactcaaatttttctttatttttgtatttgatgtttcctcatgattggattatggttatgtattctcacctagaacactacatacttgattttatgtctttctaaattatcacatctgaaggtacatgttgtccatctcttcctcactgatgctgttaaatttttgatcacctggtcacaatagagtgctcaaatctccattgaataattactgatttttttctccattgaaattaatatgcagcctttgggtgacactttaagacaatgcatatattctcctaatgaaaagttctttctaaggttagcacagtcatgagcctgcctaaatccatatattacatatttaccaaacgattattttccaagtctaacatttcctccatatttgtcagttagtcctcaatatttactttaaggaagatgtctcttttctccatttatttatttctctatttataaattaccatttgttcagaagattataattaattaaggtatgtaattattttggtgctcaaattctcctagatttggccaatcagagccccttcagcctggtacctgtatccttatgatacacgtccattttttttttatacttccttactttcaagcctaacaagaagggccacaatcatcttgaacctaccatacctcagccctgctattaggtgtctgtcttcaaggtgtcctggttcattttaatgaagagaagtaacagagaacaaaacaagggcatcaagtgagttcgttgctattgctatctcttcttgaatgaggatatatatttaaataccatattcatgagttactttgattagtttgtcatttaatttatttcccttcctcgtggttatgatattcaactgaaatgcaattagatccatttgtttcagtgttctttcagttttttagttatatttcccctttcacacttctattaatttatttctaaaataaatgtagacttacacagtttcaaatgccacaattatacaaagggtatactgaagaaaatgtcattctctccccttatgactcccaccttattctcacctcaagttgttctaccactagtctttttgaactacagtgaaatttcatatagcaagccatgacagcatttgaattttgttactgtttgtcactacttggtgataaaagactggtatgtatttctgaagtataaatatatgtatgcatggttgtgcatcatcaaaataaagacacaaaaatataaaagtgtcatagagaactcattgacttctgataatttatctgtggattaaagttcaagaaacatgtgcttttcttattttctctcagtaatcatatcgcataacacagaaagaaagagagagataaggaaagagagaaagagagagcaagagagagagacagcaagagagagagaaagaaaaaaacagaaaggaaagaaagagaaagaaagggaaaggaaggaaggggaggggaaggagaaagaaagaagaaagagaaagaaaaagggaaagaaaggaagaagaaagagagaaaaagaaagaaaagagtgcgctgccatcttttttgtttataaaccattgcttctgctctgcaacagtatatatctttcatgggatatataaataaaaggttatgtgttgagaaaaacaagtagtttatgtaggttacagtaaatacaatgcatgcctattcttcctaatggtatgaatgtggtcaaatataagaaaaaaacctgtacttagctaataggttttttcgttcatattcctcacttgagttttgctagagagtgtacttattatactagattatttattacctgaagaattcatagaaattcaataataatattcaaattacgggtataaaataaaataggagcacctaatacatgtttcccaaatctcttcttcctttcctctattgcactcctaacccagtcagcacttctggctcatacatcacaaacttgttcaatactttttctatatgaaaattcaattctgactcaattcctcctccaagttatgttatatgttaattacacattctttccccttacttctaatatctcactttcatatatcaagttttgttagtcgcatcttaattctagaaattacattgcaataaattgaaagttttgaggtgaatccaacatactatcaaatcattttggtaattgaggataaagcagaaaaacaataagtaaccatatcagacacttggatttaaataataaaatttgattaaatttcattttcttagcatttcataacttaattctccttcccacatattaccctttcatttagttagaaaatagttgtcttagtcataaatatctaagcagaactataagaaaagtattacattaaaatgtgattaagatattttgactgtgggaaataaaaaaattccaggcacaataaaaataaaaaaacaaaaagttcctgtgtaagctctatttttaaattgttgttgttgttttgctttttcagtgcgtatataattttgttaatgtggtatgaaagagaaagttctatttactaacatatgagagattctcatcagtgatttgtcttaagcatgaagatcaagttcagttctctaataataccagatggtctgttatccttctgtattaactcatagtctgaggagaattgtaacacgtggcagactcagtaaagagttgaattccaaattcttagcagagttctgaaagatggcaataacgttttgacaaggaaaaataatacacaggtcttggcggcagtttctcaggctcaaactggttcctccctctttcttcacccacgtttccaactttttttttcaaattggtgttttggttttgagaaaagtgcacaaacaaaaagcttcttattggtctatacatccttgagagtctaccccactctatctgtatcactctaatgggtgatttttgttccatttaaaatagcgtattcttaccagccctttaccttctctttcctgctttatttttcttctcaccagttacgaccctttgatatactatctattttacctatttaatgttactgtctttataaatggagatgtcaggtccacacagggcttccaggtccatgcagactgtttggaaatatttgcctctgtttccttgaaaggcaaaagcagataagaaatttgagcaaagttaaggaaaacaagaagagacgctaagcctttggtggtttggagttgtttgggaagtccaaaaatatttgaagttttgggcacctcagaaagctttgaataggtagttttagaacaactgagaacacttatttaacacagtgactaataacttgattgcccaatagttgatgctgcctgaagatgtaagcaatttaatagtaattctgataataagataattaagataaaaatagtttagaattacttgattaaaatagcaagagacatattgcagttgcaagagacaaacacatattgagacagcctttgagaatcaatacatccatttctacctgtgatgtcactgtcagtctcttggtgaatacaaggctggctggaccatgtcctgacctggaggacattttgaatgctcttgctaaaatacagtaaatgtattgaacaaacaatctacgcatactcacaaagtttacctctagctatctgtcttgtgtgttaattttcagatatttatttagcacctgttatgggctatggagaatattgggttatttaaacaagagaatgacttaaacataactgttgaaatactctttgctgcattttagacatgattttattatccaatgaaaaactttaagaaagtttatttccatgggtaatctaagctgatcttcttttaaaacaataaaatctaattccacatcctcccttccattcattcttactctttctcgcttttactttcaacaaatatcaagcacatactagaagctaggggctatgctgacctttagggatctaggtgtgagtgaaacaaacaagatgactatctgcttgattcttagactctattaaaattaacagagaaatcatcaatttaaatagcatgatgactgttttgagaaagtgtaggtgcatatgagaaacaactgacttttctacacttcagagaaaacttcccacactatggctatctgacaatgaaaaatggataggagatagtctgataaagtgggttgtgggaagagtgtcaagtagaatatatttgattatctggaggttaagaaagaaggtgatcagttttgaggaacttaaactcgttcagcatggtcagaatgaagactagcatgttgaaatctgagacaacaaagtgagatgaggaagaattaggtaatccttaaggtgtaaatttttatcctatgggtggtgaaatgccattgacaatttatgaattggagagtagaaggatgagacttggattttagaacaatttctcaagaaagtaaagagaataaatattttttaaaaactggaaacagggctagaaacttggaagatgtttcataaatctagacagaaggtagactatagtgacgatctctggggtagtgatgtgcgtagatttgaaacaacgaatacgtttataacatggaatttaagttgcccatgagacattcaagtggatgtatttagtaaacagttggatatatggcttaacaattggaaaagaaatcagaagtgaagtcaatgtttgagtttattttgtgattcatttattttaaaaatatttgtttatgacctaccatgtcccatattggggactgaaactagctactggtgctgcaaaagagaacaaagcaaacaatgtttataagttcttttaagccagttggagagagaataacataaaaagaggttaaatagatagtatatcaaagaatcataagtagtgagaagaaaaataaagcaggatagagaaggaagagtgctgataagaatatgccattttaaatgaaagaaaagagtactccctagggttatatttaagcaaagacctgaagaagatgagcaagcaaaccatgaagccattgggaaggagtgatccaggtggcagaatcagcaagtgcaaaagccctaggcaacgatttgcccaataaataagtaaggatacgcccaatatataagtaaggatacgttggtaattaaaataatagaatatggtttcaggtcttagatttaagtctttgatccatcttgagctcatttttgtataagattagagatgagaatccagtttcattcttctacatgtggctttccaattatcccagcaccatgtgttgaatagggtgccctttccctacttcagggttttgtttgctttgttgaagatcattgactgaaaatatttggcttcatttctgggttctctattctgttccattggtctatgtcccaatttttatgagtaccacgctgttttggtgactatggccttatagtatagtttgaagtcaggtaatgtgatgccttcagatttgttctttttgcttagtcttgctttgactatatgggctgttttttggttcaacatgaattttaggattgttttttctagttctctataatgatggtggtattttgatgggaattgcattgaacttgtagattgctttggtggtatggtcattttcacaatattgattttacccatccatgagcatgggttgtgttttcatttgtttgtgtcatctatgatttctttcatcagtgttttgtagttttccttgtagagctctttcacctccttggttaggtatattcctaagtattttattttattttattttattttttgcagctattgtaaaagggattgagttctttatttgatttttagcttggttgctgttggtgtataacagagctactgatttgcattcattaattttgtatcctgagattttgctgaattcatttaccagttctaggagctttttggatcagttttagggttttctaggtttagaatcatatcatcagcaaacagtgataatttgacttcctctttaccaatttggatgcccttggtttctttgtcttgtctgattgctctggctagaacttccagtactatgttgaatagaaatggtgaaggttggcatccttgtcttgttccagctcccagggggaatgctttcaacttttcccccattcagtataatgttggctgtgggtttgtcatagatggcttttattaccttaacttatgtcgcttctctgtcaattttgctgagggttttaatcatcaagtgatgctggattttgtcaaatactttttctgcatctactgagatgatcagctgatttttgttttttatttctgtttatgtggtgtaccacatttattgacttgcaaatgttaaaccatccctgcatccctggtatgaaaaccacttgatcatggtggattatctttttgatatgctgttggatttggttagctagtaatttgttgaggatttttgcatctatgtacatcagggatattagtctgaagttttctttttttgttatgttcttctctggttttggtattagggttataccggcttcatagaatgatttagggggggttccttcttttcttttcctgtgaaatagtgtcttaggcaaagacttcatgacaaagaacccaaaagcaaatgcaacaaaaacaaaaattaaaaatgggacttaattaagctaaaaagattatgcaaaggaaaagaaataatcagcagagttaacagacaacccacagaatgggagaaaatcttcataatctgtacatctgaccaaggactaatatccagaatctacaaataactcaaataaatcagcaagaaaaaaaacaagcaatcccatcaaaaagtgggctaaggacatgaatagacaattctcaaaagaagatatacaaatggccaacaagcatatggaaaaatgctcaacaacattaattatcaggaaaatgcaaatcaaaaccacaatgcaataccacctcactcctacaagaatggccataatcaaaaaaccaaaaaataacagacataggcatggatgcgttgaaaagggaacacttttacattgttggtgggaatgtaaactagtacaaccactatgggaaccagtgtggagattccttaaaaagctaaaagtagatctaccatttgatccagcattcccactatgtagtatctatccagaggaaaagaagtcattataccaaaaagatacttgcacacacgtttatggcagcacaatttgcaattacaaaaatatagaacaagcccaaatgcccatcaatcaatgagtggataaagaaagtgtattatgtatataccgtggaatactactcagccataaaaaggaatggaataatggcatttgtagcaacctaggtggaattggagactattttttaaatgaagtaactcgggaatggaaaaccaaacatcgtgtgttctcactcataattgggagctaagctatgaggacgcaaaggcataagaatgatacaatggactttggggactagggggaaatggtgggagtgggatgagggataaaagactacaacattgagtacagtttgcactgcttgggtgatgggtgcactaaaatctcagaaatcaccactaaacaacttattcatgtaatcaaacaccacctgttcccccaaaacctattgaaatataaaataaattttaaaaaagaaaaaatatcataggataataaagaaggaatagaagaaggacaaggagaaggaggaatggaaggcaggcaggcaaataggcaagcaggcaggcaagaaggaaggagggaaggaaggaagggagggagggaggaaagggagaggagaggaggggaagggaggcaaggaaagggaaggcaagggaagagaaaaggaaaggtatcctttaccttaaaataaaggttacctgtattactgccaaaatatccatttagataaagccttcctcacatgcattacaaaattgcctgtcttccttgtgtagtatataacattccacttttactggtaaacgttatcgacagaactgtgggatagggtatattcaggcttttgtagatgtgcttgctctaactttgaatattttaagggtactaggattatgatctgtacataaaaaagaaaaactagtctaccttttacagtgcctttatctatcctatttcttactttatctcatagaaaaactgatctgaaacccatctaatttttttatatcaactaatactgtgcagccatatttctcttcaccatattcttgtgcaatcaacttttctaccaacgattttgcatttatctcttgtacaactttattagtctaatagaacaacaaaaagtttttttcttttaatcttaaggctatcatgcaacgtgtcaccttgtcttacctacaaacttgatttgaatttttgctatgtctactaatcataattctacagaaatattagtaaaataattttatacatctttcttcaatatcatttcaccaagaggtcttaacttacctggcaagggataatatgagctttgcccaaattcactaacatgaaccctgcagtatcaggaagtaccttgagcatctctgcttagtctcaaacatgcagaattgtccaagcatatggtagtaactttgcaatttatgccctatcattttaagtacattcactcttctttacacaaataagtgttacatcatgtttaaatttaccactttataagtgagagaatttataccgagtagccaaataatctgtttaatattaactagattataatggatttaaggctagggcttatgcattgcttttctgtttctatcctgacaaactcagtatggtgctttgcatacagtatgtatttgaatagcatacttaactaattgaaggaaaattgtttgagctgtaaattataccactgtctgcatggaggcacttacttaaatggttggaaagtaatttggaggcagtatgtacaaagtggataatacccttgaaaacccaaatctataaagtgagagtaaatgacacatctatcaaatcattaatgactaaaacttaaatactataaaaattggaatttgattagctgtctttatttatttaactgttgataatgtacaatgttcctcagtttaactgtctttcacgttcttcaactcctttttggcactgcataaattatatatacatatatacgtacatacacataactatatgtatatataacaattaaaatgttatttggagcaaaaaattttctttgaagaaactggggaatttatcaagcttgaaaaagtgataaagagatgtctaagttgagaaatgttggaaagtctgggacagtgttgtaaagaaaaacctatgatccttttggaaatacttgcctaagtatgtcatttcaggacagctccctgccacataagtaagttttgttggaaactgtgttcatttgtgcactgtcagggtgggatcatttttacagtttacaacgtggacgggctctgaggggagggaaagcctgatttgtcactttctggctttactcgactaatctaagcttaatactgactacagtaaaacttggattatcctaacagattttaagaaaaataaaaataggatgaaaaaatctagtttagtagaagaacgtgagtctactcattcagatcttttgtattccatcgtacggtcacaccatctcaattcaaaacgataaatttaaaggagctttccattgacttttaaatgtcatagagtactgagtttttctcttttctattatttacttttatttttgtaatcacaacagaaagaatgtatgtttgactggatcctcacatatttttcaaaaacacttttggaactactctatggaatttcctttaggatcattttatgagacattcaaaaaatcagaatcattactatgtattcatattttttgatgcaatgtcaaaccacaacttgcaacaaattgtttttggcatttaaaaacaattaagcctaccctcaatgattccacctataggaacacgacaataatatgttttgaacaaataagtaattgagaaaaaattgaacaaaatgtagttactcaaaattattccatcaaagaggaaaccacttatttgaatatatagttttgacatatttaaaagcataggggtattaaattcacacaatatattgggattaaaagaatggattccagaaccagacttcctggattagcatcttggctctggcatttaccaagtgtgtaatcttagacaaatcagtttactcatttaaaaaaaacatatgaaagtagtacacattcataagaatgtgatgagggtactttctgtgtgtgtatgtgagtgtgtttgtgtgtgagtgtatagtacctagtatgcacgagccctattctaagtttatatatgtgtacatgtgtgtgtatagctatgattattcagaaatgctttattgttttaattataaaaaaactacaattattttttcataacaacttttttatactaagaaaatcaacatatgtagcccatttcataattcaccattagatacacatttgctgagcaactaacatgccaggaactgcatcagacattagatatttaatatttctcagattttattttgagatgattgaagctctctgcatgacactttttagggctaactacttaaatcgcacagtcaaaaaccatttctgagactactttaattgtgaaagactctcttcctcttcttcactcaaccccattttttgcctttatctatgcaaactaacatttgcaagccaagctttttcttataagcttttgggaaaaaaaattatctcttggatagggatccaaaataaacagttcaaataagataggctttgggaaaatgttaataaacttgactctggcaaattatttgagtttccttgtgtttctttcacttggcagggattttaatttggaagttaaaaaaaaatgaagaaaaatgtcctaagatttcacacatggatacttttattataaaatgataattttcttataaaaccacaactcaaggttgaaaattgggggggggggttaatttaaacttaaattatataaaatagattggacaaataatgatattgccagaaaactttgaatcatccatatttgactagaatctcagcatctcatcagtcaacaggtccttaccaaatgtctgcccttttggactgcttgctaggtgctaaagaaacagtgaccaccaaaacagacgcaactctttccccgaggagcttccagtcttgcagaaaacataaagtaataattatgagcaaattattataactatcagaacataaatgaagcacttttggaatgcagccattcaatatgatccatatttaggtattcttctttaatattgtaaaatatctttacccaaaattttggtgcccattgtccctaaattctaaacttttgagaagaagaaatgagaagcattatccttatttctagtgaagcagaagaaaagttaactacagcaatgtagtggtgggaataacagtgaagaaagctgacacacaccgtgatgggtacatataggcactggagatgttgactggctatcactgctgctgttgtttcctctggttgccttgtcatactttcttcttaataacagctaggaaggattttgctaactagtgggctgcaatcattaaggacttggtgaaattccaaaatccacaacccctaggaattttcctggatcccctacttggagaaacattgtaagcaacttacagcacactaaatcagaaaggttggcctgtaaaaccatttatgtaattcctctgcttttgttttggggaatcttccaaaagacgtgtctagagaatcagatataatttgagcagagtatgctaacgtggcttcaacaatgattttacttttctcgtaattttgtactcaacaatcattttttccagtgatgtgtcatgctgtcccagttgactgtctggccatattttgccctggtgtttgctatagcaaaaagtgcagctataaaattatcttcttcagcttgatgttaatttcgatgaaatcttccaagatgtatcttttttcacctctaaatctatgtgataacaaaagatcaaacagttctcgatcatattttgaatgggaaatattggtatcataaaataattcaagagccttattttagctacttatttctttctagttagtcatcataacaaataaccagcgaatgtactttttttctccccttcctctccataaaaagtatgtcacttgcacaacttcaagttaggaaatgggaagggtcagggaaatctcacacaatcctacccagtttgatcacacattacctccaacagctagccttcagctgttgatctaacaccgccagccacaccctaactaaaattttagaagtgactgttttagctgggcaccaggatacaatccatggcgacacacccctgatgctgaatctaggtcaatgtggttgtccactttgcagctaaccttgccctgaacaaccaaaaaatagattacaatttctacacataaagggaccactctagaatactattacctgccttgtatgtctccttagcatgctcaactaaacagattgaagttcccacaattctcatgggaattgaagctaataaatcaagcaataaaatataaagctttagacatttgtcttacattacatgtggggtgtctgtatttgtgggaaggtaaggaattttcagtattttgatttgtattttttctttttttatttgacattttgcacagttttttccttttaaaaatttcactgtaaggaaattgagtcaagaaaaatgaaaacaatttaaacaaaaagtgtgataattcctctttgaagcattttaatttcatgatgcttatttatatgtcattttttttctttttaccctaaaataaaaataaattaaaattatgatgcatttctagttcaattatttcaattcattttgaaattaacttttggcttttctgtcattctctttcatgatccttggtaaattacctgtatttctttctattttataaatttttctaatggtctctgacttgtaatacttgtggtgaacacagagtttgactgctttcaatttatttcctaactagttctattgtttattttttctattttataaataaattcataacatctggaagttttttaaatcgattataaatccaaagacttcctatgctggaaagagtgaccttcttttttaagagtgatggaaatactggaaataattaacttattgaaaattaccatgagttctaaaggatacaaaggaaatagattacttcaaatgtgtttttctggattaagtgtttcatattttaaatcattcgccatttgattcttattaatttcctactatgcacaaggccatgtaatagctacgatggagtataaaatgaaagataaaccttagtttttccctggagtagctttcagcctagtaaacgacataaaaagatgtaaattaaaataaactaagaggcataggaaaggtaaggtaaattagaagaagagcaaaatgattttaacagggaggatcagaaagattttgtagattagttgatctttgggtagaatcttcaaaataggatttgaacatacagaatgaggaacaatcattttagacagaaagacagtatatgcaaaggtatagaaacccagaaatgtagagtaggtattggaaaaaaaaaaaaaaaagagccatttgatttactaagaagatagttcttggatcaagatgaattgcatatcaagaattatctaaaatagtgttttgtatcctgctgggtttgggttgagaaatagagagagtggctggacatgaaataatagaaatcaaattatattaatctatttagtattattatccaaaggttagcactttgaataatcaatatggcataatttttatgtgaagactttctacttggactagtttattttcatgagtcatatgtttcaccttaatcactttatgaaatatatctgatatctataaaataaagaggtgaagagcagaaactgatccatggtctgggtcctatattgatttttttaagaaatgcttatattattaaacacgtaatattttaaatactatttaatgccatcctaattcagtcagtcttcgttacattgatcagtattcattatgtacaagggactgtgtttactactgttcatgatttttaaaagtgggtgagggtaggaaacaaaaaaggttacaaagaggagtaaaataagtacataaagaaatacaaaacaatgcttctaaaacggacattgccacaagaaagccaagactccagagggcaacacttgaatccttgggaacgaaaggagactatttgctgtggcctccttcctccaagaacatataccaagaacatacctaaatgtagagttctttaaacatgatttaatgtacagacaaaaatgaaggctttagacaatttagtagacaatttaatagtcatggcaagttaaacacagaaaggtctgtttatgtctgtttattttaggcaagggagcctgatgaggaggctttcaatttttgtgtacttaagaattatttggaatcaaagatcctaaatctgagcccccattgtgtatctgaatagaaaagatattgataggaattaaaaatcagtctccatttgaagcatgtagattccctgtttggctttgacctatttcatgtatctatcagaagatcgtgatttgggccttccttttatctttacacagaattggctacatctgaagagctgttacagctgtgttggatattgctgaaaattcctaaggatgactcagatgacaaattatatttgatagagagtctagtgggatttgcagagtggagcttcaaccctgagaatgattaagttaactgaagactcaacagggaacgcctgagctgcttcacgatgtggcatcccagtttctgtgtcacccctgtggtaaatttataaagtaatcacactattcaggaatgagattaggtaaggagatgaatttcaatttcctatgaattttcaaatataattacaataataattatgatagtaaataaagctataattaaaatataagtatatcagaacttcgttcaagagaacatgcttacaatacttcagaaagtttcacaattcaagtagaggcttaccagtagtttccctttcaatgattaatagtctgttatgttaaataagatttcaggtgacatgtttatgtctacataagcaaaaactcatagctacttatctacttatgtgaagcaacattgatataacaaatacaagttatcttacatgtatattaaggaagtttcctagaaatttttacttgcttgaatttttgtcagcttttaaaagtatatacatacgtatttaattatacatatatatgtggggggtatataaacatatacacacgcaaacacacaaaaacacatatgtgaactcttttgcatgccctaagattgtacttcattaagtgtaaagtagtggacttttacttaaatacaatactgaaaattactcaaagattaatgacaagacaaaaatcagaatggtaatttttgtaaattggccattaactccataacattatcatttttttcatcctttcacaatgcctcattagaaaacatacaaaattaagtgtcagatttgtatttaccacacttctaaattgcgtaaaaatatctttaccacaatcagtgattagtggaaagcatggtgaaaatatttgtaaagtgtgctagtcagttccagttgcaatgaattattttgagggtcatggaacctctttgaactttctgttcaatcttgggatacttcccagctgcaaaacacaaagacaaaaattcagagccttagctttaatagcaaagaataggtaggaatcaagatactcagttttttctaactaaattttactggaactttactttactaaatgtcaagaaaatatggattttgtacaaaagtgaaaatttttagttatttacaattccaatgagtaattttgagagtcatgtaacctctttaaactttctgttcattcttgggatacttttcagttgcaaaatacaaagataaaaatttagagccttaagtttaataacaaagaatagataggaattgagatacttcgtgtttcctaactaaattttactaaaactttattttactaaatgtcaagaaaatataaatcttgtacaaaagtgaaatttccaggctaaaaagaaatggttattaaaatggttctataagaaaaaaacaaggggtcaatgaactctaccttggggactaaggggaaattaaagaaaagggtcttgaagacttggtcatataatcactcaaaaactggactatcatgtcccactgccagtgtaatttgcctcaatcctggacatatctatggttaaatatgtttaagtcctgcaagtacaacatgactttttcaaccatatttttggctctactatgcacatactagtatttgttcaaattcttttaaaggaaacacaactcttcaaatgtggttttacctttatcaactgagtgaactgatcaacctctctgggaataataaagaagacctgcattgtattttacagttgtattggtagttctattatcacaagtagtttttaaatggctttacagtgatttgaaatctagaaaatgtccctaaaaataaagcatcttgctggcttcaaaaagaaaatcacacataaagccgcacaacaaaggggaggggagaggaaagagagaaacattgaaacatttctgttccatgtgttttccatggtggagataattgattttcttagtgctgttgtagaaagcgctgctggcattcactggcctactgagttcatcacagctgtgcttgtgcatctctctcaagctccactttccactgaattggaaaagatttgaatttttggttgataatctgccacacccttgctttgcctcatctttccaggcactctctttgttaaaggagatccagattaatcagtgctttagttggtgcaggtatttagatttgtgttaaagctccaaatgcaatccaaaaagcaaaatgacatgtttatgtgtcctggttaacatcagtgaagtcagggaagtatgggaagaaatgtgtggctagataacaatgaggacagcagttcctggatggcataataggattcagaagtgtatgcatttcacctagttcagaccctgtattaagaaatgctttgaccccgtattaggaaatgctttgacaggaggtagaaaaataggatctgggacacagaatgcaaaggatcctagtgcaaaacctccatattcgaggtagtgaagaatcgtaaatcagaatatctggagaatgaattctctaggtctctcctgaagaccttaaaatacaacaatccttccatatgcaaaacatcagctaatgtttcttaagtgagtgcatcaatcatgaatttttctcatgagtataaggcttttatttgaatagctaagcaaattaagaattttagaacaatagtaattttatttataatgcctaaaataaagcataacaagcattattttaaaaataacatttctaatttttcacagtggaaaataaatctaatgaagaaattcaataaatttcagcttttatagaccacctaaaacaatgagagaaatctaatatagatatatgaattctacgtagatacaaagacatcatgagaaaaactatgtttctgaattggtttgaacacaggaaatattttttgtgtacaggacaaagatgtctgaaagacagaaagatgcatataacagcctttccccagcatctctactgtgatccagtagaaaagcttatattcatgaccattctcaacagttacttttctcccacgcccccaagcagtgactctccaatctaaaataaagatacacaagaggttggtctcgttctagttttcctttcctgtcatcaaatgatgtcatctacattgagatgtcttggtttgtgtccttgtgactgaagatataagaaagcttgggaggccgaggcgggcggatcacgaggtcaggacatcaagaccatcctgactaacacggtgaaaccccgtctctactaaaaatacaaaaaattaaccaggcgtagtggcgggcgcctgtagtcccagctactcgggaggctgaggcaggagaatggcgtgaacccgggaggcggagcttgccgtgagccgagattgcgccactgcagtctagcctgggcgagagagggcgaccccgtcgcaaaaaaaaaaaaaaaaaagatgcaagaaacaagaaagcaagtttgccactgtccatgcttacaggattcatgtacacctgggaatatacatatgacatgagttgagtgaaaatttagtaacacaaattagaagaaagagaaagatgaaaattagtttaaaggaggtaatttacttaaggaggaaagttttgcattgaggcataaggaagtgacttccattaattggtgtgaaatggggagaattttatgtgcacaggcatagagacggacatgtttaggtgaaggtgaagaaaattagttcaagtgaccttgattagaattgaaatgtccaccgtagattatagagatagatgaactaactatgaactgatgattagggtgtaaagagatatctccattgccagatatagccttatactgtggacaagcatatttttcctgcagagatttatcaaagacctataaatggtatttgcccctctttcaaatatgacacaaaaattactgcttagatagatccagaaatacattggaaagttttgtggatgaggatctggaaagtatacacataaaagtctaaattagaaatatttatactaatctttagagtaatgcagaaaaaatgaccactttctctggtactcttttgctattctatgtgataaactctttctcttccagtttcctaaaaagttatgtcatgaaaaggctgaatttttctctagaaaaatctgctctgtctttcccaggcagcataaaaattggaaatctcacaagaaagcactctggcttgctaaagaaatttgtgagaaatggaaacagctatagataagtatctaacttttaggaagccattcaaacattgctgaaatactttgtcttttgatatttgcctgaaacttaacttctaggacccagggtgggtggatgagtcgaaggggcatacggtggcatttctttccgtgagtctcttacagtctcctatttaaattgagttaggattacttctggcaaaatcccaacataaaaatcttctaggaagatcagttctgtaaattagacatactagataaatgggcatcaagcagtttttcaaaattatgcagttgttaacttcataaggggaaataaaaatgtatgcatttacattgtatgtattaaaacaaggcagagcatttctatacgttcctaagttatacaaacatatatgtaagagtgaaatatgtaaaaaaacttttacataagcagatgcatacaaactccagatgtgctctttttcttactgtgggttgtgtcttctataagggaaaaagaaatatttatcatttcttttactgctgaggggatgggtgcggctctcatatttcagaaaggggctggaaagtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaaggtgagtaggtactgatttcaagaaactttatgggatttttgtctttcttctcctcacaaagaggggtgtaaaggggaaaatcagttgcctgattcaagataatttcctctataagctccagattgtgaaacgttgaactgaccatggctgtgctttttacattacttgaaaaataatcgcgttatgtgtgtttttaagagttctgtggttaagataagatgttcttgtactaacttgttttcatgttaaaggcactggaaacttttaaaaatggctttaaaatttttccctcctggattgttaacatcttggaatacttccccaggcagtctggaagttattggtctcttgcaataattttatgttcctctttgtctgctggattctttgtaaggttagaatattgagcattgttttctgaataagaatgcctttcaaatatcatggattaagaacagtctaaaggaagattctacgcattatcagaatcattgaatatatttctgtaaaatggctacaagatacctataaacattcttcaaagggatcaaactgctaaaatattttattattcctgtttttattttgtttcaagaatgattgattaattcatcttttctagtagcttgatattaagggactaatattttccacatattctacgttttaaccacattcgcattaatgaagaaaatattttttaaaatgtttcaacaggaggtttgactttgctgcaaacaaggtaaagatactagtactgtttgacttcagaaagctgttttgctatattttctaataattgcatgtaatgtttttcatattctaatttcccctaaaaacacatttgtctcattatttatgtgaaaatattcttttatttaccatagtcatgaaaatgctgaacaaattggaatacaaacttccatagaaataaatatttaagtgctaaatgtaaagatagctaggagaaattattagacaatttttattgcacataactaaacatggttacatttaaacatatagattttgcaaaggacactgcatgaaaatttggtttttgtttgtaatatcaaatgtatttgttgtcctcatagctaatacatgtaaatgtgtgtatgaggggaggggtagatatacaatgaaatgtcttcagttatattcagcccatggacacaaaagaaaagaaacacccattttccttgttcccttaatttcctctcctccttacccctcctctccttcgctttgccctcctccttatctctctccaccccttttggctcctttagacttctcttcactcatcaccccaccccttcctaggcaagcccatatctactcctctctcctcctctgtcttccctgcctgttactccctccctactccccatgtggcctccttatgcctccatttcttttttttagttctctctctccttgcctcctcaccctttctttcccctgaactctcaatccttcttcctttctcattcctctccccttttcctccctatcctgctcttcccaggagatgctacaactcacagtccttttttaggataccaaatgactactatcccccaccaaccatttattgaaaagactacaaacttaggggttttagctcaaaaaattgcaacatatttgtagttgcctcgtggttgcaagctttttataagcactgtggctatttttcttcccaatccaactttagtgggggggtgtttgccacttacagtaccttgacatcacattaagttctgtttatttccctctttctctttagatgcaaaaaataatcaataagtataaaattttgctgatatgtgtttgtgtgttcttaagctcaaaaagagttgaaagagaactgttcagcctattttttttgtcatgagtaaaagtaaagttgaagtgacttaagacagtacatcttatgttccctgtgggttttacaaggaaattctgctattagataagctttggaaaagttacaggaggtatctgaatatacagcacactgagagctgtcataaagttctggggtggggtttcttatatatgccctcataacttcagagacggcacagctctaatgaacactcacttctagttcactcacaggcattttctggatacaaacaagtcctcaaaaagaattttggtcgtcttacaaatttgtgaacattgtatttaattcatgtgttttaatccaccaatggagaaacatagtctgttttatatttcctgtagattataaacatgccaagttttaagtacaaagatgcgtcacctagtggctgacaagccaggttaccatttacataacgaatgccaatattaatgttatgtagctggctttggtagtttataatgagctttaaaaaattcatatgcgtgaattttaaatgttaacactgctctcctaaggaaattagtatgttacggataaatattgcaaacacatatactgacacgaaaacacaatggtaacaatattcagagtctttttggaaattagcttaaatgttacggccacttaaaaattctacatatgactattgtttaaatacatttttcatgtctctgatgtagtccttatttgacataagtattttattcactgcttaattgttagatagattatagacagctgttactaagtaatactgctccattagggcagaaacagaaactttattttaattaaatgtgtactaatgtttgagtttctatattttgctacagtgataattccagtaaaataaactgtaggcctctagttgttttagaattttaaaactgtaaatggactcagagaatcagtttcttattagacgtcatgagagtatatttttttcattatgctttaagagggaatttgtaacttgctcaggtaacattcaagttttctggtttgtgtttgtccctacaattaaacacactgaactaacaggaaaaggttacatacatttaggaacaattgcacttttaaagggagagaatgcatagttgctcacatatctcagtgtcagtcacctaacatggatcagtgctttatttgagattacaaaactagaaaatgacggagtcaaggctaggaccaatattctgttcagtcttagataattatagaatacacattaaaatcagatatttgaattttcttaattttgtaactatttgtcattgaaaggagatactaaaaaaattatatatcgtcctagaaagtacatgaactaataatgcatttctaaaggtgaaaaaagaataggtatttttctgtttaatattcaattttatagagagtagtacgttaatttttttaaaccccagaagctcaggatcttatcattttaaaagaaattatcaccagttctgtgtgagtaaataaagtattataacactttgtgtttttcatccatgataccttgtatttacttacctgagctttttttctagggaaagaaaaatgctcaggtaataacagagccttgaaaaatttggattttcaaaactacctatttatgtataggcctttagatcatctgatgttgaatactctttaagtgatctaaaggcctacatataaaaaggtatttttattaaattctggaattaaacatttcagcattacaagaaaagaaagcaaatccactggaacaattctgggaaagaaggaaagactgtgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactcaaaaaaaaaaaaaaaaaaaagatcatatagtgtaaaaaaaaactctccagacttttcaaaggggaaactttgcctgtttcatgtcaagatgacaacggaaaaaatgagatagctattcttacataaatcatttgtgaactgcagttgggggagttacattaaccaccagagtttcagtctgtgtctaatgaaaacacagcagaagtggattcctttcagattaactaataaaacccttgtttttttccatgactgaggtcaagcactgctgtttaaaatgtagtcttaatgaacaaaatgaaacgttgaaagaggacgagtcaaaatgcccaaaagatgtaaacatcaaagagaaaagatccagaaattattaaaagttaaacttcccttgaattctagtattaagaaagtactgcttcagtaaaatggcatatatttttctgaaactgtttttctatagtattttgtgtggaggatgacagagactgcatttctcaagtaaattaaaatcacagaaatactctttggagttgcatagcatgttcacaacgttccagtttcattcagtgaaaacttctgatgaacttagatgtatattaacatgaatcatttagtaactatattttctgaaaaacagtgtgttaatgagacatcttaaacatatttttgcattggatgcagaagtcttttctgtctggtactattgttgttagaaccctacttttttgtatatagcaaaatgtatgcagggtttctgagtcacacatttattctgttggtggtctggatgtcatcagggtagctttagagatataacccttcttcataaggtcaagagaaaataaacaggagaatttaactccagatggcatcttcctgttttgaggccagatagaaaaatattttgcaaagaactgttgtccttcaaaatatacctatctagattcagattttaaccttgcagggataaaaaatcatatgggacagagctttggagttggcttctttaatcgtactcagttttgaaatagcagaaagaaaatagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggaggtactatagcactagttttactaacgctggcaaataaaattactctaaggaagaaattaaagtacttagtaacttagtgataaggatggtgaaatgtaaaattttatttataagactatacaatttaaagttgtttgccaaatgtaataagacaagtagaatatattctcttcaatgtttttataatttgacactaagaagattttattatatatgcaattgctggtggttagatatatgatacttaaaattttctaattatctaattatttttatttttaacaggataaaatattaatcaacttaaaggacatttctaaggagattgaattctaaaagattaatcttttagacaattctaaaagattaatcttttagacaattctaaaagattaatcttttagacaattctaaaagattaatcttttagacaattctaaaagattaattgaattctaaaagattaatcaacttaaaggacatttctaaggagattgaaaaagcatatatctataaaatatgaaacaagaaaatatctacaaatgataatttatcaactttttttcctggaggtagcaagaataaataaaatcttattttctatgcaaaacagtgcttttaaattaaaattattcacctagaatgtctacagatactttcttcagagtcctttttgttaagtaatctaacatattttaagatactctgataaatacataagcagcagaaaaaatattttattaaaatttatgttttccaaacaatatcatttaaaaggcaaaccaaacattatttcaattggaaactatatgaatgccaaatacccacatgtacaaaatattcagctttctaaagtaatgaaaataattatgataatttatatatcatatctgtgattcttagattttcagattatacaacatcttttcccagataaggatttagtaagaagagaaaaggaaaaaacattcacttttcattcaagccaaattaattaatttaattaggtgctttagggaataatattattgctccaaaaatagtattaagacaaacataacattcattttttgtccaaacaatatgatttcttcaagtcagcatgatttaacatgaagaatggaaacaaaaaaatcacaaaatagtaagctttatgcacatctaaaaatataaaattatgttatttggctttatttttctctaaaattccaaaatagaaaactaggaaagaagcagctaagagtggtttaagacatgtgttagcttcaatatgttttatattatagatcccagcaaggagatgattgagtttaatacattgcttgtgtgatcacaagtaaatttctttcagaattgtacttcgtagtaaggaacagaaacaccaaatgacatgggagatggaatttaaaattaattataaattggaacagagagatttagtttaaacaactaaaataatggaaataattggaaagtccattacttttcaatagtagaatgaaattatttgccttttatttaatatttttggaaaaaattaacttatttttttaaccgaagctactctgaatgcagatatctaagaaatgaagagaataatatgagatgacttacttctaaatcccattttctattctatttctaaatgttgcaaatggctaactagagcatttttattcctctagaaacaaaacattcttttccttgactttgccatgattttcgcacatattactaggtattaaatgaaggtccatgaaacatcaatctaagagctttaactttcagtagaatatattgctaactatattttgtcatgcatggaataataaaggaagctatacaaaactatttttttcagcaaaggtaactaaggtagaaaaacagagaaagggctaattttcagccacaagtttttacaggaactgacttctcaggagagccaaatttatttcaagtggatgtgaaataagttatggcaataaataaagttgcattaattcttattttttaaacattccaactctcttttttttacttaaaacaatatgactttctaaagtaaaacaaaacatacatgcaccatgttgactgtcatgtgcaggtgagaagagaaaaatattttaagaatatgataatttttaaaattgcactaaaataatctttatattgaggcctccgtgttttaaaaagtactataatatgtttctaataaaatttagaaacaataagctaaataacaacgttaatacttataacattgcatttgacccaattttaacaaactcatttacaattttaataagtcaatattgtgctcatttatttaataattagcagaacaaatggaaagtactgtatttctaatgatgtgaggacacccttaatgagacataaacataggaggatgaatacacaggagggaaaagtatttatgttaatttctaggcagatcaagaacatatagaagatacttaaaataggaaatgtttgagcctagctttaactattatcttcatttgtctttaatatgcctttagtattcaatggctgtttttcataatccacgtgctgtattaagtgtgaaaagatatgcctgatccagaggcaatgagctaaaagaatcatctgtacaatctaacaatgcttttgaggatggatctggagggcttaaaatacacattattaatgggaaaatcttgggctgaaactaatctgtaggaatatttcatataaagttgatttggagaaaatttttaagtggttcattttgagaaaaggaaccaatgtaattacagtgttccatgtaattttactgcacaatcttccaaacccaaattttcggaccttttctgcagactggtgaacttagtacttaaatatgaaacgccagttctgtctagagaacaaaatgagtttaatgcatagactcacctgttattactcttcacaccaatgtgtaaatgactgtttgctcttctattaaatatattttccgtaacaccattcaaataggcctacttcatttccactgagataagcattttggtattcagcttttatattcactaagaattaagaaatgctgttttaaaagcttaggaaatgtatatagaaaatatatcccatgttctcatatatgtgtttcagacataggggaggaattagaataaattttctaaataaacaaattatttgcctacttaaaattgcaattaaaaaatgaagctttccttcgttagctgtaaactacattgagaaattgtaacataaaaaagaatggatttttaaaacttcttgagtagatcaagtgtcttgtacaatatcattaaatttgtatcagaacacataaatggaaatgaggtggggaagcaattgcagtactttctagagtctaggttttgaaattctttttggtgaacatttactaaatcagctaaacatttcaactcatttaaacacaaacctaaattattattaccctagacagagagatgatatagcaacgggacctcgaaaaggtgatcttttgtggctgcatgtagtgcccagatggaaaaatcttaggaccactaaaaggcctcttgaccactaggcggcaaaaactaattttgaactacttgcctactcggtagcaggcctctttcaatagacattttaaatatcttggctttgagaaaataaaaatttcaccatctcacaaaaatataaattactgaacagtacatcatttgttgtttgcaaaaatttttgcagatgcttagaaacttattatttatttactcaattactggcaaactatcatactaattgtcaagaactaaagttgtatttaaccacaatacacagctaatgccttaagaattgagaccaggttttgttttggcaattcctaagctgattcatagttaatagctgctgaaatttcagtaccttgtatataattatgaagcaagtctaaaattttggttgaagcaattttttttaccattttaagccacaaatacagatggttatgattcatattttccctattatttttacttattccttgccaatgtttattttaaaaacatctttttcttttctttttggtgatttggaaatgtctttacatccatatgggatatacaatatattatgtcatatcatgttgagctactaatgccaaatagagctaacagtgacattcaatacacataataagttctgttaaaactttcccaggaaaatctggtagagttttatgctgccaagattagctcagttttcccctgaatttctcaactaggttgataaaatccagaaagtcttcagagttagtgacaaaatcatctctttagtttaatgctcccatctgctgttaaggcaaagaatagcaattgggtagaagagcttattttcaatgttcctttaataaataaatgtttaaatgcttgtgtgatatacattgatgttaattcttactataaatgaaattaaaatatctgctggtcttaaggaaaattgactatggtgtgccaattttatgttaacaagcagatatgatattttaattaatttcttgctacttagcaaattacatagggcaagtataattttctaatgaaaggaagaaattatttgtttcaaaccttttcaactttggctattgttaatagtcctaacagagtaacaaaaatcacctttcagcaaaacctaaggaaacttcacgtcatctaacttgtttttcagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctgtgagtttaaagataaactgtacatcttcaatattcatatttagacacatgaatagctcctatatcataggagcctaaaagggaatgaaagtcatgttcatcaaatagccatgtttgtattacgagtaaaaagtgaccgtttcaatttaaagataaggattggttagaatctgggttactaaataatatgcaaattctgtgtcttgtttaacttgtttcttttccatttattagcctactcgccctcctaatggtcaaggacctcaaggccccaagggagatccagtaagtaaacattcttcagtagaataaaattaatactaatgataattctagtaagagtttgctttttctagatttgagctttcatcatacattctcttcattaccacatatttgaataatggcaccaaacaacagactgagaatccataattgtacgtgtaaagatttcaatttcccaaacttcatattatgtcttcacccccatgatcagtttaaagaaaatgtgtaggtcaatatacaaaggaatacattatacttaaattattcacaagattttgattaaaaagtatgtgttataaagaaaatatattacttatattgtttcctaatattataaagtagagaaacaacaatctgataatgattgtgaatcaccaggatttttcactatttaatttatttttatctcttttttagggccctcctggtattcctgggagaaatggtgaccctggtattccaggacaaccagggtcccctggttctcctggcccccctggaatctgtgaatcatgccctactggtcctcaggtataacaattacggtacttaaaaaattccctcataaaactatctagttcatcttctttctttactcgatattacgtctcactattatgagttctttgtatctgttctctgattcagtgtatttaataaatccttatttagtgcttctatgtattaggcactattctaagtactttataagtattcatttttcctcataatgctaatgtcattgctactatatccttggaaaatttgctaatttctcagcagatatatagcatacacattatgtttaagaagtgaactatgaacttaacaaaaaaaattaacctaaataatttagttagtactgtatccatactttattctcctactaataccaatgtcaaagcctctaaaagtttagacaaaaagaagttgaagaactgttagtattcctattgaacaggattatttctgcctatgaaactgctcttgctaatacttcagagcacaccttgcttctcctgaagcatggcagccaaataaatctgcaggtaaaacaaccaaacaaataaatatgacaaaatttctgttgcatggaattaggtgaaacgagaaaatatattacacaaatttttgtgaggttaaaaagtgcatttcaaaaagcaattcaacaagaaccaaagtatattgtctaagttattcttattctagtaaccaaacagaacctaactctagacctggaacttagaatttaaaaaaagcttcaaagaaatctaataagcatatgagcctttctactattttttggtttattttctatggagatgtttatttttgagtgaatcttttagtcatattaaccagaatccaggggatatgaattttacttgtatcattaagtgtttgaaaaataatttgacttcatttttttgctcaaaatgagaaggtgtattatatgatctcgagactcttttggcctcaaacagcctatgatcctatgtttgtaatgatgtagctactgcttagaaataatagcttaagtaagcgcataataggaaaaattggggggaactaacattgaacacagtggaaagatttgtgcatcccacaagaaaatgcttctgtaggatatctaacgtctaaatctacagaaagacacgataaacaagataattagtgaatacataccacatcttttggcacacaaaaacctatcagtagacagtagatgttgcatgcacttctaaatgctttttaaaagaattatgaactgtctgttaaaatgatcatatctatttgtctccttgccacagaactattctccccagtatgattcatatgatgtcaagtctggagtagcagtaggaggactcgcaggctatcctggaccagctgtacgtacaaatgtttctcagcattttggagctttattatctttctggtttgtaaaatcttgaatggttgctcttctaggaattcagtatttttatggaattgtacaaaatagcttacccctactaaggttggaaaagaaaatggtagcattatcatgttctttctatcttattcatattattaaacctatttttaatcacatataaatttttactaaaaaaaaaaaccaaagtcaacacttattaacatctcagaaaagtgtttataagagaaaatggaaatatacaaactattgttttataaatttactatcagtatttagaaacagcatgttacaaaactgaagcatactgttttcagcttgctgaaggttttctagtttaatctgtatttctgaacaatgataaatcaattgtcctatgtatgatgattcttgcatgatcatataaatctctatgtcaattaactctgtgatagatatatcaacataattatgggacttttgggttgatttacattattattttagatacttgattataggatttctagtgtgccaataaatgtttttctgcactgagtttggctgccaagcgagaaattgcttcttcaccagtgcaatataaccctaacattgcagggattttcatagcattatgtactagtttttccagatttttaattcccttccttaagagttcaggacaacattttataacatttattaataatttatatagaatctgtgagaatttcattacagtaatgtttgcttgctaagatcttcattatagatctcatgaatagttatcaaaaagttatcaaaagatgagatatagttgttcatagttttaacaatgcgagtgtcattgctttgaagcatggataaagtgtattttgcattcatttattttgtttttcattcaaattcacattccagggccccccaggccctcccggtccccctggtacatctggtcatcctggttcccctgtaagtatagccattggtggtgttttcttcctcatttttagaaaaatcaaattaatatatattctgctataattcagccattccagcatgcataatcccagttaactagagaaatcataaccaagaaactgattaaggcttcaaagatggaattccatatttaattcctttccaccaacagttattagcaattgaaatcttggtaaaattaaaccacattaatttgcatgtaatatgacttttagttcaaaaccattcagttttgatggattgcaatgaatggaatgaaatacattaacttcattctgatctaaaaataatttggtctcaatatttataaactggagtaaaatttgctgattacattcacaatcctgatttcttactgtcaagatgtaaatgaattatatgaagattttgttactttaaaattatttacatattctactcactagggatctccaggataccaaggaccccctggtgaacctgggcaagctggtccttcagtaagtaacaattaaatttatatttagtaagtcgataattccatatggaacctacctttgttttctaaaacaagtataggtctttacagaatgaagattaaatttacccttaagtttgtaaataacgaatagcattttattgagtcttttggactctttcaattgttagctatcttagagacactagttaataaaggaattccctcatcattagccatcaaaatagtccacttcccagagctgataaaaattctgtatatattaaatatagatttcatttttctgtaaacactcagttcactcatatctaatctactgataaatatagttatatatttacatatgtaaatatacatatacatatatcttagacagtagaaataaacataatcttagagagtcctttagaaggatatgctctgtaaataagcaagtaaaatagtttaaatacaacatttcatgacatttagaaatacctttatatttagatatatttaatattcctaaacgtgtagaaatgcatttggatttataaatacacatacgtaatatatgatgcttttaatttttattaacagtaagttgatataatagaggtataatattaactcagtaagtatcattttcattatcagaaacattaaaagtattttctaaaaggaggttccttccaggaatacatacactgtgtaataataaattgtaacagaaaaatttacaaatctattcattttttatttccttattttcagggccctccaggacctcctggtgctataggtccatctggtcctgctggaaaagatgtaagtttttaaaacttaaataagaatacagcaaaatttaacttggtgtattctaaacagtatatgctttatgtcagaatcccagaagaaaaaaaaatgttattcaaaatattgttgtcttaacaacattttagttaatactaatttttgagtagctatacagtatttgcgtttctatatatatcatttgttgaattccaaaataaaatccttaaagtgctttttgactgcggagaagactcatccattgaatatattatttaactggaggagaaataggtgtctctgcctgcctcttttaatgatgaaattgataccactatttaatgaacttgagaagttatagataccttcaattcaatggcattccttctttccctcttaatctccaatggcaaattcttttcactggcttatgttatttcagtgattagaagcacctgcattatctctttataagcttatatcaaagtgggaaaggtcttcctcatgccttctaccaagaaagctgatctcaactatacattttgtggaaccattttaatgagtcctttgtgagaaaaatgcaaagtaaccattttgcttattggctacaatgtattttctcatacatgagcacctacgtattctttatttctctacctagggagaatcaggtagacccggacgacctggagagcgaggattgcctggacctccagtgagtcttcagcatctaataaattaattggaataatcttagcttgaaaactattatgtaattcaatggaattaaacttaaaaacagaaagtgttttactactagattgtgattctatttgaaggttcattaatattttttcattcattatttttagggtatcaaaggtccagctgggatacctggattccctggtatgaaaggacacagagtaagtagagtttctaagttgtttacaaggtattccactgggctatgtttacttgcctaaccaattttactggacaattatgtgccaaaaaatatgattctgacaattaattaatttgatatttttaagtctactaagtttgtttgttgaccaaactagtcattttttgcaaaataaaggagttgatttctagtgtataaagtactcttgaaaaatatcgttttcttactaccactatcagaaaaataaaaacattttgtgaattatgttttttattgacttaatatgatttatagattgagttgaacaactttattctatgcaaaatatttcgtacattcaaccaactgtgcctacaacctatcaactgaattataataaaatctatgaaactcatgtttgctactctatagttaaggcaactttcttatcagactaaattgcactttctagttttcatgttttcctgttgtaaaatcagtatgaaatatcttcaacccctttaaacaagttttaaattatttaagctaattttgcaagtagtgttatgaagaccaattagaaaaataccatgtaaactttatcaatcattctagattattaacagattttaataattttgctggttttatacatttcctagggcttcgatggacgaaatggagaaaagggtgaaacaggtgctcctggattaaaggtaaatcacaacaaaaatcatattttcataagtaaattcattaaatattaaagctacatataagattcatattgtgagccttaacttgttttctgaaatttacctgaattttacctattaggtgtgaataatggtaaccaattcagatattctattaacgcttccatgaaaaatgacaacttgaagagtctagattagaaatagttgagcatcttagtataacttatcaattacttcactttagtctttaagtttttaaatacagaaattgagatttctggtaaataaaatactaacagaaaattaatattgttaaaatgtatatctttttctaggctctataaacttttccataatattctgtatttaaaaatatataatattttcttcctcttttgtaaaatagtaacatattttatatgtatctagggtgaaaatggtcttccaggcgaaaatggagctcctggacccatggtaattatgtttcttatgtataattttcagttttattattaacctcattgttacctaaaactggctttgctcccaccccaactgttcttacacatgtcaagattagagtaaaaccatatttcaattttactctgtagggtccaagaggggctcctggtgagcgaggacggccaggacttcctggggctgcagtgagtatagctgctaacatcacacaattacaacccaaagtgacagatttttacagcctcagtaaagtttcaggctgtaaaaatatgttaggaaaaagaccttcctacaaaattatactcaatgatactgtgataaagttttggctatagttaaaaggaaatgaataattgttttacaattattatctctattgagaatttttgtgttaacttttcatatgtcatttgagccattatatctgcattcagtcctgaaaacacagactccaatccttctacatttgattgttgctgtatatatcagaattgtaataattgactttaaaatacataattattaagcagattttaatgtacttgaagaaaactcaactcacttgagtcagaattttggtcaaaatattactcatgaccagccattcagaattaaaaggatatttgatgtaaacttctctttttagggtgctcggggtaatgacggtgctcgaggcagtgatggtcaaccagtaagtaactttctatctcttatgtgttgtagggtaatgagaagttatggattgtggattatttaatattttatatatgtatatactcttaggtatatatatatgcatatgtatatctctaatatacacattagcatctctgttgaccatttttacaatttaaaaagtgaaaaaatattgtagccccaatacttaatattgtatatacactcctgtgattaaaactgacactgagcccataaacaaaatctaggttctgacactcattctgcttgatcaactgctaacatttgaatggtgctcccaatgttagttaatatcctatgtaagacatggcactttaaagagtcctacaaaatggataaaatagatgttacctccattttgtagactggagtacaaaagcccagggaaaagtagcctgcactaagtcacagaattcatggcaaagtagggagaaaccaagaatttctaactttagatttcactcttttcttattttaccacattgtttctctacataatatccataaaatatgaatatcatttttatctgcataaatatcttctttactttatatgtgctcacttatttactagtatgtcagctttcatttagttgaaaaagagctcttgaaattgtatttaattttttcagggccctcctggtcctcctggaactgccggattccctggatcccctggtgctaaggtaaacatgtgtttctatagaagggtataaaaatatcttggaggcaagagaaaagcattagattgcttcttgcaactgatttttttaatcagtcaaatggatagcttttatctatacatgtctttaaagccctattcttgattctaaaagaggtgttgtccctagtattcaactatcttgatatttcttctgctaccttctttttttccccagactctttctaggaaactgataatgcaatcacacacacatagttacatttttctctgcctttacgattaatgattccttgctttacctgcagtatagagtcccactactccaacttttgggagatgtgtttaaacaggactgaagggtgaagtggctaagtgagtagaagtggtaagagaaactgactacacaaggttttaccattagggtgaagttggacctgcagggtctcctggttcaaatggtgcccctggacaaagaggagaacctggacctcagggacacgctggtgctcaaggtcctcctgtaagtatcatagttgagagggagtaagcatagtttcatgcttactccatgaaagcatagtttcatgcttactccatgaaagcatgtgcttcaatatggctatcagtgaaaattactttgaaaaaattgttgcttagtgctctaaaatgatcctcctgtgacacatactgatttgattagtagtaaaaatgatagtttttgactgttgcactattccagaattcatgattttttatgtttatataaaagaatagaggatagactagttttctgatgctttcaagaatgtgccccaagctaatcaccaatcataaaaattcagagaagaaccaaattcaaaatctcttctatttatgtatcatttaataatttatacgaagtacatattatctctaatttatttagataatgatgattcttttgaccacatttcatatgttgtgttatagttggaggattcacttaatctctacaaagcataacactcatcgatacatttattttcacacaaacaacttcaaatatatacgaactatttgcattactattaatacattatctgttttttgtatacttagggccctcctgggattaatggtagtcctggtggtaaaggcgaaatggtaagctgtccccactcctcagccttatctcatccacacattactggcttcttttgcattttgcatgacaatagatttgtgatatttaagtgagatattcataaaagaacattcaagttcggctaatatagtgtctttggtttgttcttagggtcccgctggcattcctggagctcctggactgatgggagcccggggtcctccaggaccagccggtgctaatggtgctcctggactgcgaggtggtgcagtaagttgccttgttttttctctgttgactgaaaggtatagtttaattccatcaacaaaaaattaatagcaaaattttgctcctgttcagttgaatttatattgacttcactcttgtcttataacttataactgaattatgtgttactggtgatgatttgttagtcgaatcctccctgtgtttcaaccaagactttgttatactttagggtgagcctggtaagaatggtgccaaaggagagcccggaccacgtggtgaacgcgtaagttttactgcaacagatctggttatttcttgaaaaaatgcaacataattagaaagtaaacaggtaaaaactttgaactaaattcagtcataatttctttattttaccatcttttttttttttcagggtgaggctggtattccaggtgttccaggagctaaaggcgaagatggcaaggatggatcacctggagaacctggtgcaaatgggcttccaggagctgcaggagaaagggtacgttttccatggggcatctaaaagaaaagcagcatcactgtcatctaaataaaactaccttcagggtgagacagccaatttttcttaagttgagtgttcagtgaaaatattgtttaaagcattctatgacataaaaatatttgccactcaagaattatgaaaaagaattgaaatcctttggactgaaatacttgtctttcattattttcagggtgcccctgggttccgaggacctgctggaccaaatggcatcccaggagaaaaggtagataactttagtttctatgttcctaaatgctagcaccacaaatgggcagttcttgtatacaatttctcattcatgaaaacctaaatatctgaagaatatatattagagttaagaaaaattcctaatataatgcatcctctgttcaacaactttcctggctttgtaactaaagccacttacttaccctctatgagaatcctttacttatctgttaattggaaagcatttatctgagcatcgttgcaagagtacagtaaactaaaatgcctgaaaagtctttgaaaactctaaggttacatcaaatatgatttcatagcattaagatatttgattttagctgcacataattatatttttaagcacagtgaatactgttttattaagcatgtgatgttcacaaagttgctttaaaattttttcaatatggcaatccaagctaagataactgattttatgtataaatgtttcagcaacacacgaaccctttttaaaagttcaaatgacgtcctctctttgtaaccaaaatattgttgctatctaggttagtgaaggctattttaatttttttaaaatttctttcactacttagggtcctgctggagagcgtggtgctccaggccctgcagggcccagaggagctgctggagaacctggcagagatggcgtccctggaggtccaggaatgagggtacagagaaacatttgtttgaatgacactttaatttagacagaagaaaggcaagacaaatgaagacagatcaaaagcaacttaaatcaatcagattacatattttgtaaggcaccaaacaaaacaaaattcttttaagtaaacttaagccgagatagttcaaggagaagagaagatagaacacttgccttagatactttatagacaggaaaaaagatgtgcaaatctgaggcttcacatgtaagtgaaaatatcaaaatcatacaaatagtgtatgtagtaattttttattatttcattttaaatcacctaacaactgacttctttacttcagggcatgcccggaagtccaggaggaccaggaagtgatgggaaaccagggcctcccgtatgtacatttttaaaatctcattttaaaaggccagttaaaatggaatgtatatgttggcctatccttgagtgtgtgtgtgtgtgtgtgtgtatatatatatatgtatatgtatatctatatatatacacacacacacacacacacacatactatatatatagcatgctttaatcttctctttatcaaacctttattaatgtaattttttcttattagggaagtcaaggagaaagtggtcgaccaggtcctcctgggccatctggtccccgaggtcagcctggtgtcatgggcttccccggtcctaaaggaaatgatgtgagttccttcattaatttcttcaataaatatttgactggaaggcttttattttccatatggagtaaagaaatggtcaaaactcagtctcctcttcaaagcatggaggagtatatgaaaatcaaattgcatgtaggaagggagctaaatatataattggttatggttgtatgtgtgtgtatggagcaggcagataaaaaatatgaaacaggctgggtgcgctggctcacgcctgtaatcccagcactctgggaggccaaggcaggcagatcacctgaggtcaggagttctaggccagccttgccaacatggtgaaaccctgtctccactaaaaatacaaaaattagccaggcatggtggcatgtgcctgtaatcctagctacccaggaggctgaggcaagagaatcactagaacccggggggcagaggctacagtgagccaagattgcgccactgcactccagcctgggcgacagagcaagactcagtctcaaaaatatgtatgtgtgtgtgtgtatatatatatatgagacatatatatatgagacatatatatatgagacatatatatatgagacatatatatatgagacatatatatatgagacaataatatgattagttattgccctttgaggattagtaaataccgaccacttcttctttagggtgctcctggtaagaatggagaacgaggtggccctggaggacctggccctcaggtacgtagctttcctcaatttatttctagccttctaatagatgcgttcatctccaaccttctgacttctctctgtaatctgtattatttctacttccctaactgttcttgtttttagggtcctcctggaaagaatggtgaaactggacctcagggacccccagggcctactgtaagttcactcatataaaattggagatgaaaatagggtggaggtggggcaggaagaatgcttcaaaaattacataatctctgacaccatgttgttacagtttaccaaagcaatgatgaaacttgctgacctagttatctagctaaatgctagcattgagtttagagtgtacatgtgtgctttgggtccaggtcctcccttttcttcacatcactacttttataattaagcaacaggcctgttgaaatggatactgtagactaaatataaaaggatgtttacaacagagtgtatcattatacttttctaggggcctggtggtgacaaaggagacacaggaccccctggtccacaaggattacaagtaagaacttgttatttaaatgtcacggcatatctgactgtcaaatttttttgtgtccctaatagattataatttatctgaagcttaacttgtgattctgtctttcatctggaaataaaattttaggcaatgttaataggtaggcatatcttccatgtccgttccagagcacattaataagttatttaaaagaattaatgaaactcaaataattctatttggttacacttatttttattataacataaatccatatagccaagtctatcctgccatgctggtcaatacatttttacgtgtagcaattgaaagaacagagagagatgaaaatgggtttgtaaaatatgattatcacgtatgtgtcactggattttgagtggcacaacgtttctacccctacaagaccactggaacttttttttaatatcttgcagaaacatgtgtacatatgagaagcttttctataagccatgtttgaggtaattacctaatacaaatatgattctttctagggcttgcctggtacaggtggtcctccaggagaaaatggaaaacctggggaaccagtaagttacgtttcattattcaaaactcagaaacaaaaagaatacacactgtttgtttgtcaactattaacttcttaattttcttatgccatgatatttgagatttaacatttagttttgaaatattatcaaaacaaagacaaattatttaaaagataactattatatagagtttgaattttaccataaaatagagagttcatagtttcaagatttgaaaaattatacagtatgccaacatgacaaatgtgtattttgcttatatttacatatttgcttatatttacatatttgcttatatttacataaaatgcactctgatatgggcctaatcatataatgccaatctcccagggtccaaagggtgatgccggtgcacctggagctccaggaggcaaggtagtatttcaatttattctctaccttcttcagcaggttatagagcaattgattagtagtatatttttagtatatcaagccaaaatactctttctttaaaagagcatcattgcaaatgtttggtaagtacacttagagaaactcaagacactttcaatacattaaatttgctttaatctggaaggtccaattctctgacattcataatcactacagaatcaaatacgggcttaaaatttcaaacggaaaaatattgccaatatgttgattctatgtaggaaaactgttttggtaaaaagaactttaaaatgttgctcttgtgaataaaataataagtatttcaatgacagctcacacttaaccagactaagtatccaagttttattttagacactcttttaagcttctagttcccacccagctgttcaactatttttaagtatacaaatttctagattgttcacaatataataacctagtggcctgattcaaaatgatgcaagttaaggtgctttgtttttagctttgggttgtctaatatggttatttacatatttttgtcacagggtgatgctggtgcccctggtgaacgtggacctcctggattggcaggggccccaggacttagaggtggagctggtccccctggtcccgaaggaggaaaggtaactccacagcattccattcacctaggtttaaaaaatgcatttgatttccttctgatcatttattatttctcacttattttcagggtgctgctggtcctcctgggccacctggtgctgctggtactcctggtctgcaaggaatgcctggagaaagaggaggtcttggaagtcctggtccaaagggtgacaaggtgttgacttgttttctcttaattgttcaataaatcagtcattgtaggttttaaaaaaagcaacactcctggaaagtaatcgactgtattttcaaaattaatgttatcattttatagtaagtgaaatttaagatggattcctaaagcaacaatgaattagaacacccaatatatatccctacaaatcctgagagttactcctcttcttggctgattttcactgaagatactttgaatctgatgacattggcttttatttgacagggtgaaccaggcggtccaggtgctgatggtgtcccagggaaagatggcccaagggtgagtattcccagtgaggagaagcaggccttatctatatgtcatatgggacagtcctgcacttcaactttaattttttccaaaaactactcaagagaaattagatattttaccacctaaagacccgaatgacttgatttataatgaaatttgtggtctatatctatggctacttgatagatctacagtgactaaagaatgaaaaagcctcaagagtacgataaaggtcacaaactagcatttgtgagtcactaaaatctgagataatcactgaaatttaggataatcaatgctgctcattaagaaactaaaagtcatcaaaattcaatatagtaagtactcctcattaatagacttaatatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatggtgattgcacatttgagtatcttgattgaggtggtagtcaggcacatctacacatgggataaaattctatagagctacatatacacacacataaatgagtgtgtgtatcactggtgaaatctgaacatgctctatggatggtatcaatgtcaatttcctagttttgatattatattatagttgtgtaagatgttaacattaggggacgctgggagaaaagtgcacagaatttccctgtatattcctttgcagcatcctatgaatctataattcaaactaaaagtcaaaaacaaaacaaaaaacatctcctaaatatgattataattaagtcttttaataaatttatataatagttgccttaaagaaattcataaatgcttcgcttttgacagactaagtagataagccgtcattcaggtaaaaagagtgctcaatacttcagttttgtaatataagtaaaactactatttgaaaatttcaagttgaaaaatttaatatgtacaatgagactttgagaaaacatttaaattatcaagcaattgaataaagaaatgtactttaatttaaaaagacattactgtaagatcttacatgacatcctatttatcttctacaatggagataaagataaatgaatcaataaactattgctgaatcctattttctcccagagttatccccaaagaggcttgtgtttactgagctctgcagtatttacacattgagagaaaagcatagcattcaagccataaaaatttttaaaaagtatgttatctagtttattaggtatctatgtctatatactttctgtttgattaatgcaaaaaacgatatttgtatcttcaaaattaaaaaatatttttatttcctctagggtcctactggtcctattggtcctcctggcccagctggccagcctggagataaggtaacccttaatactacctggatataaaaagaaaatgtctctctcttttggatgcaagacagtgacatggcttctctttttccagggtgaaggtggtgcccccggacttccaggtatagctggacctcgtggtagccctgtaagtgttaaagacattctcaacatactttttaaccccatacagacagtagctacttatgcttccctttttggcagttttgccctcagttccctgagcctcaatttggagatattatcttcaaaaaccatataaggaaccatatagcatgcaagggaatgttaaatttcttaaatctaacattcacaggagaccattttaaatcaggatttctttcctaaataactttggaaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcttgcaaataatatcacagtaggaggcagaaggaatcaatggttctggtattttccactcctaattttattgagaagtggcaaagtcttcagaagtttattggctactctgcacatttcctgcttaaaggaaagaaaagataagatgataagatgacatttcctgcctaaaggagatgacgcacacttcactgtgactaaggaggatatttttctcttcagggtgagagaggtgaaactggccctccaggacctgctggtttccctggtgctcctgtaagtgtgaatatttatacatacatgtcccatagcccaggatctctatcttgctgaaaaattacaaaagtatagtcaagtttggtttctagtctcattttagctgctcattccctataggattattgtacccctattttgttttactttacccctattgtcgctctttgaaagatggaaataaaaacacctgtcctgcttttatgactgggtaatgaactaaagcagtatcatggatttaaaagcactctgaatttttgtaaattcttccattataagatggtactaattaaaattttctcttaaatccggtctttctcaaaaaaatttactggtgctgattttcaaatgtttaatccttagagacacttcctccctccctaatggcaaataatgcacagtttatgctttcttggtcatgttctttgatcatgaaaatattttgattggcttcattttgtcatgtcttcagaaagccttgtttttaaattttatttcaactccttccatctgaagaattctatattctgaagagaaataataataagccaattgtatcataaagagtgtcagctgagagattgctgttgttgttgcatgtagggacagaatggtgaacctggtggtaaaggagaaagaggggctccgggtgagaaaggtgaaggaggccctcctggagttgcaggaccccctggaggttctggacctgctgtaagttccttcctctttctctgtctatctatctatcatctatctatctattgattatctgtctatctctccctctctctctccctctcccccctctgtaagtcctaagtgttctaatggaaaaacatggaggtttatcagtaatttaatattttatactgagatagcatgtcatagtgtcaagaatataatctttatatgaatatagtccaagtatgaatctcagcaccagcaatctaaaagttattttaacctcttcatagagttcctggttttcaaaggcttaatgcttttcccaaattttgattttggtgctattcttacataatttccttccatttcatatagggtcctcctggtccccaaggtgtcaaaggtgaacgtggcagtcctggtggacctgtaagtattgatcctcttaactattattgaaaagcattaattgatatcaacctgtataaaagctgcatttgagacactagttccataaagagaatgtaaaaattgtaatcgctcattcatacatgagttatatgtaaattccaaggggaaacacaaaccataaatgactttcaggtacaatgcagatcatgccacacattatactttttgtttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagtaaaaaaagaaagaaaaaatgcactttttattataaatattcaaatttcaaacaattatttgtagggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccagtaagtaacttcatttttttaaattgattctactattttgatttttatcacaaatcgattagagaaaaacactgtcacataaagatgagctaagtcttcattatctgtattagggagctccaggcccacttgggattgctgggatcactggagcacggggtcttgcaggaccaccaggcatgccaggtcctaggggaagccctggccctcagggtgtcaaggtgagtatagtcattttccactacactcttccttcctttggtagccttcagagatcacttaaccatatcaaggatgaaaagtttttctgtcactggagtaaattagccaggagataatttttttttatttttagatttttaaaagcataaattttaataaatggctccagaacacaaaacagggcatatcatagacaaaccttgaatataaacacaaataaattaatatgatgaaaacaatattgccatctcaaacacctcttttaggaaacttgtgaatattcttcaatttgttgactgtcagttttgaagggggaaatagtgttagcttatagatcttggaaagtctttcattaatgctagttatccatccattcaagtcatcttgcactcctgactctctttcactagtattatattcctataacattctagtgcttagcatctaaaacattcgtttggtaaacaggataataaaattgcatttttattagggctcgtattatggcactttaagtacttctttcaacaaaatgttatgtaatattgtcataaaattaatatttcatatttaagtgtgttcaattgatatgatatttctggtaagtgtatattcttcagatagagacaaataacctaattttaaggatcaccatacacctctagtttcatgatggctcattattgtttttccctatactaatcatgtttatgtattcatctcagattacaatgtacagtattctgaattagataatcaatgtaactattcagccctttgccatccagagtcactgagcaagttagaaaatgcaagaagcttgctcccccatattttttcccatagcaggcatagttttaattttaaaattcaatgaagattaaataaaataagttttttacctgaaaataaagatatctgataacaccattttaattgatttcttaagttgaaacaaaatgtttttcattcctttgtatacagggtgaaagtgggaaaccaggagctaacggtctcagtggagaacgtggtccccctggaccccagggtcttcctggtctggctggtacagctggtgaacctggaagagatgtgagtagcagtttttattcaaccagccaggtagaatttgataatttatttcagcaaaggtgaaattgagctttaatgtctaagagtgtaaatatggccacatagcaaagttcttctatctctaataacagaaattctttcattacaatttaggatagacttaaaagctcttgttcattagtatttacccaatgaataatcatttgtggagaaaatattatctctaactaaattaggaaaaaagttagtggggagaaccacaattgacatgttttctgagtgaaaatattctacggttatctatggttagtcttttattatttttaaagaatttaaaattaatattatttataattaacaaatcataattgtatacatttataaggtacaatgtgatgttttaatatatgtatacaatgtggaatgattaaagcaaactaattaaactgtagatttccactaacagtttagatcactatttcttaaacttttatttattagaggtctgtaaagactctttttggatatcatttttctaatcacctctcctccatgaatacactaactatctgtctggacattgtgaccctttgaagggccacactgctttgtaatatctaagatttcttacccccaagaaccaattttaacccccttgagaattatattgccctgctgagaatgcatggatgaaatggcatttggaaggtttcaagaaattttatttcctttctcattttttaatcagggaaaccctggatcagatggtcttccaggccgagatggatctcctggtggcaaggtataataaacacatgtgcaattgatttgtgttatcaaaataagtgatcatcatgtttattttgtacctatgaatttgttcacagggtgatcgtggtgaaaatggctctcctggtgcccctggcgctcctggtcatccaggcccacctggtcctgtcggtccagctggaaagagtggtgacagaggagaaagtgtgagttcccaaaagcagcatctgtcttgtttgtctatttccttcaataaagacatttgtaggtagaaggtagaatgtcagatctgccaaccaaaatatccactgtcatttgttttacagttttaatgctagttgttccttagacaaatgtgtgaataagtcaataccagaagtacttggcagtagtcaataaagaattcattactgaaacccgaaatcatattaatcagaccaactatctatatgctgggtaaatgcaaggccaagttaacagggctcttgcccaacttttctgtctagatcccctgagaaagctataaacagggctttagcactttgaaggcaaaaacaatattaacttccaataattgcatgcatactataattctattataatgaaattatttacttttgaaaacgaaattgtgtcaacacataaaactagttccgtgtatgtcttctcaattgaatgttttcatcttagggccctgctggccctgctggtgctcccggtcctgctggttcccgaggtgctcctgtaagttttgtcattttttggttttattttgttttgttctttttttaactcattctacagtgtaggaaatattttattttccagcgtgttcaggaaaaaagaatgaatatatatatatatatatatatatatatatatatatatatatatttgttctatctatagatagatgatagatagatagatagatagatagatagatagatagatagatagatagaacaaatataaactttcctttaatgacaatgatatggaaagcagttcaggatctaaaagttctttggagccaaggatagaaacatcagttgttagggatccatgcaatgatcagtccaaaatgaaaacaaccacagaaacaaatctcatttcctatctgaagtgtctgttgatgggggattttttagctgatagaaagccataaaatagatttaattattataaattctattttatttttccaatatgtatgtgtgtatatgacttcaattcaaaatatgtttctaaagggtcctcaaggcccacgtggtgacaaaggtgaaacaggtgaacgtggagctgctggcatcaaaggacatcgaggattccctggtaatccaggtgccccaggttctccagtaagtgcattcattttgttggaaaatcccttcaatgtatacaaattttagagattaagagaagaaagctttccatctctaaaaatatgtactagaagagatgagaaatggatttgaaggctaatttgaaacaacaatcagcatgacacaatgggaagattaaagaaagaaaaaaaatttcatcatgatccccatgtttcttgatctgatcttgaatgtacagtttcccagtgctttttaaggccttcactcctatgtacacttcctttctttccagggccctgctggtcagcagggtgcaatcggcagtccaggacctgcaggccccagagtaagtagcacagaaagatattacaggtccacatgtttcagatgtctgcatttcagaaagatattctggcattgtgatgtcatgatactttcttagggacctgttggacccagtggacctcctggcaaagatggaaccagtggacatccaggtcccattggaccaccagggcctcgaggtaacagaggtgaaagaggatctgaggtaagacatcacttatacgtatgtgtatttaatttgctacaatcttccaattttcagaaacacagcgcattatgtttaaattgaaatagagagacgcaatgcatccactcaatttagaaactgaacaatgactttaagacattctccatcacattaaaaatgtttctaccacactataacaggagaaaaatacctttttaaaaatttgatcaggtatccatcgtatcagaataatgacatctgcccaattaaccaaataaaccctgtccacattgctatcccactagagatctcagaattacaacattcataattatctgcgtttatgtagtgcattttacttctcaaacagcttccatggttactattttgttaatgatactatcattcctaatactttctattccatgcctttgggtaaatgaaataaaaacaattatcccaacaaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctcaatgatccatgttttactcattctagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggtatgtttggtagtctttcatcttcatggcaataggattacagagaaagctgcttagattagaatgggaacgaaaaaacatctactttcaatggaaagctgaaatagtactttaagaaagttaactgaattgaaactgcttgatataaaagagtaaactttgcagatgtaaaatataacataacttcagatcatgccaaatacagaaaaatataaagacatttttgtagaagttgtagtataaattgtaagttatttgagtataaagtaacatatctttttttctcaggattaaatatacataatttgatgcagacaattataatctgattattgtaatatttacttattgcaatgaatctaattattaaaattttcaaattaaacaagtgaaaaatttcagaatactgtataaaattaaatagaatattgtaatagtttaaggttttgcatatattgggttaaatatttctgaaaagcaaaattatttcaagttttcaaatatcttgacatggaacactgcctttgctaggagtcatttctagaaattacttaaaataggagacaagcatcaatcatagggatttcagctttagaactattggaacaaatctaggttagacaaccagcttatattattaagcaagattacatataataatcatctttttttaaaggagagacttttgcaaatattatacagcaatcaaaaggtcttagcttagtgtatcatccttattagaaaccaagatgttgcattttatttcagtgctttctgtagtcatagctaactcttttacctcagcaatttcaatcaaaaagcttctctatcattctatacataaaatgcagacacattagcagtcaacattatgaatgcctttacaggtaaacaaacaaaatcactttattactggattttataaccaattcccattcttttttgtgactattcaggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattctcctgttttttgtcacttttcaaagatttaaaaaatgcacgtctacattaaggaactccagtaatcttgaaaaagtatattgaattctaactctatagattaataatgcaataatttttaagaatataaaataatataacatatattcagagtagagataatgctcaatgaggaatcctgcagatttttagatcatatttgcaggaacccctgtgggacatactggacactgagggcattctgtttgaaagggtcaatccttggaaatggtaacacagtaaatcaaggtattcccaaactgggaataataagggaggaagatgttgatagtttatcagaaagtaattgtaatacgggtctattgaaatatattaatattaagaaaaattgacaagtaccacatgatctcacttctatgtggaatctaaaagagttgaattcattgatgaagaatagaatggtggtttccaagggcagaaggtggggtggggttgggagattttagtctatggatacaaaattgcagtaagatagaagttataagctcaagagatctattgtgaaacgtggtgaccacagtcaataacaatgtattatatttttgaaaattgcgaagagagtaagtattctcaccacaagaaatgatgagaacctgagatactgcatatatatgcatatgtatctctgtcttcctacatatacatatatatacacatacatatatgtatacacacacacacaaatatatatatatatatatatatatatatatatatatgtatagagagagagagacagaactcaaatcaatagtatgaattaataaattagatacttggagttttattttagaccaagaaagatatctggaacacaatgttctgcctcctgtatttgtaacttaatgtatcacagagagtagttcatttcattatatatagctctaacttattgtgtgttattgatcccaatactcagtttaatgaacacacgagttaaaattacttgtttgcctatttgtttatttatttgctaccaagtatctaaagccctatctcattgcagggaagttacagttagatgagtcttggttgaggttagaggccatagacagttgctttcctaacctgtcttgagttagggtgtaggcaagtggccatgtgacctgagcttggcaaatcagagacacacacctgaaggtctcaatctggggataattgtattcacttcatattactgctgtagcaagttaccataaatttagtgacttaaaaccacacagatttcttgtcttacacttctgaacatcaaaagtctaaactgagtcttactggactcaaatgcaagtgtcaaacaaggttgtcttcctttctagagacactagggagaaactgtgtgttcccttttccagcttctagaggctgcccagcttccttggttcatgagccagttccaacatcaaagccagaaatatttggtcaagtctttctcacgttgtctcattctgacattggctcttctgtcttcctatttcacttttaaggaaccaaatgattgcactgggcccaaatggatactccaagctactctccccatttcaaggtcagttggtaagcaaccttaatgcctgctgcaaccttaattgctccttgccttgccaaaaaatgtaatatatttactggctctggggattagggtatgaacatatttgagggagcattattccacctaccaacaatagtgatgcaaagaagtaaaaagaattaaaaatccagtttggtggtgatcacagctatagttggggcagcaaccgccagatatcaaaagaagcatggccaacagtgccagaaatggcatccagtgtcttgtgtttatgatggctttgccaggttgcttttagggtatgattttgaagatggctctgaatgtcagcattcacttcattttttgttgattttatgcacctggattctatagctttctctgaattcctctgaatttcagataaaaatccataaattacatttttacttcagtgagctaaagttggtttagattgtttacaactaagcctgactaggccagcaattggtaacagcagggctggcaggaagcagaaatgcaagcaaatggaaagactctgagatcaaatgtttgtactagttaggggtaaaaatagaaaatccagcttgtatccgggaatgagaatttggaagtccatggaaataggattaatcatttatgattacattgagtgatttgcactttaaagacaaggcttaaggagataagtggcctctactacacaacagtatgtttgaatttcatgagaaattgcaggactgcatgtgaatgtggctgctgtgaatggtgatgaacagaaagagaatgacaagttcaaatccctaacttcttgatttaagacacagaagaaaatctatgccctttccctgactatgctaaaataaaagcatactatctttctggaaaaaaagaaaaaaaattcatatttttgccaaaggtttgagatactaaaaaccaaatacaaatcttaattctgcagatcaccagacttcaacataaatctaaatggattttccaattctctatttgattctctataattgggaaacagcaagaccctggaaatttaaatggggtttatggaagaattctctttaaacattccagtttcacattaagtttctttagacatctgaaatgggatctgcattccttgcctggtaattgttcccccattctgaaaatgcaagctgactacaagaaaaagccaattctcttcagacctcattctcaccactgcttattgtctccagatttgtaactgaagtcagatcccagaatgcctcagggggtagcaatttaaaggtcaatctcaggaggaggtttacacataaaaagaatggaaggatttaactaatttatattgtttaaaatctgagaaacgtgtgtaggagtggattttgagatactagacaaaaaagaacagtgaaatttggataaaatgtatcaatatatgaatgtaacaaagagttataggaacattataattattaacatggttgaactgaactcaggcctcagaggttgcccaaactgaatgaatttgagacattacaaactttctgacaggtggagaatgtaattcagaaacttaagaagatagaaatattggaatgaatttatcatatgtgatacaaccattcaccttctgagtatattctcaaggtggaccagtacggttttgagaaacacgtggtggcctgcatgccggcacctttgaataatctccttgtgtgtctgtagtctgaagaaggaagtagaaaaaaatctagctgaaataggcttcttgattcaatggagatgacaggatccgagcttgcagaggacaaagggcaactctagactgccggaaacaaagtgagaatgatattgtacaagatagcaggactgtcatggtagaaaaaataaaatggcataattcagaagtaatgttgtcggtggctgattgataatgagaatgatgagatgtctgggacagtcacatttatgtcttttataaacaataatgacaaatatatttagttcaggtaaaagagacctcagatcagcaaccacacaggcctcaagactttcttcaattcccagactataagatggttaataaacctagtctccttaaaggaagcataagttcagtgctttggaggaaatctcctgcaatagaatcacaactgataagcacttaccatgggccaagcattgttctagtcactttaaacttattaatttgtgtattactcacttgtggcatctcatctatttccataatgctagtcatcaattaaattaaagataattcacaaattgacttctggctttgtggaactaaagacccatatattctatggactaattgaaattcccatcaaagttttgaatatctgtaatgtagcaagtaatataaagcttttaaagagatcattccaggaagagagaagagcaatagcatgaggagaggaatgttctggatgtgtccaaggaaaaacaaagtgaatatggttgtgacaaaatcagtatctgggggaggagtacaagagaaagccataggaaaagaggagacaaatcatgtggagacctataagaagggtgaccataggtgcagctttgccttggaaagtaatagtttatgcctatgttcccaatgtctaataagatttagtattgtagaactcagaaatatcctgatcggatgacattatatggtcaccctaattttatctggccactgaggatattggctgttgcctcagttagatgagaagccactgtgataatggatgacacaatctggcttgcagttttagagtatttctgtgactgctgtttagagacgactgactgtgtgttaagagcagaaaccatgagaacagtcatgagtccattgcaatagtctaagccaaggatgacagtcgtctccaccagggtggtaatagtagaagagatgaaaagtagtcatgttctggatacattttgaatacagagccaacaggaactgctgacaatttggatgtatggtttaagagaaagagagatatcaagcatgaatccaaggcttttggtccaagtagctggaagaatagagttgcagctaagatggggaagactaaggtaaaaaatttgaggaactcagtactttgaagctgggcatgttacattttggatgcttatcgctcttttaagcagacttgctggaaatcagaggagaggtccaggctagagaaataaatttaagagtttcagcgtatggcttttacatcctcagaaatagaagagatcaggccaggcatggtggcttatgcctgtaattccagcactttgggaggccaaggtgagaggatcacctgaggccaggagttcgagaccagcctgaccaacatggtgaaacctcgtttctactaaaaatacaaaaaattagccacagtggcacgcgcctgtaatctcagccacttgggaggctgaggcaagagaatcacttgaacccaagaggtggagtttgcagtgagccgggatcatgccattgcatccagcttgggcaacaagagcaaaattacgcctcaaaaaaaaaaaaaaaggaagaaaagtagagaagatcatgaaataatagagtgtagaaagaagaaaatatgaatgcctgggatactttaatattcacaaattggagaactgaagaggaagcaacaaaggagagagagaaagaatgaaaggaaaccatgaaagtgtagtgacttaggtgccaggtgaaaaagtttaaatttcagaattgtggcattaagggaagaaatgaatttagagtcaatgtattccaagaccactaattatagatttttaaaagcaaggtcaattgcggttatatgagtttttctgtctataaatggcagatagtgatgcaatgcaatcctttatatcatagttacgttatctcgttattatctctttcatgatggaggattaaatacaactttcttcaccctcaaactgacattttaacaaagattattttacttccttgactaaaataaaatgtattttataaagattgaggatgaagttaatgcagccattataacataattagaacatgcaggaaactaagaagaaaaatagagtatacgtgttccagatcagtggctatttccttcaagtcttctaagcatattctaacataattgggataatactatttatgcaatattgtatgctgcttattttacttaacataatattactttatccataaaaatgtatttttaaatttttggtcaaattaggagaaatatagaggaaactgttcttacaggatgatggctccaaagttagaaatcacatcaaagggaactttcttttatctagtgtatactaaaatcctatttttctgggttctgtcttagaggaatatgcctatttttaaaagtgagtctgaaactatgaaaaaatattttcttttcatacataattcttcactgagtcataactcactaagctagcttgatacagtattggtgaaaacattctgtacaacacagcatacttgaaagatctccccaaatctccatattctctagtctgccccattgaaggttttcagaaatcttgcaaataatcacttgttgagtcaatgccataaacaaaaagactatcatctatggctaacattttttattaaacaagtttttatctgatattttgctcatcctttttcttttcattgctttaatcttcctgaaaaacatctttacctttaaaactcctgaatgttttcactaaaatgcattgaattactttgcatttttggacaatatctgctatgatatttattaacagaaatcaggttgccctttgaggtccataaaatttagaaataggagttatgatatttcacgccagtttagtgattttgtgggatatactttccattatctttaaaatgagataccccataatggagtaggaaaagaagcaaaagttaagctctgtctttggttgagttccctgaaaacagactgtaaggcagctaatgatgagcagaagatttactggggagtcatcttgggagatacatctgtaaggaaatgagaaacgtaggtttagacagagggggaagctgaccccatgcaattgatggaggtttcaggggactctgcaggaaactctggaactgaggtggcccttcagagttgctataattcacagtaagagggatgggtctttttattcctgaatcagacagtcattgactgtgggctgaaatttggaaggggtggaggttacatttgtaaagcagtcttcgtgactgagggcaattctatgtgagagacactgctgtgaactctcagtaacaactattttcagtggctgctatcagctgctatcaatgttttggctttgaaaagggcatacatgtggattaccaaattataagctcctcctatatgttcagtactcttctaaacactatagggaaatatatcacatgattgtccgtctttaggtgtgtgttgtctagggtagataggttgaacccaaatgaagttgcacaaaagcattcaagacaagcaattaagtgctaaattgtgctgagctaactataagagataaagatagtagatgagaaaaataattggtcaatgatgattatattttcaggactgtcttctttaaaaagataaaatgtattgtacaataaaaaagagtgttatttgagtaaacattggagaaaaggaaaaccactttggactaataaacaaaagaagagaacaaatagaagaatgattatcctatgtccatagcacagtgaagaacccaggctacctaaatccattcattttaattcagccacagtattgagcaattactaaatgcaaggctcagaaccaagtgcccaagattattcaaggagaaaaagagatcatgaaatttagtaaaagtacgatgacacaagcatgtcacaagacttaacataataatttgaattagagaaatacaaggtactagtgatggcagcagctgtagccatcatgcaggctgcagcaaggaggcacagggaggcacagctggggctgcacactccatggagctggtgggaaccctgacccttctgagttggtgcaggagctccccaggtgccactgcagctgcccaaactgcagctgcagacccaggtctcccactctgtggagcaggcaggagccctgccctcctgggtgggagtatagtcaccaaagctgtggctgtggatctgagcctccctgtgctcttcgagggggcatgagcttctcaggtgcagctgcagctgccctcccaggcccaggacctggacatctctgtagcctgcatacttgaggtcccgggaagttccccatcgctcatccccgtaggcttgagggtatctgctctggctgcttggcctctgtcctctgctgccgcagctctgatctcaccccgggttgcagctgagccctggggtcatgaataacagtgggacacagagtcctgggcagaagttggtgggtccctggtaaggccccaccttcaggctagagagggcctaaaggttacgggccaggctgcctgtcccatggaccagagtggggacttgtggtgcctctcccaggccacccatggccatccatgaccaatcggcaggcacttcctcccctgtgaggtccataaaagccctgggctcagccagagcagggcacaggatggagaggacagagagaaaacaggacaaccaactgcagagaggaactacccccctctgctgagaacttcagagacctgcagagacgtctgaatgatctgcagagagaagctaccctctccagggcttcttctctgcagagaactgaacactccacagatgacttgcctgcggagagaagttacccaccgtgggtctcatctgagctgctgtaatgctcaataaagctcatcttcgtcttgttcacacttcacttgtctgtgtacctcgttcttcctggatgcacaacaagaactcaggccgaggcaccatggccacaggggtttccagccagaaaattgacaccccgaagatcccgtaacatgagaatggcacaaggaatgaacagtcatgtccacttggaggctctcaagacaggctacatgaagcagatgacatgtgggaccaactttaaataatataatgtttttcaggtagcaagagaaaggaagaccacagaaaatactgtaaggaaagaggtgcagagttgggaggcatacttggcaatttaaattatcccagtttcagagggagcatgggtgtcaagcagtggtgttgtgagagacgaggctggaaatacagtctagacatgaggccttagaatagcaaggtgatgactttttattttgtctgcttctcaatctagagtcataaaaaggtattaaatattgaaaggctgttgcttgaggagagcacaaaatcaagggaaacatggggagccatggccagatttacaggcaatgaagagatacccattgtgggaagaaggaggcagattggatctccattttaggaaagatgaggatgagacaaaacaattttagcagggaatcagaacaccttttcttcaaagactagactgaagaaagagtcacagagtgtagacatacttgctgggaaaattaggttaaggagggaaatggggtcaggctgaaggagaatatcaatagtcaggcaagagacgtttccatttaataaggactgagtggaaatttacacaacctcaggcttactcgcagctttctacgtggcagttaaacgtggcagtgattcatttggaagggtggttgaacatgataaaatgtgtgactgattggagaatactaggtcagaggcagctaagtctatttggaaattatccttctgcagatggtggatgaaatcatctggctccaagatgaaatcatcagggagcaaaacttccaaaggaaaggggaaaagaacagcatggtgtgtacgtggtgagaaggaggatgtggaggaaacgtcaccaagggtctgattcgggatactgtagcttttaatcgtttttgaaaaggaggattcaattttgagggctcaggttgtgattaattcagggctatgaggagagagaggaaactgaacagaaggagggcttcattagtgctattgataaaaatgctttgggactgattttcaaattttgtcttgaatttaaaccacctggagactgtcctcagcagagtcagcaaaagcacagctttgaaagaggcgatcactttctgtaagaacccaacaaagcacagcattatgcaaggaaacgtcaaatgtctctgggaggggcttgtactttagcttcctttgagtctttagggctacaattctgactacagatgttttcaatttatgttgtttttttttttttctcattaaattggctaacaattgtgatcattctgtatctccagccgcctttcattataggatctctcataacagtttcaactgctgggaaaattgttcacattaccagtacagttctacctttctctatttattaccacttgaatctgcatttgtacttcacatatatgcagacaaattttctgccatatcaatggcatttaaccataactgcttatatgcatatgcttttggtatgcactctttaaaatgaggtgaatcatattctttgattaaaattaaatgcatctgtgaggtgaaggcaggaagatcacttgaggccaggagtttgagatcagcctggccaacatggtgaaaccctgtctctactaaaaatacaaaaattagctgggcatggtggtgcacacctgtaatcccagctactcaggaggctgacacaggagacttacttgaacccaggacccagaggtggcagtgaggcaagatcacaccactgctgtttaacctgggcaacagagcaagactctgtctcaaaagaagatatacaaatgaccgagaaacataggaaaaaatgctcaccatcactaatgattaaagaaatgcaaatcaaaaccacaatgcaataccatctaactcatgcaagaaatggccataatcaaaaaatcaaaaaataatagatgttggcgtggacatgatcaggaacacttctacactgctggagggaatgtaaactagtacaaccactggtggaatacagtgtggagattccttaaaggactaaaagtagaattaccatttgattcaccaatcccactacttggtatctacctagaggaaaagaagtcattacaccaaatagatacttacatgcgcatgtttatagtggcacaatttgcaattacaaaaatgtggaaacaacccaaatgcccatcaatcaacacagtttctttattcactcgttgatatatatatatatatatatatatatatatatatatatatatatgagatatatatatgatggaatactactcagctataaaaaggaatgaattaatggcattcacagcaatgtggatgagttggagactattattctaagagaagtaactcatgaatggaaaaccacacattgtatgttcttactcataagtgagagctaagctatgaggatgcaaaggcatagcaatgacacagtggacgttggggaatcgggggaaagagtggaaagggagtgagctataaaagactacaaattgggtgcagtgtatactgctcgggtgctgggtgcaccaaaatctcagcaatcaccactaaagaagttactcatgtaactaaacaccatctgttccccaataacctatggaaatacaaaatttaaaaaaaaaagaaaaagaaaatcaaaataaatgcaatcttcagggcattttttatcctgtaagatagtcacatatgaacgaaatatcatttgaggtttttgttgatagcatcaaaataaaatccagcagagaattatgagcaaatttttataggattttgctaaatttttacagttttatctctagagctccttattatgtctcactaatgcttttgtctagttcaattttcaaatagaattttcattttctttcatatttcattctgttggttttattgagtttagtcattaaagtataaaaatgagaataagagatgcattatagcattagacatggcttcaagctctcttttctgacttcacagttacctctaacatccgaggtttagaattctatgactaaaaagtaatattcctataatatatattcctccttcactcttttcctcttgaacatcagcattctccagtcgtctgttccgggctcactagtctccacttttgtgaatgattgcactcacactgaaatctcaaacaattactggatgtgatggctcatctatccttatgtataaccctgtctatctcaagctagatgccccatggacatagaacacatgtcctcaaggctgccccctttgctagtccccatctcagtacatgccagcaccttccttccagctacctaagccagaaatttggaaataatcttaaaatcttggttcctcatcctcactctttcatcagattgcgttgatgctttttcttaaatatctctcaaatcatctctctccatgtgcagtgacatgaactgctctttcctgctttttttatacattgttcgactaatctttctcttttcagtcttactcacattaaaaattcttccttcagtattgctgccaaggtgatctttctaacatgcaaatcacaacgtgtcttacttgccaaaacacttcaatattttgcagtgaaacttctattggtattttgggtggttcagattttgttctaagggattggcctacatacaagaatttcaacatcctgggctcatctacaaaatgcctaaaatattccccaatctttattacaaccactaacacccccctcacacatttccaagggtactctagagggtatggttacacacccagctaagaaccacagatactttccttaaaacaccttcaaaataattttcaatctctttatttctacacacaagtccctttatgaaacctcaacctgcttctctaacttcatctcccactaaccccttgtgtgcaatctattacagaaactgcccactaggggctccccaggcaagaccatgacttttaggaactccatgccttgatctatgttgttctttgtgtcttaccttccctcactgctcaagacgctgtctttaaccctcaagacactgtctttctttaaccctcaagactcattaagaaagagtgtattccagctactcttccttgcttcctctcctctccaaattccagcctagcttgaatttggctaggtcccatgcttcccatgtacaaacctaattaacattagttatcaccatgtatttattcagcttagttggtatgttggtctgttttacccactaaatagtataaacagcatataaagcatggagtgatttcctgtaccatgtgctgggtaataattttacattccaaagcaaaaataccagtatctgacatgaaatccacatgaaaagcatgtacccacaatagattcttagtctgtagtgtaaataatctggcaccattgtgaaattgtttttgtcatgttaatttttaagttctattctcttatatttattatatttacatttctggagctgttttgtcttttgttgttttttgttttacaaataatgttttaagttacttgtcatcaggtaaaatcaacagcccagaggacatcctagtgtgtactactctatcctcaacctctggctcacttttgggcctactaccttctcacatttatgggaactgtgaataaaccaattagagaaaatgactttaactattctttccactttccaggggaaaaaacagggggaaaaagtgtatgtgactgtttttctgcatcttctttgacacttaatagtatcaggtattttaatgtttgtccaattctgatagaattcaatatcttattgtttctgttgcatttttatttctaatgatattaaatatcttccacatttatcagtttttatattgtggcttttgtaaattacctgtataggactatgcatattttggaggtttttacagaaactgtattaaaccatttctgtaatatatattacataaattttcccaatttgaacatgctttgaagcatactactgacagttttataatatagttttctttttttttatggtaggatctcactgtcttgccagggctagccttgaactcctggactcaagtgatcctcccacctcagactactgaacagctgggacaacaagtgattagcattgtgcctggttataatacagatttaagatgtattatagaatctgatctttcatcattttattatttatatatttttttcatttccattccaggattattcaactactcaataatttttatgcaaacatatttagaggttttaaaaactgaacaacctgctcctgaatgactactgggtgcataacgaaatgaaggcagaaataaagatgttctttgaaaccaacgagaacaaagacacaacataccagaatctctgggacgcattcaaagcagtgtgtagagggaaatttataccactaaatgcccacaagagaaagcaggaaagatccaaaattgacaccctaacatcacaattaaaagaactagaaaagcaagagcaaacacgttcaaaagctagcagaaggcaagaaataactaaaatcagagcagaactcaaggaaatagagacacaaaaaacccttcaaaaaattaatgagtccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctcttaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtagtccagcatataaacagagccaaagacaaaaaccacatgattatctcaatagatgcagaaaaaacctttgacaaaactcaacaacccttcatgctaaaaactctccataaattaggtattgatgggacgtatttcaaaataataagagctatctatgacaaacccacagccaatatcatactgaatgggcaaaaactggaagcattccctttgaaaactggcacaagacagggatgccctctctcaccacacctattcaacatagtgttggaagttctggccagggcaattaggcaggagaaggaaataaggggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccatcaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactgtctgatctttgacaaacctgagaaaagcaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcatcatcactgccatcagagaaatgcaaatcaaaaccactatgagataccatctcacaccagttagaatggcaatcattaaaaagtcaggaaacaacaggtgctggagaggatgtggagaaataggaacactttaacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaataaaaaaaaaaataaaaataaaaattaaattagttcatttgggaactgttttggtataagaattaaagaaagaaacatgctttcaaatgataaatagttataaatttactttaatagcatttactggaaaaatgggaatttttttctatattaattataatacaggtacatagattcatttctaaatattttttgttccctatgactggtagctttttattatttttaaatatttacttgggccagggcccacctttattcaccacttctgttttggaggggattttctaatcacttttctagcaaattttttattccaatgagctttagaatagttttgtcaagttttctgtttttatgatcttatagggattttcagtgggagtatttattaatttaggaaaaaaattacatttttcaaatattgagcttccctatgttaaggtaggtttagccctaattttaatttacatgtctcagtcaagtgttatggattttttcaatcacgttctgtaaatttcttgtcacgtttaggtatacgttgtatgttgctattgttactggataataatcccttcttcaattgtgtttctgtccagtagtactaatagaaacagtaacataatataatggtaataatgatgtatgcttcacactagtacagaaatcaagtatgattactctctgaatgtatttttccagttacacatagtatacaatttttcatcattcaatgaatgtatgttgagcatgcacaaatactaagaaaatttttagatcctgtgtaaacaatccatgcctttgtaacaaatacaattaatagaaaagactgacacctaccaaataatcacaccctttataaaacattctaatttgtgctataaatataaatatttataagaagaaatacagcgtgccaagaaaatttaacagggactatcttacctgagttgtggtgaggagtgaggagcctagtaaagattttgtgaggatgaggcattgagaagagttctgaaaggtaaatacaagtaaactgggcaaagagaatacacatacaaatggttttcagcaggacagggaatctagaagcttttagaaaatggacaaaatcccatgtgagtggagcacagagtaacggagatagtggtgtaaggaagcctgggaagaaggcaggagtcaggtcatgccagtacctcatagtttgaagatttttgtctttatcctagaagttaccactgaagctttttataataagatgagtgcgtgtgtgttgtgttagctagggtggcgggggggagtgggaggtgacatattcagatttttatttcaaattgatttctctggctgtagtgagaagaatggatcagaagagggaaagagtgcatgcctgaaaacctgtcagaggctattgaaaaagctcaggcgagacataatattcatgtggacaaggataacggcagtggagatcaagagaaggatatgaccttagggaatatttagggggcagaattagaaatatttaagaaggacagtactctggcatggtctgagagagagagagagaggtgacaaaaatgactctcgggtttctggcctgcctaaatggatggataatgacgctgctgtctttttttaaatttctgttaattttgagaattttcatttgtattttttaaataaatcaacaataaatgtatgccaccatcctccccaaatgtagattatttcactttttatagtgtagaatttgaggtgtctatgggacatgaaagtaaagaaatccactgacaggtctaatatataggcaagaaatttgagagctttggaatggtctgggcaggcttttattggtagcattcccaaaatccaaataagaactgttatttctatagttggaaattgttagtgtttgtgacttaatagtattaccacatatttctgattcatctatatgaacttatataatcttatagtttggacttggaagtcaaacaaaactcacacatgtatttaggcatataaatactcaaatttaagatatacaggtcaaaatataaccagtttaggggaaaatgatgttgtaaactaaatattgagaatgaaactgaaaacaattaggctaaattcatatgtgatacactttgagacatatgttttattattacagtttattcagtcatgaaaaatctattgcttgccctttttatcaataatactactctgacatttttaagggcagaggcagtgataattggtgtcatgttgcctttgtgggtaatgttgtagatagattttcatttataagccagtacatacatgatagaaggtatccgttgtatcttttaaacaaatggcaaacaaagtataccaccacatctccttttcactattggaaatgaaatagatctaatatggtcaaaggaatttcacaaaacaaaaaccactgacatgacaaaagcgtgcatttaatttgatgctttgcagagatacatgaccaaagttgtatgcatggcttgtcttttgggatggtcccagctgtttattttaaaagaaaaaaattaaaatagagccaacaaatgcaattaagaaaaaaaaagtattgagacacaaggggacctacatgttctggtctaagaagcatgcaagtattacaaagcattccagatacagtatgacagaggaacagtgaacaagcattggaacgatgctctttctttcagaaacgggaagtctaacagttatgttttcacaatggtagtgattaaaccatctttatttttaaggaattttataggaagaattttagcaccatcattaaaggaaaaataataatacctttttagccctgcctatctccagtcttggaataataacagaagcatagcacctttcagtatctaaaatataaacaagaatagtaagtccatcccagcttctagagatgaggtagctcatgctaagaaatgttgggtcatttttcctatgaaagttcaaaggccaaatggtctaattccaatcatcacatttgattagagtcagctccacaactcagtttctagatctttttcttcattataggcttcaggatgatgagattgtacatgtggaagagtctcaatttagagtccttggacatatgtttgtaaagttctatatgtcaattattttgcattcaatatcttcttaaataagaaagtgtaaatgtattaaatggtatatactagtgtgacttctatcaatattgatagattgatcaagaggagaaagatatctttaaatttgaatgagaaagatgtctaaacttatagtcttttacaaaaatttaagaagtcgaagtaaattcactttgttctccaaaatgccactgaatatatactatttaaaaattctatttaagacagtgagaaacgtttttttttttttaagattctccttaaagagtctctattatagttacacaatatcaagacatgcatgtaggtctcgatcacaagttaaacattttaaactcatttttaattgacaatcttggaatgagaggtcacaaaagggcactaatttctatttttcaactgcagccaagcaaaataaacatgtgttgtggctctatataccccactctttaagctacctgccaggaagaagaatttcctcataaatactaagcaactttttcattacactgaaataaattgaagaaaacggagatttatttattcaatcagtttactttctgcaaaggtggtcattgtcattggtcatcttaaacctaaactgttgtattgaaaaatatttaaaatcaattaaaacttgaggattgtaagtaaaataaatattctgaaggataaggaggccaggcacttaagaccatatatacaatgctgatgcaggatcagccattacttcaagagtctcaggatcaacttcaaacagtcaaagttcttgtgaatggcggtggtcattgatggtggtgctcattgtcgatgtgtcttggcttactttacacaaaacaaactggcccaatttcaacgccgaattcctggtctgtgccgccaacatccacaggagcaagatctatgatgggcaagcgtgccacattctgtgttctatattcaaagacagtcttgcccacatttccattccgcttctgaaattaaatgatgcaatgggttaaatgtacatacaattttttccaagtatgttagacagcaaccttcccagacacttttataatgtaaaggcaatgatttttagagtactacttaaaaaaaaggaatgaaaacataaagtgaaatattagtgtacttatgtaacagaatttctttcatgctttaagtaaatttcctttgttcttctgcagcttcccaaatggtcactagcaacataaattatgaaagcttttttgtttttcacaaatgaaactataattcaccatttagtattattttcgttttatatctcaatatgcaagcggggagacttacttacaaattggtggaaaaaataaagtatcttggattaattacgcattttagaaataaggaattttaagcatgggactgagattcagtaagttaaataacttggaaaagaaccaaagaaagtctgcagaagaactggatcagatcttagggatccagttctttctttactatatggattcaaacctctatcatgcttcatgtgctaacacacacacatttaccctaaggaatgactataaacaaactgctattatgctcatatacaaggtaaaattgcccccagttctagtgctgtaatagtatttttaacaaaaataattttttttcctcaaccagatcaatgtagatcaaaaagtacttacagagcaagtgtcttgaagaacgatataccggaatctaatatttccctctgctttgatatctaagtcatttgcccctttgagaaccacagcttttttgaggttcttagcttgatcgtccatgtatcctacactgtttttacagatgtaagtgatgttctgggaggcttcttttgataaaaggcgcaaaaaagtcatctgagtaatggctgtattaggtgattggtggtctccataagcgaactagaaaaacaaagagtctttgtcatacacaagactgaagggtttcataatgccttacacatgtatagataaatatataaattgatttcagataaatcaattttgaagagtattactttaattcttgtcataaagtaagctattctagctgtacatctaaacatatcttaaaatgtctatgaatactcaaaagaacctctgtccttattaacccaaagggtaatgaaaccaataataacaataattcacgagaacaagcataagtatttttaaatctgcttcactcatgtatcaaaaataactcatttttattgctaattataataaaaattagaattaactagtagtataaaatcttttgaccccaactattacacaattgtaggaaatacatattaaaagttttccatgtgctaacaaaaataatcaaaaaaatttttctagagactctttcctactcaccttctactttagctttggtttcagcactcccatttgggggttttattttacatattatattagctaaattatatttcaactatttatatttaaaatttaaaattttgtgctcattaaataatgacagatactagcttatcttgtatacacccataatgttctcataatgtttattctgaacgtgatttctaggaaaaggtcagaagcagaagtgagaagaaaatttcaattaggctgccataaagagatgcagaatgaaatattcacattgcaacaggcagtggaaaggccagacagttgtctgaacaccagaccatgatagaaacagggtagactgggactcagaaaaatatcaattgacttcataacattacaaaaatgccttaagtttaaataatattaaaaattttacaaaatgattcaattatttagacattattatagtagttatctaatattaatttaccatctatcccatagtacaagagaccctaaactaagaattttatatccacatggaaactatggaataaatattatcacccttactttaaactggcaaaactgagtctccaaaaagttcagagactttataaggccccaaagtcagtacaagatccccgtgaggtaaccaggtctgctgaagctgaatatacagaaataactgtttatcaactatggcactatagtttatcacttctggtacactccatagtccatgtcacatacattagaggaacttacagtaaaaataattacttttctatatttcatccatgagaaaatttttaattcaaaatttatgttaacttcactcatagcaaaaccttgtttatgcaatggtattacaattgtaactaatgagactatatcacttcaaaataaacatggtaaaataagcctggtttaaaaaaatagcaaagtcctaaataaatcaaaaatatgtaataagtagtaaaaagtaaagaatacaattttaagtaaacatattaaattacctgagaccctctgttcatatcaagaccataccaaacaggtttattgtcaggagatttactggcccaccaggttttacgtggtacactggatgggtttgctgaaatacatgtttctcctgtttccatgttgcagtaaactttgattgcatcttcaacagatccttggttaggatcaatccagtattcacctatttttcaaaatagaaattttactaaataaagacaatctcaatcatgactataagtctccaaaagaattaacagagggtttgaaaatatacactcactgattaaggattcttttaagtgagagtgccccttacgaaaaaagtaaccggtatgcattgggggcctttctacattctagtcgctattgtaaggcactttgccaaaccatgtacttaaggctcaaaacatccatatgaaggaaatatcattacccccattttatagatgagaaaaccataccgaaaagagaaaatctatagtaagcggctttaccaaaatagatgtgtttccaatattttaaagcaaattagaatgagtgtaacaaaataatgtaaataatgtaataaaataatgtaacatcaaaactatgagtaaagtgaataaataagttgaattacaattagaatgctatgaatcatttcattagatctttttaaaattactcttctcatatataagagactcttaaaataggaaataccaaggcagtgcctggtggtaggcatacagtcaaatacacaatttaatatgcatttgcatacatgggtgtgtgtatacatatatttgtgtgtatattatataaatagtatgtgagaattgcattttaaatgaaagtgtcggaatgtaatgtatagagttaataaaattgccctttcttcaatgataataattttagctattcctgtcaatgtcatttcaaagttaacttaaattcttaggctctttgtagctcatttgtctcctgtgacttaggatccctcttctctaggtcatattggattaattaaaatgacagaataaggtaaactttaagcctggtacatgcaactagggcagaacaactatttgattccaaaatgtcttggaacctcataataatataatcctgccagcagagattccaaaagtatgactcatagaacattaaactacatgaaaggaattacatatttaaatgtgggaaatatatgcttgatgatccagcaatatgttaacattaagacacttataggtcatgcaagtaaataaatattttgaacaatacttaagcaagcattttccacatttccacgaaatgcttttattccacaaaaatatcaatattttaagatttctggatgaaaatggaactaccatcatgaaactggattattaataggatatatcatctattatagtacattttttttaaagttaacatttattttaaatacaaggggtacctgtgcagatttgttacatggggatattgtatgatgctgaggtttggggtacagatcctgtcacccaggtagtgagcatagtatccaataggtaatttctcaacccttgctcccatccacaccctcccccctgtagtagcctgcagtgtttatggtttcatatttatgtccatgtgtgctcattagctcttacttataaatgagaacatatgatatttggttttctgttcctgtattaatttgcttaggattatggtttcccgctgcatccatgttgctgcaaaggacatgatttcattcttttttatggccacataatgttccatcatatatatgtaccacattttctttatccaatctaccattgatgggcatctgggtcaatttcatgtctttgctactgtgaatagcacagtgatgaatacatgaattcatgggtctttttggtagaacgatttattttcctttgggatataccaaatcacaggattgctgggtcaaatggtagctctgctttaagttctttgagaaatctccagctgctttccacagtggctgaactaatttacattcccaccaataagtgtataagcattcccttttctccaaagccttgtcagtatctgttttgtgacttttttatttttttgagacacagtctcgctctgtcgcccaggcagtggcgcgatctcaactcactgcaagctccggctcctgggttcatgccactctcctgcctcagcctcccgagtagctggaactacaggcacccgccaccacgcctgactaattttctgtatttttagtagagacggggtttcaccatgttagccaggatggtcttgatctcctgacctcatgattagcccacctcggcctcccaaagtgctgggattacaggcgtgagacaccgcacctggcctgttttgtgactttttaatgacagccatactgactcgtgtgagatggtatctcactatggctttgattttcatttctctaataattagtgatgctgagcatttttttcatgttttcacaaaattgactgtttccaccattaaattataagctccatgatatgtttactatttttatctcaaatctatcactaagtagaaagtcagtaacatattttggaatgcagttgagaataaacaatcagaaacaacgggttttgctcaaatgggctgctgtctactcaccactctgctttgcggaatggcaaagctttaggtcatcacacgtgcgggctgggtgctttttcgagccatcggggctgcgcatggtttcaatctgactactgagtgacttcagggtagcatgaacccctgggtccgttttgtttttgtcatcaggagccgcctgatcttcagtaaactcaggaagtggatctggcatgctttcatcatagtgccccatgatatccccaagagcagctgtaaggtggccagggggacccggagggccaggtgggccaggctcaccaggagggccctaattaaaaagagattggaaagacatttaacacattgtttttgttttacttaactggtagaacttggttcatagggagttccaatgagacactccaatttgacagtaaagggagatctatgactcgcgcccttttgtaactagatgggggtggtctaacaggctgtaacattcaaggatgagaaatgatgctcaatcatttttcaggaaacatatcttcaagtcagcatccaagataaataaagatcaaagcacaaaatatttgctcaggtgtttaccttgaagatacaacatattttatgttaatagcatgcagatatgtatgttcatttgcaaactattttcgtcaaggtacaaccaaaatgttttaaaattatttttggatgaagctgaacaaagcatgcaggggaatagtggctgctggttctataagattacatgtcaataacaagaaaatacccacaggaaacacccacaagagaattatactcctacttctaaaagagagggagagaaacacaggaagtccttttatgtgcattaattcctgtacagataaaaattctctgtcctaagaaaaactgaagaaatagtattggtttttagagacagggtcttgctactatgttgcccaagttggattcaaactgctgggctcaagcaatcctcccaccttcacctcctgaatagctagaattacaggtgtgtgccaaggtgcccagtattcctagccttagcctttgaattgacataaataaagagccctcctgccttttttttttttttttgccaaataagacacactgaaatgagagggagataagcacaaaaagtggcagagactacgaaatggatcctctctattaattcccttctgcacttccccaaggaagaactcagcaacttgaaagaaccaggtgacaacctgaagagacacatagtccacatctcatgtagagagcaagatctgggagcaagaactctccagaaggctggagttctactattggctctgccacttgttatatggctccagacaagttgcttttaccttcagtgccaatgtttcctcactctcaaagggctgttacataatttttttttcttcctgtctctaaggtcatatactgagttcatgcgttcctttatactaattttaagagaaaagaaaagacttttttctaatatatcaaggcccactgaatcacaaagtcaatcaacagccacataagctgaaggtattccaattttctagctgtttcctattcacaattagagaaataaatgagtagaaaacatatctcttgtccataggaaatataagactatttgatccacataagaagtaaatatctggcttaacagtattgctatgaagggcaaaggaaaagtaaggaagagaaggtaaagaccaatgaggaagaaacaccagagagagaagcataagctcatatacaaacacgcacatgagtacacctgtgcatggaagatgtatgaagatgtttcccagacctgagaagcaaggatctaactaacatagtatacagctttgtatcatcctcaagtcaacactactgaaactttttacaaaaagttttaatcaaagtcctccctgaatgttttcaatggagaaaaacttcaatttcatactcttcattgtccagcatttctatggagttttcatgaagtaataactatacctcacagacatttaaaatattgcccttgagagcaaatcaacattttcataactttaattataaatacaattataacttgttctttgctcttgttagtatcacattatgttaatgtctgggtaggttggactctgattttatgtgctctaacttatctgtattaaaatacttgaaatagttacttatactcttgtgtgacttctacgtttgttttcggggtcccttaagtctcttgtcaatcgggctgcacagacatttcttggacggaatctgagctattgaataaatagcatttcttgcatgtaaacctttgtgactttacctcaggtcctgcttctcctacactgcctcgtacacctggaggtccaattggcccaagtggcccagggtttccttctttacctgaaggaccaactgggcctggaggaccctgcaagaaacaaagactgtagtttagattctatgaaggaaaaattttacaatgcctttctctaatcaaagaactattttacatatggagctgtaacagtgatttctaagattcattttcttactgattaataaatgaacttctggtactttgtaacatttatgatttcatcacataagaattttccatcatccatgcatggtaaaagacaaatatgagtttacatctttaatggactaatcacctacttttattggtagtaactttcattaaacctcacatattgtaaacttagaaattcaattaacttgaaataagaaaatgacagaagttggagtgtttaagtgaaatttctgtgcttatgcctcagaatgccatcatgtactattattctgaattttatgtatgctttgtttacactgtattcagatataccaagattctttaaattattttttctaattttttctacaaaatattttctattttcctaaataattatgtccaccaattgtcttatgccatcaatgacttattacaagcaacattaatactaatggagaatttctaaaagcttcaaatattggcttcattttattatttacttccaaattagctttatgtaaactacttctgaggaactatcactattacttaaaagacaaaatatatttagcttcaaaatctgtctccacttcatagtaaatgctattacatcatctcaaaaagtgaaagttgaatagaaatttaaattaacacaatgtaacaaaatgaactaacagaggaatatatccaaaccctaggtaataaattttattgcgggcccatgaggtaatatatcatatttcaagatatttctacttaaaattaattgctaaatagcttgtctcatatgtgtgttgccaacctcagagaagatgagccaactccagcttcaataccaggaaaacgatactcaagcattagcagtacatcaacaaaggcattattatttacacctgcaacttactactttttgttacttactcttgggccaaatggtccagggattccagcacttccttgttcaccatttggaccctaagtaggaatacaataaaaaatgttgccaaaatatttggatcctgcattgtgccattctcaaaaatgtgctatcattgactttagcagcatgaactactttgataaagtcaccaatctctgcaatgtctacatgagttgaccaatgttaaagacacctgtaggagtaacagtgcatatagcttttgctttatttcttccctacaaaattatagcttattattggcaattatcacttgttattcatcaagatattctttgaactgaaaataagatacaaacatatccacctattttacagacagataaatgttcgtgtcaagatacccgtgtattttcaactacagggcagaataatacttaaaggaataacttacaggagggccaggaagaccctgaagaccagtaaagcctctgtggcccttctgacctctgtcacctcggtctccatgatcacctttgtcaccacgaggtccttggggtccctagaaatagagatatggcatgaaaattacttgctacatattattgttgagactaaaatttactaaaattttactttttataattgtatttactacaattttgaacttggtattttatatggattaatatatttacttatctaaaaatagtattagacctagaaatttctgtttatttttcccaaagaatggtaggtgatcactgaaaaaagatataataagaatacttttctgaagatttattttttaaatgtttatcttacattcatactaaaattagatatttttgtttgatctagcctatctgaaatgttttttaaagattatgcttcacatatttagttgatattattatataaaaatattgctaccatatatagattcttttaaattaaaacatttcatacttgccgtgtgtaacaatgaaatgattttaaatttacatatgcaaataaactagctggctatgacagctgcaactatattaagaaattggcaaaaacttgcttgaacaaattaaacagaaatatcatctttaagccactttcctctaaagaacaaagcaactctaagttatcccatatctgcaatatctgtaaccaaatccagtgatcttgatgctaagcttgatctacggctacaaagaaagccgtagttagggatcttattttgagatagaagctatacccagagaagaggtgaaaattatctgatcaatctcagatgttttgttattgttggtggtggtgttggttttgttttgttttaagtcctgggaaattaaaaacagctccagggaacgagtggttcacagtaaactgacaagtggcatagagtcatctactatagaaccggattctgttgcttttagtgttttcccaaaagataactgaatccctatttatctgactttggaagatgactgcagtcatcaaatcaattggctctcaggttaatttttcccttattgttttgattttgaatttatatttcctaattatcatacagtataggaacccatttataataaaaagaagatgatttcagtagcttttgcatattttatataacaatataaatttaaatactatcaaaatcagcctgaagtttttcataatgttcgaaaggttcttttatttgggggatgacccaaagtttcataattaaaactaaactaaatcagaaggcacctatttgaattattaactacaatgtatttattcatagaaaacaaaattacaatgtttctataactgctcaaaacactgttcacttgacatgctatgcaactataaaatatttgccagtcaagctcaaattaaagaggagaattatttaataatatggccatgattttcaaagtataattgttctttttgagaacagacattgatttacctgatgggcatgaaaagcatatgacctattagattacacatgagatgattcattcatggtaagacatctatataataatgttaacctgaaagtcactgattgcaaatagcacaaagatcagaacatagaaagaaaaatctagttgaaaatgaaacataatatttgaatagtgcttttcaagtttacagagagctttcaaatccattttcctatgtagtttttagaatagctcagagagaaatgcactataattcctattattttaggagaaacctgtgactttaaaaacctccatgattattgatataattcatggttaaattcagaagaattgtgttaaaattataaaaataaactcgtattactttaaaaaataagagtaaacttataatttttaattaatatttttgttcaagcttgaggaatttcatatttttcagttatgaatcttaaattatacttctttgggagtatattttatataagaaaacattttttaaaaaacaaaaaaagagaacttacaggtaatccacgtttcccagctcgaccaggtggtcctataggaccccgagaaccctaaaagaaatttacaacaaaaaaaattggcatgtaaaaaagatattcacatattacatagatacaggatgtcaacaatacgtttatagttggatgcatatatatatatgtgtgtgtgtgtgtgtgtgtgtgcatactcttatgattaattaattgaaatcaggcaaatgtccatgtgtagataagactgtggtcactataacttcaatgacacttttacggtcaattttattcattgacttcattgaataagtatcaccttagttgaatacagtaagacattattcattgacatttaacatgatgcatacttattacattttcaaactacagcattttcagatgatggaagtcaaagcatcagtatcttctattccctcttagaaatgaaattttgcctttcagactaagaaacatatagtagttcataattagctgtttaccattcattatttagagtccttaacgaagtgcacatgtatgactatgtgtgtgtgcctatatgcagcttataacatagcatatgggtgtgcaaaactgtcagtgtgaaattgactccctccttaccggatctcctctttgtcctgcatctcctggagcacccacagggccaggagttccaggggcaccctgagagcctggcagacctgcaggcccagggtctccacgatcaccctaacaagaataaccatgatattattttttaacatttattctaaaacaacaatattccatatgttcatgttattcttatagtattaataatgggaaaaaataccctttaaaacttatttttacttattattttaactattttacttatatttattaattaataaatcaaattgaaaagaataaagttatttcttcctaatttcaagtctcatcctttccctcacctactccctattgctcgcacgtcaagatcattggagtataggagtgatcacctccagaatttaacatgttttctagagcaccaatctttaagctggaatattggtatacttggaatacacaaagactttccaaagactgtgaaaacaaagaaaattttaaggaaaccaccttctagattttcctctccttatgtattctttcagaaaactatattttgattatccttccttacttcccctaaataatccaccttctctcattttgtaaaagaaaagcagaaatcataccatctgcaatcttattatgatgcaatgtcccaaggaataaatacctctaggcactgaactaagggacttttccagaatgcatagtttacttgagtataaagctacgaaggatttggaaaataaagaggctcctttttattttatccagatgacacaattatgacaaggctccaaatattacttgtctccttaagaagtcagaggtgagataagcgttatatgaacatgtctaaacataaatatttgacttgaaaaattgagtcagactgtattttctgacaaaaaattgtcttatttgactgataaatttatcaacctagataaactttggcaattaggttatagaacagacacataatacattgaataagctgaattggcaacttcaaggttttgaaaaaaaaaaaaaaatacttgcccgggcacagtggctcacaaagtgggctgtaatcccagcactttgggaggccaaggcggccggatcatgaggtcaagagatcgagaccatcctggccaacgtggtgaaacccagtctctattaaaaatacaaaaattagctgggtgtggtggcacatgcctgcagtcccagctactggggaggctgaggcaggagaatcacttgaacccaggaggtagaggttgcagcgagacgagatcgtgtcactgcactccagcctggcaacagagcaagactctgtctcaaaaaaaaaaaaaaaaatacttaaagcacttgtacatttagaatttaccaggaatcacctcctttgcaactatttaaacttgtgattttaaaagggcgatggcaacttaaaataagtagagagatttaccgattttcataattacttcagcaaaacctttgaagatggttgcactatatagtatatattgacaaaggaaaaagcccaagttgccaagagaatttgcagtctgtggattatagtagatgagcgggacttagcccaagcttcctccaaatcctttcttccccttttttttcaatatgaggttgagtgtctatcctgtagtggagtgtttaaacatgtcatttaatatacaaatgcccaatggcatatgtattaattatatttaaagcatttgaaaatggaggttcagaaaatctgcttaagattacacagctaattacttagggaaacaatattccaaatcaagtctgactggctccaaagcccattctgctacatgatgagctttaattacatcataacagactttggagtggggagtgattttgccttcagtggcccatctcagcagcatgagatgactgtgcaactgccagaagggactggggcttcagagaaagttggggacatgttcagttcagcacattctaatttaaaacacatcatggaatatacagtgtttaaaaagccacatggcttatattctcatacggcattcactttagatggtgaatggaaaaatttagacattacacagcactattttggctttcatgcttttgttaatgagtttaaaatttagaacacttcatatatatcctcatccaaagcctttatgttaaaccaaagatggcttcaattttatcttcctgctctgaaaaaataccatcttaatttgttgcatattcaaatatcatttcatttacaagatataaaaattatggctttacagaaacagttgttattcagaaaaatcagaagtgtattggaactatcaggaaaaatgacagtttttagtgtaaattaaaaagatttcagatttgcatgactttagattttataataagtgaaatggctcttacacgttctccaacagcaccatcccgtcctggggtaccatcattgccagctggaccctataaagaataatggtttgaaaaactacttaactgagtaatgaaaaaaatcctcattccaattgtcaaaaaatgacagcatgttttacacctgtgttttataaactgtcagttagcatttatgcaaatgtcagcagaagaacggtttctacctctttttcattattttgaattactgtaaaattaacatattcttacttaatccatattcttcatttatatttcttattttgaaaaacaaaaaacccacaaatattttgaaatagataacaattacattcttgccactttatgttttgcttgtattaacaatgaaaggcttttcttacatttacttcttaagattattcaaatatccttaaagttttgaaataaaataactgtttcaatattaaactactttaagaaatagtcttccttttctattttattgtgatttttttcataaatatgtctttgctatttgatcaaaaattgttccaaaggctattgattctttctttcaataaaatgttacattaactgtttgatgattcactccttaaaatcctgaacagaggatattccagcctttaacttctcaaattgcctatcaaaaactgatttcctcccaaaagtgcctaaaggaacatgatatccattatgttactttatagtgatatttaagtaaaatgatctctactaactttgcccttttcacaagctggaatagctatattaatcctatcaccaaaaaacttggcaattttgataaatatgtcattacaaaatgaaataataacaagggaaagatgaatggatgtgtcctttcaccctcaaaacagtttggcaacagcttaaatgaactaaaatacttagctccagactagatgaaggtcagtgcaaagacaccgatcctattaccttttctttatgtcatcacttagccaactctctagggaagtagagtacatcaaataacattactaagaaactttcttaaggtcaaatatgcaataaaattctaaatcaattgctaaatgaaaaaaattgtttccatgacaccagataacaagagaagagttattttcactgtagtactcacttctggtccaggttcccctacaggaccattggagcctgggggccccacaggtccaggtggacctttatctcctgttgcaccagttggtcctacttttcctggtgttccctgaaatagaagtataaatgtcaaacacttgtgaagaaattgaagaacgctagttcccataaaggctaagttttcaaaatggtgcctctgggctccttctataataataattttgcattatcttacaacactcatgtaatcataatgctttcttagaggcctgcccacctcctatcagactcctcttgacgtatctaagggaccaaaaaccaaccatctgttgccaccagcacaggtgtgcattttgggttctaatcatgtgtaccataggtgattctagctgcccttctggaatttgcatcactttcatcctttttccccgctctgctttgtctgttcattttatttctatattctgatactttgatctcactcttgagagattttactttcacattcttggctcacttctgataacaataagacatcccttagctcctactttgttggtttcatatttcaacccacatgtctcccagttctaagatcccatacatctctctgtctacattccatatgaaaacatcattaatttttttcaagcactgtaatcttttagcaataaaatttagtctcttcaaagctaactttgaatcaaacttttatccatactccagggaatataaaatcctaaagcaccctccagggaacaggagattaccttcagatccttcttcagcattccccctacattcacctcaaatattactttagctcaactatgtcttccctttgatggtttactgtaaaatatggtatttttgttaagcatgtttacttaaaaagacactacctattcaccagaagattatccccctcctctagctccgggatctttttaatctttgaagaaggatttaaaggtcaccaaaaatccatatccttatttgcctacttttctagtctcagggttaaacaaatatatattttcaaagactttgtaaggtagttaagaatttgacatttaagatcaaaagatttttaagagactcaaaaattaatgtccctacaatactgtttaaatctattcatcaagcaaaaaaaataaaatcaattctctaaacaatttgtattgcacatatgagataaaatattgaccgatgcagctactcaccgctgggcctggtaggccgggcatgcctctctctccacgttgcccaggcatgccaacaattcctctctgcccggtcgttccagctggaccaggggggccatctggaccctaatgttgaggacaaactaaaatcagaaactatccagggtaaaactgtacccaaggaatttacaataagttgggtacagctttacaggtttttcagtatgaaaaagaagttctctgtttctcaaaatcatactgcatatgagtagtcataaattgtaatccgcacagaacctctaacattatttaaaggtgaaaacagctcatccgttggaaagaaactgaagattaatgtgaatactgactcaataaaagaggtaacttcagagaaatattttttcttctttataaaaagacaaaaagaaagtttaacaataaggaaaaaagagttatctaaacacaatatttaaaggcatttgcatataaaatataatatacatatatttttaaagttattcatacacaatgaacatttaacaaataatttttttgggtttagtttttagataccatatctattactgctatttttaaaatctatatatatacacgtttttcctaaagccttatagatttaatgcactttaaaaattttaggaatgtgcccagcataatatttaagcatttttgtgacactgatcattatgggtttctatttgtaaatatctcagttgaaggtggtctggaacggatacgccaaacttacaggttgcccatcttctcctgggtcccctttgtctcctgggccaccaggggggccagctggtcctcgatctcccacacgcccatgagagccagggtccccacgaagacctggaggtccctccttcccgggttcccctaggggtcccgcaggtcctggagctccctagtataacaaagaaagaaacaccaaggagggcaaaatggaaggcaagtaagagtgattgacataacgctgtctgcctcagatgcagatgtccaagcctcgcaggttcattttacctgttagataatcagtcattctataggatttaaacaaaacaaaacaaaagaaaacacagctgtagattcattccccagggggaaaactaaatatcatttgcagtcaattccctttgaataatttttaaagagtggtgcaactaacttgaattttcaaacttatttaaagctccactccaatgatgaatatataatactttattctgagataattatttattcttatgatttgatcttataatgaatgacatttattaaagaaagtttcatagttgcatcttaactgaagagaatgattattagcacataatactgtaagtattcagtatttaaacggaataataataaaacattggggctaaaaagaacttgcaaattagctcctccaagaaatactagattattaaggatgatttgctttgctgaaataccagcatgcattattggaataagagttgttaaataagaaaacataccattaagaaattaaataaaataataaatttaactcaaatgtatacgtgtgtgtgtaattatttcattatcagtgacttgtctcactaagttgacttacagcagggcctggaggtccaactctgcccgcagaaccaggaaatcctgtagcaccctagaaccagaatatcatataagcaatttttaaggtaatataaattagttacatgtattttcctgggattttttttcacaggaagactgaagcctttagatttcctttcatgttgtaagcaatatttttttttcttcgtacgaatcccatattttggggaattaatctagattaactggtaggaagggcactattttcctttttccatgcaggtagtactagaatcacattgatattttatacaatcaaattaaataaagtgctttcacattgtttatttactcttttatataggtagtatgttacttacattacaggtgaggcacctgggtctccaagattacaaacttgattttaacccaaatctccatctgagttaagtgccctttgcactatagtacagttgatacaggtaataatttgttatttcagtctcagatgaaaattatcttttacatgaccaggaagcactaggtaactagaattagctgtgcatactttgcagagcatcaaataaacttacaggcggaccttgggttcctcgaccaccttttagtccaggaacaccattaggaccctgaatagaaacaaacaaaagagcactatagtgaagcaaaagaggctgaatgtacactccaaacatggggcacttgactcaagttatgcctttttcttgttaacttacatgagggccaggggatcctgctaaaccttgtggtccaggagaaccagcatctcccttctgtcctggctctccaggttcaccttttactccaggctgtccgtcaggaccctataaaaaattatacaaacaagcaattgattataagacttatagacaaattactttagagtaattattactaatgtatcaattaatcatatattgtgaaacagtgctttataatcagtattaaagcatactaaaggaaaaaaagtactctgatgagatctttcaaaacagcctaaaaaataagctatcccactgcatttttattttaacaaataattatagaagctcaactagcacaaacaagttttgtgccagtctataaaaaaatgtattgaaaatgagaatattgtctagaaaactgtaaattttccagaatacgacttcaaaacatatgacaatgatcattaaacttattataacaagataagtgtttatttgtaaattagggatatttgaaaattatacctggggtccggcaaaaccaacagctccagttggcccattttcacctcgagaaccctaggaggagacaaagattactgtagctttcacacattatcctaaacaggaacagtattttaaaatatgatcatataaatctgatagttagacatgtaaatatagaaaaattacacatattgcttaaggaaggtccttaaggattatataaagatataggtcatagaacaaaattcccaaggtcagaagtctcaaaggagcctccaaattagttagtaaacaagctgcctaactacacttaatagattgtatagcagataatttttaagtttaattagaaaagcaaaagctaaaaaccaggaagttatacataacctaaaaccaataagcattgttttatataaatataaaaacaaaatgattaattgttttattgctcaatctcacactaaagaacaccaaaatactgtcacttacaggattgccccgggagccaggagggccaactaaacctcgaggaccaggttcaccctagaaagcagattttagatggttactgtccaaaacagtagctaaacataattttaggacattggtcactgtgtaggaggagatagtggaaaagaactctgaaatgatcttgctcagataccatatgttataaaatgaaaagatttatgaaagagcctgctattcaggactcataattttgagtgtacaaattaacaacttgtgacttaccttttctccagtaggacctgccggacctggagggcccaaaggacctggaagaccctgtcaattaacagaacataggcatattgaggtaaaaaatgcacagaaatcttcatgcttagcaaatcaacaaacaaaaaagaaacgactattttgttataatttggctgcctttgcaaatcattatctataataaatgatataatctatatattttcaagagttttctgtctagtttaataccatttccaccatattttctccacacagtgttttaatctctttcatgcaacctaattcatgcatacataaaactgttttcaggcattagcactacattaatgctaagctacaaaaatgtttctatttcttagcataattagctttgctaatatttattcggacatttgaccacaaattgaaaagaggctttccttcttttgcatataatattatattcttaaattataatagcaaaatatcacttttttacttttaaaaattgaaattgtgttaaggcattttaggtgttttttcctttttttttttttttttttttggcacagggtctccactctacattgcccagaatggagtgcagtagccattcacagatgtgatcacagcacatgcatctttgaacgcttgccctggatcacgtgatcctcccatctcagactccagagtaactgagactacaggcacaagccactatgcctgacttagttttcttcattttttttttttttgagacggagtctcgctctgtcgcctaggctggagtgcagtggcaccatctcggctcactgcaagctccgcctcccgggtttgcgccattctcctacctcagcctcccaagtagctgggattgcaagcgtctgtcaccaccacacccggctaattttttgtatttttagtagagacggggtttcaccatagccagggtggtcttgatctcctgccctcatgatccgcccacctcagcctcccaaagtgctgggattacaggcgtgagccatcgcgcccagccagttttcttcattcttttgagatgaaaaggaaaagtagctaaagtttacagcctaaaaccccagctactttgagatttatgggcataggagagctaacacttagaggacagtacagctaacacatggggacacaacctgagtcttcttgacaggtaatcacaaacttgaaactgtgggaatattgaagtcctctttaaaacaagttctctatcttataactgtgtcttgcctcttcatatgcagcccaaatattctttcatcgtttaatttctgtatgtacaactaaagaaacttaaggaacaaaaatgactttaattttatagatttgacaagaacataagaaatctgtgttcttatagtctctggatctacaatggaatgatatcattccaataatttatgtaatatacttctttaaaggatttgatgaaatataaatatcacttcattacttatgtttatagattttttatacagagaaaacatgttattcattttttccctactatgagattgcagtaagtgctttgctctgcttctttcctgcaacaatgtagtgtcctcattaaaaataaagcagtcattgcttacatcctggtcctatcacattgcaatttcaaagttagttcataggcacaattgatatgtattttagattttcccttaaaacaaactgccaatgcatcgttcctataaatagtactgcactacttatgcattccaggacatccatgatgtaaaatattaaaaatatgccagatttacttgactatttttgaaatattaaattaaatattagatttaactaaaaggcaaggtgtatcttttgtgcataatttgttaaaagaagtggtgcatccttaattaaatttgcataaaaaggactaattacccttaagatgaaaattttctactacatttcactatatttccttaatctaaagctattataaccaatgtattaacaatgactcaatgtgcagaaccaaatagcagttctcttttattatgttacaactgtaattgccagggcacacatgacaactaacagcaaaccatgtcatactgaaacagaaatcattagtcaaatatcaggtactattccagaaaatgatggatgtttaagccattgtgactagccactcttacatgaggaaatcatttatgtctgaaaatatattgtccttcgagtctgattgtccttggaattgtaaatgcattctaatttcaaagacctaacgcttgttaaatgtcaatttctgacatgacattaaacaatgctttgcagttgaccatccttctggacattctgcttgttcaaactgtttattaatgataacattaatgacgattcactgtgcagtaaatttctcaccccaacatccaatatactgagaaacatttatcacaactttggtgactccacaaagctctacttgtctatgctggaatgaagtattggccagctcactagattagcattttaacagaaataaaccttgtgtatgaaataaaaagatgatagagaaagataaagagggcccccatccccttaaggcacttatctcataggcacaataaatatgtttttatttaagtttcatttaattcagggtaagcaaaatgaataaaccgtggttgaatcacagcagatctcacatgccattattctccaactcctgactaccaaggaaacatgactgactttattttggaaggttcagggaaactcatatgatactgtaatgttggttcctagcccagctagaaaaggaatactttcacttactcttgcaccatcatttccagctgtgccttcagcacctttttctcctatgccaccctgggaaaacacacaaaatacaattgattcatttaattgtctctttcccacacttgtgtgtaagtttcatgagagtgaaggctaattgtcattttcctagtcgtatccaggtgagcctgggatggtgcctcacactgtgcattttctcagtaaatgtttattagaagaatgaaaaatgaatgactagtgactcaggatggtagaaataaaagcctgctcaagaaatcatttcattttcagcagaaagtctgaataaatgaactgaaaaaaaaaaaaaaaaaaaaaggacttactctgtcacccttggggccaggagttcctgcaattcctctttctcccggcataccttgaagacctggtgggcctgtatctccaggggtcccagatggacctggactgccctaaaatgaaccaacattaagtgaccataccaataatattaagattaaactaatgaaattgctttttagtgggtcaaaagtagttgtcagcaatttcatgtagttcaacttagtgcttatatttttcatctgagaaagttgtctctgagtgagttgatattttgaaattaaaaaaaccagattttgtttttgattgctgctttatatttttaacttttctcttaagaggcaattgaacgctatttcaaataaaaaggatagagttgcctttttttccctctgttggcaacataatggaatatattaagaaagaaagacattacatttagagaaatatttcattctctctttaatgaaactgatatttgatattaacctggttttcaggctaatatagtgtctaaattgtagtagactgcatcaatcactctaaaccctgaaaataataaggggtctcatgtcacatgaccatgaaaaattctacttcaattgtttatactgaagttggccacattattttctaccaatcactaaatggcacacatttctgccttatgatgcattatattttcagattttaaaagttccatattttcacatatgtagtaagcagaattgtgaaacctgagacaaggaaaatggagcatattattagaaaagcctcctaataaattatgtaattttctatttctttcctctgtttattcatagaagccactaataaaatgtacataaacattagaaatgtgtttgtatatggaagtctatcaccatgtgcactaaactacaatccccatcaaagaagagagtcttctttttagctgacactttagttgcaaggaaaaagcctagtaagcgctcattaaatatttgtggaagaagaaaatgatataatcaaattatctttcaaaaacaagacaaatgcattctcacaccatcatgcgtttattaagcagtaattttaaagcattttaaaacactgagatcactatgacacttacttttgggccatcaggaccatgtcctccagccattcccttctcaccagggagtccagttatcccaggttctcctctttccccaggatttcctcgttctccctagcacaaaattgggatgtcaaataatctcaatacttgatctaaaaataggtcaaaatgtttctgagaaatggcttctactgcggaaaaattcagaaatgagacattactaaatctcaattttctaatttagtgataagaaataaatttgaagtaaggatatgctagtttcatagcacaaaatatttctcataaaattaatttttatccagtcaaagaatttataggttaaaataaatcccagtttaagattttaaaagacaccttttaaaactgaagccagtgggaaacaacattaatcatgaagattaaaatacttactctaggtcctaacgggccaactgctccgggatctccaggaacaccctataaacacattttttttttttaatggaacaagagctttgagtttaggcatttatcagaaaactttccagttcatacacctagtttctattaatgtgccattagaaggctgcataagccaacaatttaaagaaagaaaagtacgtatatttttataaatgagggaatattacatgttttagatgaaaacatttttccaaaaaactttgtattatacctgaatgtttgatttttggcaatgagaacatgcaaagtactatttcacaaagatagagcattagttttttagaggcaacaaaatacatgctaaatgtctttttttaaactaatggaagatgaaaaagtttaaataaagaaaagttatataaaaagggctaaagagttggtcttttaaatagaaccaatccaattctactcaattaagtaaatctttcttgagcctataatatggacaaagcactctactaggtattgtgcattcaaaccagtgcagtcatgtctaaattaaaagtttgtttgttcttacataaaagaaagtttgtcaatttgaaatttctttctttgataaagataactttatcaaataggcctccaatcttattctccgaaatggactgtcctcactgtggcctgatctccctaatcttatcatattactccttccttaaaaacccttcttttttcttttctggttttttttttttttttttttttttttgagacgttgtctcgctctatcacccaggctggagtacaatggtggcatgatcttggctcactgcaacctccacctcctggattaaagtgattctcctgcctcagcctcccaagtagctgggaatacaggcatgtgccaccatgcccaggtaatttttgtatttttagtacagacggttggccaggctggtctcgaactcctgatgccaagtgattcacctgcctcagtctcccaaagtgctgggattacaggtgtgagccactgtgcccagcctaaaaactcttccttagcttcccattactctaatgatgaagaacaaattagaatcaaattaaagccctccataatcaggcccctgagtcaccctgcagccccctttctattttccccaaattacattacccactctgatttgtaagcttgtctcatttcctggaggtttttcctatcttccctccttcatcattatcatcattcatctctcagatctcataaaagatattactttgtctggaaaacctttcctaaaacccccaagtcttatttaggtgcatcttttttgtttccataaacatagtacctcccttattatagcatttagagcatgctattattgtaattgtcctatactctctgaatcctactatactgtaaggacagcaaggtccaaatccattttgttcagctggttcaggccagtgctttgtagaggcaagcacacagagtgttcagcaaatatttattaaatgattaaatgaacaaatgaatcattcaaagaaaaataaataaatctatgagccaggaaaacgacagaataaaattgttagtatttgtccataactgtttatataaagtggttaagaacacatcttgggaagcagatgacctgggttcaaatctattaactgtgtgactttgggaaagttatctaacatctgtatgccccattttcctcatctacaaaatggagataatgatagtacctagtacatagggctgctttgagaactcaaagagataatgtatgtaaaggaaagcacaacagagcctcacacataaaaagtgataattgagccagcaatgtatagtgttgccattattattatttaaacacttacttgatcacctggttttccaccttctccaggaggccctggaggaccaggaagcccctaaaacaaaagtaagaaaataaaattgtgaatctgtgtaagtttaacaggctaccagtgttaacagtttaccttttacaattcatggggtctccaagactatattttcaatgaaaatatattgttcagacattttaagtaaaaaatattgttcagaagcattaaaaaaagactaccaataaaacacaacagctagtcaatttataggattgtattttcatctgcacaccacttagcaaaaaaagagataatgtaacaggagcttcttcatatttatagagtttttatggctctgtgaacaatattttagactgctagaatattatttaaagtcagtccagaaagttttttttacaaattatgatcttcctcctattaaataatgtacatactgatatatgtagataaattatgaaactttgttcaataaaaaattctagtcactgtgccgataaaacaaaatcagccttaaaatggtttcataaactttgttgagctatcagaaacattttattcctgatatctttttattacttttttgttattttttatttgttttgttcataatttgcaggtttgatcagtttttttagaagcccattcctttactttgaacaaaaatgttcgattttatccaaatgtctatactatctactaaaagagggatgactttttgaaaattgtagaatttcaaatcttctgaccatatctttttttttaaaaaaaaaaagcattttagttaatggaagatgaaatggaaaaccgaattagtgcatacctgaaaacctgtggggcctggaggtccttgttctcctctttcaccagctagaccctaagttgtgaaggagaaaataattgtgaatataaccagatctttgtctgcttcctctctacgtgaaccactagaagtactgatatttatttgtatttcttccaatcacatgtttttctctttagccaggtaataaactagtattaatagtaaccaaatggtattgtttgaagtctctggaggtgagaaaatatcttctaaagccagtaactgataacatgtatttattttttgatccaaacttaaatgtctggagccaattgtaaacttatggggaaattggattgaatataggaaaacccattacttttgtatatgtaatctaaaaacataatatttttattatagtttatttctgaatgtcttaagaattatttatcaagacttcaaaaacagaatgactaaagaaagcaaagctaacattttagaaagatttaaactgccccacccccccaaaaaaatatgccaaaatatttcggataaacacttcatttgaaagtcctaaaatgaaaatagacctcaaagaataagtattattccttttatgtcctaaaaaataccttaaataattttttttttttttttggagatggagtcttgctctgccacccaggctggagtgcaacggtgtaattttggttcactacaacctccgcctcccgggttcaagtgattctcctacctcagcctcctgaatagctaggattacaggcacatgccaccatgccaggctaatttttgtatttttaatagagacagggtttcaccatgttggccaggctggtcttgaactcctgacctcaggtaatccacctaccctggcctccctaagtgctgggattacaggcgtgagccaccatgcccggccttacataaatttttataagatgcattattgagagaaggtaaataattgagtatctaaatattttaaataaaatattttataaaatatttgttacacactgttttcttcagttgatatagtccttaactgtgacatataaaaacctttgcagtcagagttttacagaagtttaaagtaaaaagatcaatcattatatttaaaaaggcagaagacattatctcacagaaatcaaaagagaaggtataacagaaattcttcattcccatacattcttattcactttccctgaaacttacccataagtcttgaacaaacatcatcgaaaaaatgcaatgtgtgtatatatatattctcacacacacacacacaaaaatcacataccggcgggcccacaggaccagaaggaccaacttcaccatcttttccaggagctccctagtatcacacacagatatttgtgaggtgagtctatgataatttaaatagtacctacattatttttctttagcagaaaatgtatatttaccctctgcccaggaactccagcatttcctgcttctccaggtttcccagggtcaccctaaagaataaatgaaacttttgtataattccttcaatttgtcaaaaacatacctcctccaaatgaggatcatgatgaggtggccaacatattatacactgtactcacactgctacctttggggcctggaaggcccatgctcccgggctgccctctgattcctatggagcctggaggacctggacggccatcttcccctggcgcaccctatagaattgacaggagccatgtaagtttcatgtaagttgtttctaaacatagcatcacccaaagtgtcacctttgcttactatcatgttacataaattttaaattatcttgcattttcatgttaaagaatcaggacagttgaatgggttttttaaaaaacactgaagtattttaagtaactagaagagagattttattcttattctagatatgagcttcctcatgatgtctcctgacagtcatattaataggggaaatctttcttctttcatttactctggtttgtggtaatgaaaattcaggacttctatttcacattgcagaacaagggaagatcttagaatatataagttgtcaaaattcatacctacttatctcttaaacatataaaattagaaggatataaaaatgagaacattgctaatagacaaatttcaccaacattaaaaactatatcattttaacattttcactgatgtcaggcagggaagcaattcaatctcaaatatttatcttagtaaaaatttgatctacatttttgtcaacttgaaaatagatcctaagaatatgcttccagaagttggtacaaatatgtcaatatgaccagcatccatataatcaaaaacattaacctaaataaatatcatttaagttgcatgtctgttgaaaaatattagtggttgtggacttctgtttaaattacttaccaaaggtccaagttttccttcaggaccttgaacaccaggatttcctgtcaaaccctgaaaataaaaaaccaactgtcagtttgttgctgatatgcagttgaagtaaagattcttaagagtaaaaatagtgttgcatttttgtcaactgaatagaatgacatttctgtaaatcaaataaatttttaagtgatgtattgttaaaatttttcagaatttctctgccaaaattactttatttgctatattgctataaaagtatatttacaaatatttataaattctttacttgctaacaagttataaaatttgacaaacaggatttttttctcatgccaagtgataaagctattaatacatactgctttgagagagactagaagttaccgtgttttctatatatgataaaaataacaaaccagtattttttaaaataatgaattggatcaaaaccataaaaacaaagaaatgttctaaactgtaaaaacaaactaaatttaaaaacaaacaaaaacccgaccaatgcatgctcaggagcacttctcccctttgatgtagcaaacacttgctatattcttacccgagcacctggaagcccaggttcccctggacgtcctggatccccctggcttcctttgggtcctgaagaacctacaggaccccgttctccttgagcaccctgtaccgaggcaaagcagatgcatgaagaaaaagagtatagaaaaacaaaagcaagcagaagtaaaattatcgttttacaaatcaaggcactaatataacatacaaatcaaggcactgatataacgtataaaattttgtcaccacattccgccaactagcatccttcccccctatgcctcttaatacaggaattacacaagagaggattggggttaggcctggtatttgtatccatctcctttctggatctgagcccatgcaggccatagctagatcaccgtgctgaaaaatggcatcttctggagcaccccccacgtaagtatcaacattgacagggcaacctcacctttggcccaggtaaaccatcagagcctggaaaaccacgattgccaggagcaccctacaaatgaccaaaatgtgattcttaattgttgttgatatttttgcaatatgtaatgaataggtgatttttatttttagcactataaagttttaggagccatcatcaagccaacatggctatagatatgcatgagaaaaatctgactcgatggaaaaactttaaaattttgaagaatatataagtactgagccaaataattcctcaaatcaagaaatattctgcactttgggaggccaaggcaggcagatcacctgaggtcaggagttcaagaccagcctggccaacgtggtgaaaacctgtctctactaaaaatacaaaaattagctgggtatagtggcaagtgcctgtatcccagctactcaaaaggctgaggcacaagaatttcttgaaccttggacgcagaggttgcagtgagccaagatggtgccactgcactccagcctggacaacacagcaagactatgtcagaaaaaaaaaaggaagaaaggaaggaaggaagcaaggaaatattctaacgattcatagtaaaattaaacagagaaaactgatatctagagatgagaggcataggtaccatctatagcaattaaaatgtcaacaatgacatgcattagtgacatttttgtgaaacgctttgcattctccaaagctctagataaatgtgagattactgttcttcttttcagacctgtctcactgtgctccagtcacagctacctcttctggtctttaaaatcaccaggtcctttctgccctcccagctttgcatttgctttttcctctgctaagaatgttcttccttccaagttttctactggcttatcatcatcttcaggtctcagctaaaatgctatcttctcagaggatcctctttcctaaccacctaatctaacattacaacactgacatatatgtgtagttactctccaatgtgtcatgtctttacttagtgtgtgtatggcattttttaaagtgtgtacatatatttttatttacccattgacttgtttattgtttacctctccactaaaataaacaactatttactagtctccacatgaggactaggaccatagccttcttgttcactgatataattccaagcacagatggctcaaattggcatagactagtgatttaaccaatattagttgaatgtatgaataatgattagtcagttggctctttctatttgcacataactgtactgaactgtgcagggaacctgcaagcatttctcttaactgttctagttttccttactgttctcagacttacacacataattccctcacaactgtaagaatgtgttgtattatttaaatttaccctttctcccactggccctggaggaccaactgttcctgggtcacctctgggacctcttttgccttcttcaccgggtgggcctatcggaccctgaataccatgtggcccctgttaaaaacagaaggacagttaccagaaagacccatccaaccagtgaattatagttggaagcctaatttaacgaagtcagtcacaaattttaaagtatatggaacaatgagatattttcatctcaagctattataattctcattattattttaaacccttgagcattttgagctgtacacttccagacaatactatgttctacttatcattaaaacaatgaaaccttactggttccccttttgggccagcttctcctttgaaacctggaactcctggatcaccctgaaaaaaatatattgatatttgtaagaaccaggacatttagctagtccaatctgctcaaattagttacaataaataggctttaaaaattctctccagctgagtcggttttgcatcagtagtataatataatcatttttaaatgaatgcatgtgaatatgttaatatgtgtaaatttttataaaattcagtataatttggaagccatttaatttatagtggtctttaagagatttatttttaaaatcatgttttttatcatgtgtagtagaataaatagaattattgagttattattcaaatttgaaaattaaaattggaactatcaatgacaatttctatagataaatacatttaggctgtattttaggatgtgaacttgtttacccagaatcaaaataattttatatttatgccgtatttattgagaatttagcaacttcaaatagggcatttcactcttggaatgttagagggttttctgtaggtgtgtctttaaataccaactgaaatttaagttgtaagaactggattgcaaaattcagaacttggtaaaatcaaatgtgacactagcaacactaatgatttaataaatctgtcaccagcactttaagagaatttatcagcatgaccacattacttggaacagaattgtaaatatttatttaaatatttatttttatacatcaagctaaaagctattaagcacaacttctcaatgtgtttatttgttatgggttcatcaaaatattttttctaataaataatttctgtaaaatatgaaaacattcaatctgacattcaatctgattaatatatttgaatcactctttaacaataactctgaagaaatagttgttgaaccctagcctaattgtcattataaattcctattgaagctccatattcctcacactggcttgcataatattttcataatatttattattcaattattcataaaattctatgaggtgaaccataaagttataaccttattattttaaataaaagaacactaaaatttaacatactgcaataatgttccacttagaatttaaacatctaagttgtacctcaacatttagctttcacttcacaaagactcccatcttcccacatttggataagtcacgttatctatgtttcattgcatcacatgacatgttattactcttggccctcgtagttagattacactaaaggatgatagttctttcaaaggtcattaccggttggcctcgaattccctgaggaccagtgctaccctgaggtcctggagatccaggaggccctgctgagccaggaggaccagaggtacctggagagccctattaaacagcaagagtgatgtggtaagtagagacacaggtagcagtctggggccaatgtctaaagaatcatgcccatttgagcttcacatgccataaatgcagtactcaccgttgggcctttggcaccaggagtaccatcagttcctattgcaccctaaaaggtacattaaaagtatgtaatgaaatattaagcaatatatagatacaaatgtgctagtatacagatgtccagccatcttcaaaaaggaagtagaagcattttttaaaaatcaaccaccattatatcataaaaattacttttttgactacttctcctttacataaaataggtaaaacttacagagttgacaagggaaatatattttttcacagttgtaagcactcattcagaattcagagaatatattaaattttatatttcaaaatagctagaaaaagaggacttaaaatgttcccaacacatagaagtgatatatgctcaatgggatggatatcttaaataccctgacttgattattacacatcttaggcatataacagaacattacaggtaccccctaaatatgtacaaatattatgtatcaattaaaaaaataggttgaatttgttctgatgttacaagaaatgtccagctttctgggctggttcttaaatatgctagaaacttacaggaagacctggagagccaactggacctgggggcccagtttcacctctctgcccctgaggaccttcagggcctcgcgcccctgtaggacctgcttctccctaaaagggtgcaaagggaaatgttaatttaagaaaaatacgagagtggcattgtacaaagttgaccgcttatttggaattttacatttgaaacccaaatactgaaagaggccaaagaggattacaagagatgcgtgcccaacca

SEQ ID NO: 18 - DNA, 182514 bp, Artificial Sequence
  Synthetic BAC sequence
gcttttgggaaaaaaaattatctcttggatagggatccaaaataaacagttcaaataagataggctttgggaaaatgttaataaacttgactctggcaaattatttgagtttccttgtgtttctttcacttggcagggattttaatttggaagttaaaaaaaaatgaagaaaaatgtcctaagatttcacacatggatacttttattataaaatgataattttcttataaaaccacaactcaaggttgaaaattgggggggggggttaatttaaacttaaattatataaaatagattggacaaataatgatattgccagaaaactttgaatcatccatatttgactagaatctcagcatctcatcagtcaacaggtccttaccaaatgtctgcccttttggactgcttgctaggtgctaaagaaacagtgaccaccaaaacagacgcaactctttccccgaggagcttccagtcttgcagaaaacataaagtaataattatgagcaaattattataactatcagaacataaatgaagcacttttggaatgcagccattcaatatgatccatatttaggtattcttctttaatattgtaaaatatctttacccaaaattttggtgcccattgtccctaaattctaaacttttgagaagaagaaatgagaagcattatccttatttctagtgaagcagaagaaaagttaactacagcaatgtagtggtgggaataacagtgaagaaagctgacacacaccgtgatgggtacatataggcactggagatgttgactggctatcactgctgctgttgtttcctctggttgccttgtcatactttcttcttaataacagctaggaaggattttgctaactagtgggctgcaatcattaaggacttggtgaaattccaaaatccacaacccctaggaattttcctggatcccctacttggagaaacattgtaagcaacttacagcacactaaatcagaaaggttggcctgtaaaaccatttatgtaattcctctgcttttgttttggggaatcttccaaaagacgtgtctagagaatcagatataatttgagcagagtatgctaacgtggcttcaacaatgattttacttttctcgtaattttgtactcaacaatcattttttccagtgatgtgtcatgctgtcccagttgactgtctggccatattttgccctggtgtttgctatagcaaaaagtgcagctataaaattatcttcttcagcttgatgttaatttcgatgaaatcttccaagatgtatcttttttcacctctaaatctatgtgataacaaaagatcaaacagttctcgatcatattttgaatgggaaatattggtatcataaaataattcaagagccttattttagctacttatttctttctagttagtcatcataacaaataaccagcgaatgtactttttttctccccttcctctccataaaaagtatgtcacttgcacaacttcaagttaggaaatgggaagggtcagggaaatctcacacaatcctacccagtttgatcacacattacctccaacagctagccttcagctgttgatctaacaccgccagccacaccctaactaaaattttagaagtgactgttttagctgggcaccaggatacaatccatggcgacacacccctgatgctgaatctaggtcaatgtggttgtccactttgcagctaaccttgccctgaacaaccaaaaaatagattacaatttctacacataaagggaccactctagaatactattacctgccttgtatgtctccttagcatgctcaactaaacagattgaagttcccacaattctcatgggaattgaagctaataaatcaagcaataaaatataaagctttagacatttgtcttacattacatgtggggtgtctgtatttgtgggaaggtaaggaattttcagtattttgatttgtattttttctttttttatttgacattttgcacagttttttccttttaaaaatttcactgtaaggaaattgagtcaagaaaaatgaaaacaatttaaacaaaaagtgtgataattcctctttgaagcattttaatttcatgatgcttatttatatgtcattttttttctttttaccctaaaataaaaataaattaaaattatgatgcatttctagttcaattatttcaattcattttgaaattaacttttggcttttctgtcattctctttcatgatccttggtaaattacctgtatttctttctattttataaatttttctaatggtctctgacttgtaatacttgtggtgaacacagagtttgactgctttcaatttatttcctaactagttctattgtttattttttctattttataaataaattcataacatctggaagttttttaaatcgattataaatccaaagacttcctatgctggaaagagtgaccttcttttttaagagtgatggaaatactggaaataattaacttattgaaaattaccatgagttctaaaggatacaaaggaaatagattacttcaaatgtgtttttctggattaagtgtttcatattttaaatcattcgccatttgattcttattaatttcctactatgcacaaggccatgtaatagctacgatggagtataaaatgaaagataaaccttagtttttccctggagtagctttcagcctagtaaacgacataaaaagatgtaaattaaaataaactaagaggcataggaaaggtaaggtaaattagaagaagagcaaaatgattttaacagggaggatcagaaagattttgtagattagttgatctttgggtagaatcttcaaaataggatttgaacatacagaatgaggaacaatcattttagacagaaagacagtatatgcaaaggtatagaaacccagaaatgtagagtaggtattggaaaaaaaaaaaaaaaagagccatttgatttactaagaagatagttcttggatcaagatgaattgcatatcaagaattatctaaaatagtgttttgtatcctgctgggtttgggttgagaaatagagagagtggctggacatgaaataatagaaatcaaattatattaatctatttagtattattatccaaaggttagcactttgaataatcaatatggcataatttttatgtgaagactttctacttggactagtttattttcatgagtcatatgtttcaccttaatcactttatgaaatatatctgatatctataaaataaagaggtgaagagcagaaactgatccatggtctgggtcctatattgatttttttaagaaatgcttatattattaaacacgtaatattttaaatactatttaatgccatcctaattcagtcagtcttcgttacattgatcagtattcattatgtacaagggactgtgtttactactgttcatgatttttaaaagtgggtgagggtaggaaacaaaaaaggttacaaagaggagtaaaataagtacataaagaaatacaaaacaatgcttctaaaacggacattgccacaagaaagccaagactccagagggcaacacttgaatccttgggaacgaaaggagactatttgctgtggcctccttcctccaagaacatataccaagaacatacctaaatgtagagttctttaaacatgatttaatgtacagacaaaaatgaaggctttagacaatttagtagacaatttaatagtcatggcaagttaaacacagaaaggtctgtttatgtctgtttattttaggcaagggagcctgatgaggaggctttcaatttttgtgtacttaagaattatttggaatcaaagatcctaaatctgagcccccattgtgtatctgaatagaaaagatattgataggaattaaaaatcagtctccatttgaagcatgtagattccctgtttggctttgacctatttcatgtatctatcagaagatcgtgatttgggccttccttttatctttacacagaattggctacatctgaagagctgttacagctgtgttggatattgctgaaaattcctaaggatgactcagatgacaaattatatttgatagagagtctagtgggatttgcagagtggagcttcaaccctgagaatgattaagttaactgaagactcaacagggaacgcctgagctgcttcacgatgtggcatcccagtttctgtgtcacccctgtggtaaatttataaagtaatcacactattcaggaatgagattaggtaaggagatgaatttcaatttcctatgaattttcaaatataattacaataataattatgatagtaaataaagctataattaaaatataagtatatcagaacttcgttcaagagaacatgcttacaatacttcagaaagtttcacaattcaagtagaggcttaccagtagtttccctttcaatgattaatagtctgttatgttaaataagatttcaggtgacatgtttatgtctacataagcaaaaactcatagctacttatctacttatgtgaagcaacattgatataacaaatacaagttatcttacatgtatattaaggaagtttcctagaaatttttacttgcttgaatttttgtcagcttttaaaagtatatacatacgtatttaattatacatatatatgtggggggtatataaacatatacacacgcaaacacacaaaaacacatatgtgaactcttttgcatgccctaagattgtacttcattaagtgtaaagtagtggacttttacttaaatacaatactgaaaattactcaaagattaatgacaagacaaaaatcagaatggtaatttttgtaaattggccattaactccataacattatcatttttttcatcctttcacaatgcctcattagaaaacatacaaaattaagtgtcagatttgtatttaccacacttctaaattgcgtaaaaatatctttaccacaatcagtgattagtggaaagcatggtgaaaatatttgtaaagtgtgctagtcagttccagttgcaatgaattattttgagggtcatggaacctctttgaactttctgttcaatcttgggatacttcccagctgcaaaacacaaagacaaaaattcagagccttagctttaatagcaaagaataggtaggaatcaagatactcagttttttctaactaaattttactggaactttactttactaaatgtcaagaaaatatggattttgtacaaaagtgaaaatttttagttatttacaattccaatgagtaattttgagagtcatgtaacctctttaaactttctgttcattcttgggatacttttcagttgcaaaatacaaagataaaaatttagagccttaagtttaataacaaagaatagataggaattgagatacttcgtgtttcctaactaaattttactaaaactttattttactaaatgtcaagaaaatataaatcttgtacaaaagtgaaatttccaggctaaaaagaaatggttattaaaatggttctataagaaaaaaacaaggggtcaatgaactctaccttggggactaaggggaaattaaagaaaagggtcttgaagacttggtcatataatcactcaaaaactggactatcatgtcccactgccagtgtaatttgcctcaatcctggacatatctatggttaaatatgtttaagtcctgcaagtacaacatgactttttcaaccatatttttggctctactatgcacatactagtatttgttcaaattcttttaaaggaaacacaactcttcaaatgtggttttacctttatcaactgagtgaactgatcaacctctctgggaataataaagaagacctgcattgtattttacagttgtattggtagttctattatcacaagtagtttttaaatggctttacagtgatttgaaatctagaaaatgtccctaaaaataaagcatcttgctggcttcaaaaagaaaatcacacataaagccgcacaacaaaggggaggggagaggaaagagagaaacattgaaacatttctgttccatgtgttttccatggtggagataattgattttcttagtgctgttgtagaaagcgctgctggcattcactggcctactgagttcatcacagctgtgcttgtgcatctctctcaagctccactttccactgaattggaaaagatttgaatttttggttgataatctgccacacccttgctttgcctcatctttccaggcactctctttgttaaaggagatccagattaatcagtgctttagttggtgcaggtatttagatttgtgttaaagctccaaatgcaatccaaaaagcaaaatgacatgtttatgtgtcctggttaacatcagtgaagtcagggaagtatgggaagaaatgtgtggctagataacaatgaggacagcagttcctggatggcataataggattcagaagtgtatgcatttcacctagttcagaccctgtattaagaaatgctttgaccccgtattaggaaatgctttgacaggaggtagaaaaataggatctgggacacagaatgcaaaggatcctagtgcaaaacctccatattcgaggtagtgaagaatcgtaaatcagaatatctggagaatgaattctctaggtctctcctgaagaccttaaaatacaacaatccttccatatgcaaaacatcagctaatgtttcttaagtgagtgcatcaatcatgaatttttctcatgagtataaggcttttatttgaatagctaagcaaattaagaattttagaacaatagtaattttatttataatgcctaaaataaagcataacaagcattattttaaaaataacatttctaatttttcacagtggaaaataaatctaatgaagaaattcaataaatttcagcttttatagaccacctaaaacaatgagagaaatctaatatagatatatgaattctacgtagatacaaagacatcatgagaaaaactatgtttctgaattggtttgaacacaggaaatattttttgtgtacaggacaaagatgtctgaaagacagaaagatgcatataacagcctttccccagcatctctactgtgatccagtagaaaagcttatattcatgaccattctcaacagttacttttctcccacgcccccaagcagtgactctccaatctaaaataaagatacacaagaggttggtctcgttctagttttcctttcctgtcatcaaatgatgtcatctacattgagatgtcttggtttgtgtccttgtgactgaagatataagaaagcttgggaggccgaggcgggcggatcacgaggtcaggacatcaagaccatcctgactaacacggtgaaaccccgtctctactaaaaatacaaaaaattaaccaggcgtagtggcgggcgcctgtagtcccagctactcgggaggctgaggcaggagaatggcgtgaacccgggaggcggagcttgccgtgagccgagattgcgccactgcagtctagcctgggcgagagagggcgaccccgtcgcaaaaaaaaaaaaaaaaaagatgcaagaaacaagaaagcaagtttgccactgtccatgcttacaggattcatgtacacctgggaatatacatatgacatgagttgagtgaaaatttagtaacacaaattagaagaaagagaaagatgaaaattagtttaaaggaggtaatttacttaaggaggaaagttttgcattgaggcataaggaagtgacttccattaattggtgtgaaatggggagaattttatgtgcacaggcatagagacggacatgtttaggtgaaggtgaagaaaattagttcaagtgaccttgattagaattgaaatgtccaccgtagattatagagatagatgaactaactatgaactgatgattagggtgtaaagagatatctccattgccagatatagccttatactgtggacaagcatatttttcctgcagagatttatcaaagacctataaatggtatttgcccctctttcaaatatgacacaaaaattactgcttagatagatccagaaatacattggaaagttttgtggatgaggatctggaaagtatacacataaaagtctaaattagaaatatttatactaatctttagagtaatgcagaaaaaatgaccactttctctggtactcttttgctattctatgtgataaactctttctcttccagtttcctaaaaagttatgtcatgaaaaggctgaatttttctctagaaaaatctgctctgtctttcccaggcagcataaaaattggaaatctcacaagaaagcactctggcttgctaaagaaatttgtgagaaatggaaacagctatagataagtatctaacttttaggaagccattcaaacattgctgaaatactttgtcttttgatatttgcctgaaacttaacttctaggacccagggtgggtggatgagtcgaaggggcatacggtggcatttctttccgtgagtctcttacagtctcctatttaaattgagttaggattacttctggcaaaatcccaacataaaaatcttctaggaagatcagttctgtaaattagacatactagataaatgggcatcaagcagtttttcaaaattatgcagttgttaacttcataaggggaaataaaaatgtatgcatttacattgtatgtattaaaacaaggcagagcatttctatacgttcctaagttatacaaacatatatgtaagagtgaaatatgtaaaaaaacttttacataagcagatgcatacaaactccagatgtgctctttttcttactgtgggttgtgtcttctataagggaaaaagaaatatttatcatttcttttactgctgaggggatgggtgcggctctcatatttcagaaaggggctggaaagtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaaggtgagtaggtactgatttcaagaaactttatgggatttttgtctttcttctcctcacaaagaggggtgtaaaggggaaaatcagttgcctgattcaagataatttcctctataagctccagattgtgaaacgttgaactgaccatggctgtgctttttacattacttgaaaaataatcgcgttatgtgtgtttttaagagttctgtggttaagataagatgttcttgtactaacttgttttcatgttaaaggcactggaaacttttaaaaatggctttaaaatttttccctcctggattgttaacatcttggaatacttccccaggcagtctggaagttattggtctcttgcaataattttatgttcctctttgtctgctggattctttgtaaggttagaatattgagcattgttttctgaataagaatgcctttcaaatatcatggattaagaacagtctaaaggaagattctacgcattatcagaatcattgaatatatttctgtaaaatggctacaagatacctataaacattcttcaaagggatcaaactgctaaaatattttattattcctgtttttattttgtttcaagaatgattgattaattcatcttttctagtagcttgatattaagggactaatattttccacatattctacgttttaaccacattcgcattaatgaagaaaatattttttaaaatgtttcaacaggaggtttgactttgctgcaaacaaggtaaagatactagtactgtttgacttcagaaagctgttttgctatattttctaataattgcatgtaatgtttttcatattctaatttcccctaaaaacacatttgtctcattatttatgtgaaaatattcttttatttaccatagtcatgaaaatgctgaacaaattggaatacaaacttccatagaaataaatatttaagtgctaaatgtaaagatagctaggagaaattattagacaatttttattgcacataactaaacatggttacatttaaacatatagattttgcaaaggacactgcatgaaaatttggtttttgtttgtaatatcaaatgtatttgttgtcctcatagctaatacatgtaaatgtgtgtatgaggggaggggtagatatacaatgaaatgtcttcagttatattcagcccatggacacaaaagaaaagaaacacccattttccttgttcccttaatttcctctcctccttacccctcctctccttcgctttgccctcctccttatctctctccaccccttttggctcctttagacttctcttcactcatcaccccaccccttcctaggcaagcccatatctactcctctctcctcctctgtcttccctgcctgttactccctccctactccccatgtggcctccttatgcctccatttcttttttttagttctctctctccttgcctcctcaccctttctttcccctgaactctcaatccttcttcctttctcattcctctccccttttcctccctatcctgctcttcccaggagatgctacaactcacagtccttttttaggataccaaatgactactatcccccaccaaccatttattgaaaagactacaaacttaggggttttagctcaaaaaattgcaacatatttgtagttgcctcgtggttgcaagctttttataagcactgtggctatttttcttcccaatccaactttagtgggggggtgtttgccacttacagtaccttgacatcacattaagttctgtttatttccctctttctctttagatgcaaaaaataatcaataagtataaaattttgctgatatgtgtttgtgtgttcttaagctcaaaaagagttgaaagagaactgttcagcctattttttttgtcatgagtaaaagtaaagttgaagtgacttaagacagtacatcttatgttccctgtgggttttacaaggaaattctgctattagataagctttggaaaagttacaggaggtatctgaatatacagcacactgagagctgtcataaagttctggggtggggtttcttatatatgccctcataacttcagagacggcacagctctaatgaacactcacttctagttcactcacaggcattttctggatacaaacaagtcctcaaaaagaattttggtcgtcttacaaatttgtgaacattgtatttaattcatgtgttttaatccaccaatggagaaacatagtctgttttatatttcctgtagattataaacatgccaagttttaagtacaaagatgcgtcacctagtggctgacaagccaggttaccatttacataacgaatgccaatattaatgttatgtagctggctttggtagtttataatgagctttaaaaaattcatatgcgtgaattttaaatgttaacactgctctcctaaggaaattagtatgttacggataaatattgcaaacacatatactgacacgaaaacacaatggtaacaatattcagagtctttttggaaattagcttaaatgttacggccacttaaaaattctacatatgactattgtttaaatacatttttcatgtctctgatgtagtccttatttgacataagtattttattcactgcttaattgttagatagattatagacagctgttactaagtaatactgctccattagggcagaaacagaaactttattttaattaaatgtgtactaatgtttgagtttctatattttgctacagtgataattccagtaaaataaactgtaggcctctagttgttttagaattttaaaactgtaaatggactcagagaatcagtttcttattagacgtcatgagagtatatttttttcattatgctttaagagggaatttgtaacttgctcaggtaacattcaagttttctggtttgtgtttgtccctacaattaaacacactgaactaacaggaaaaggttacatacatttaggaacaattgcacttttaaagggagagaatgcatagttgctcacatatctcagtgtcagtcacctaacatggatcagtgctttatttgagattacaaaactagaaaatgacggagtcaaggctaggaccaatattctgttcagtcttagataattatagaatacacattaaaatcagatatttgaattttcttaattttgtaactatttgtcattgaaaggagatactaaaaaaattatatatcgtcctagaaagtacatgaactaataatgcatttctaaaggtgaaaaaagaataggtatttttctgtttaatattcaattttatagagagtagtacgttaatttttttaaaccccagaagctcaggatcttatcattttaaaagaaattatcaccagttctgtgtgagtaaataaagtattataacactttgtgtttttcatccatgataccttgtatttacttacctgagctttttttctagggaaagaaaaatgctcaggtaataacagagccttgaaaaatttggattttcaaaactacctatttatgtataggcctttagatcatctgatgttgaatactctttaagtgatctaaaggcctacatataaaaaggtatttttattaaattctggaattaaacatttcagcattacaagaaaagaaagcaaatccactggaacaattctgggaaagaaggaaagactgtgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactcaaaaaaaaaaaaaaaaaaaagatcatatagtgtaaaaaaaaactctccagacttttcaaaggggaaactttgcctgtttcatgtcaagatgacaacggaaaaaatgagatagctattcttacataaatcatttgtgaactgcagttgggggagttacattaaccaccagagtttcagtctgtgtctaatgaaaacacagcagaagtggattcctttcagattaactaataaaacccttgtttttttccatgactgaggtcaagcactgctgtttaaaatgtagtcttaatgaacaaaatgaaacgttgaaagaggacgagtcaaaatgcccaaaagatgtaaacatcaaagagaaaagatccagaaattattaaaagttaaacttcccttgaattctagtattaagaaagtactgcttcagtaaaatggcatatatttttctgaaactgtttttctatagtattttgtgtggaggatgacagagactgcatttctcaagtaaattaaaatcacagaaatactctttggagttgcatagcatgttcacaacgttccagtttcattcagtgaaaacttctgatgaacttagatgtatattaacatgaatcatttagtaactatattttctgaaaaacagtgtgttaatgagacatcttaaacatatttttgcattggatgcagaagtcttttctgtctggtactattgttgttagaaccctacttttttgtatatagcaaaatgtatgcagggtttctgagtcacacatttattctgttggtggtctggatgtcatcagggtagctttagagatataacccttcttcataaggtcaagagaaaataaacaggagaatttaactccagatggcatcttcctgttttgaggccagatagaaaaatattttgcaaagaactgttgtccttcaaaatatacctatctagattcagattttaaccttgcagggataaaaaatcatatgggacagagctttggagttggcttctttaatcgtactcagttttgaaatagcagaaagaaaatagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggaggtactatagcactagttttactaacgctggcaaataaaattactctaaggaagaaattaaagtacttagtaacttagtgataaggatggtgaaatgtaaaattttatttataagactatacaatttaaagttgtttgccaaatgtaataagacaagtagaatatattctcttcaatgtttttataatttgacactaagaagattttattatatatgcaattgctggtggttagatatatgatacttaaaattttctaattatctaattatttttatttttaacaggataaaatattaatcaacttaaaggacatttctaaggagattgaattctaaaagattaatcttttagacaattctaaaagattaatcttttagacaattctaaaagattaatcttttagacaattctaaaagattaatcttttagacaattctaaaagattaattgaattctaaaagattaatcaacttaaaggacatttctaaggagattgaaaaagcatatatctataaaatatgaaacaagaaaatatctacaaatgataatttatcaactttttttcctggaggtagcaagaataaataaaatcttattttctatgcaaaacagtgcttttaaattaaaattattcacctagaatgtctacagatactttcttcagagtcctttttgttaagtaatctaacatattttaagatactctgataaatacataagcagcagaaaaaatattttattaaaatttatgttttccaaacaatatcatttaaaaggcaaaccaaacattatttcaattggaaactatatgaatgccaaatacccacatgtacaaaatattcagctttctaaagtaatgaaaataattatgataatttatatatcatatctgtgattcttagattttcagattatacaacatcttttcccagataaggatttagtaagaagagaaaaggaaaaaacattcacttttcattcaagccaaattaattaatttaattaggtgctttagggaataatattattgctccaaaaatagtattaagacaaacataacattcattttttgtccaaacaatatgatttcttcaagtcagcatgatttaacatgaagaatggaaacaaaaaaatcacaaaatagtaagctttatgcacatctaaaaatataaaattatgttatttggctttatttttctctaaaattccaaaatagaaaactaggaaagaagcagctaagagtggtttaagacatgtgttagcttcaatatgttttatattatagatcccagcaaggagatgattgagtttaatacattgcttgtgtgatcacaagtaaatttctttcagaattgtacttcgtagtaaggaacagaaacaccaaatgacatgggagatggaatttaaaattaattataaattggaacagagagatttagtttaaacaactaaaataatggaaataattggaaagtccattacttttcaatagtagaatgaaattatttgccttttatttaatatttttggaaaaaattaacttatttttttaaccgaagctactctgaatgcagatatctaagaaatgaagagaataatatgagatgacttacttctaaatcccattttctattctatttctaaatgttgcaaatggctaactagagcatttttattcctctagaaacaaaacattcttttccttgactttgccatgattttcgcacatattactaggtattaaatgaaggtccatgaaacatcaatctaagagctttaactttcagtagaatatattgctaactatattttgtcatgcatggaataataaaggaagctatacaaaactatttttttcagcaaaggtaactaaggtagaaaaacagagaaagggctaattttcagccacaagtttttacaggaactgacttctcaggagagccaaatttatttcaagtggatgtgaaataagttatggcaataaataaagttgcattaattcttattttttaaacattccaactctcttttttttacttaaaacaatatgactttctaaagtaaaacaaaacatacatgcaccatgttgactgtcatgtgcaggtgagaagagaaaaatattttaagaatatgataatttttaaaattgcactaaaataatctttatattgaggcctccgtgttttaaaaagtactataatatgtttctaataaaatttagaaacaataagctaaataacaacgttaatacttataacattgcatttgacccaattttaacaaactcatttacaattttaataagtcaatattgtgctcatttatttaataattagcagaacaaatggaaagtactgtatttctaatgatgtgaggacacccttaatgagacataaacataggaggatgaatacacaggagggaaaagtatttatgttaatttctaggcagatcaagaacatatagaagatacttaaaataggaaatgtttgagcctagctttaactattatcttcatttgtctttaatatgcctttagtattcaatggctgtttttcataatccacgtgctgtattaagtgtgaaaagatatgcctgatccagaggcaatgagctaaaagaatcatctgtacaatctaacaatgcttttgaggatggatctggagggcttaaaatacacattattaatgggaaaatcttgggctgaaactaatctgtaggaatatttcatataaagttgatttggagaaaatttttaagtggttcattttgagaaaaggaaccaatgtaattacagtgttccatgtaattttactgcacaatcttccaaacccaaattttcggaccttttctgcagactggtgaacttagtacttaaatatgaaacgccagttctgtctagagaacaaaatgagtttaatgcatagactcacctgttattactcttcacaccaatgtgtaaatgactgtttgctcttctattaaatatattttccgtaacaccattcaaataggcctacttcatttccactgagataagcattttggtattcagcttttatattcactaagaattaagaaatgctgttttaaaagcttaggaaatgtatatagaaaatatatcccatgttctcatatatgtgtttcagacataggggaggaattagaataaattttctaaataaacaaattatttgcctacttaaaattgcaattaaaaaatgaagctttccttcgttagctgtaaactacattgagaaattgtaacataaaaaagaatggatttttaaaacttcttgagtagatcaagtgtcttgtacaatatcattaaatttgtatcagaacacataaatggaaatgaggtggggaagcaattgcagtactttctagagtctaggttttgaaattctttttggtgaacatttactaaatcagctaaacatttcaactcatttaaacacaaacctaaattattattaccctagacagagagatgatatagcaacgggacctcgaaaaggtgatcttttgtggctgcatgtagtgcccagatggaaaaatcttaggaccactaaaaggcctcttgaccactaggcggcaaaaactaattttgaactacttgcctactcggtagcaggcctctttcaatagacattttaaatatcttggctttgagaaaataaaaatttcaccatctcacaaaaatataaattactgaacagtacatcatttgttgtttgcaaaaatttttgcagatgcttagaaacttattatttatttactcaattactggcaaactatcatactaattgtcaagaactaaagttgtatttaaccacaatacacagctaatgccttaagaattgagaccaggttttgttttggcaattcctaagctgattcatagttaatagctgctgaaatttcagtaccttgtatataattatgaagcaagtctaaaattttggttgaagcaattttttttaccattttaagccacaaatacagatggttatgattcatattttccctattatttttacttattccttgccaatgtttattttaaaaacatctttttcttttctttttggtgatttggaaatgtctttacatccatatgggatatacaatatattatgtcatatcatgttgagctactaatgccaaatagagctaacagtgacattcaatacacataataagttctgttaaaactttcccaggaaaatctggtagagttttatgctgccaagattagctcagttttcccctgaatttctcaactaggttgataaaatccagaaagtcttcagagttagtgacaaaatcatctctttagtttaatgctcccatctgctgttaaggcaaagaatagcaattgggtagaagagcttattttcaatgttcctttaataaataaatgtttaaatgcttgtgtgatatacattgatgttaattcttactataaatgaaattaaaatatctgctggtcttaaggaaaattgactatggtgtgccaattttatgttaacaagcagatatgatattttaattaatttcttgctacttagcaaattacatagggcaagtataattttctaatgaaaggaagaaattatttgtttcaaaccttttcaactttggctattgttaatagtcctaacagagtaacaaaaatcacctttcagcaaaacctaaggaaacttcacgtcatctaacttgtttttcagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctgtgagtttaaagataaactgtacatcttcaatattcatatttagacacatgaatagctcctatatcataggagcctaaaagggaatgaaagtcatgttcatcaaatagccatgtttgtattacgagtaaaaagtgaccgtttcaatttaaagataaggattggttagaatctgggttactaaataatatgcaaattctgtgtcttgtttaacttgtttcttttccatttattagcctactcgccctcctaatggtcaaggacctcaaggccccaagggagatccagtaagtaaacattcttcagtagaataaaattaatactaatgataattctagtaagagtttgctttttctagatttgagctttcatcatacattctcttcattaccacatatttgaataatggcaccaaacaacagactgagaatccataattgtacgtgtaaagatttcaatttcccaaacttcatattatgtcttcacccccatgatcagtttaaagaaaatgtgtaggtcaatatacaaaggaatacattatacttaaattattcacaagattttgattaaaaagtatgtgttataaagaaaatatattacttatattgtttcctaatattataaagtagagaaacaacaatctgataatgattgtgaatcaccaggatttttcactatttaatttatttttatctcttttttagggccctcctggtattcctgggagaaatggtgaccctggtattccaggacaaccagggtcccctggttctcctggcccccctggaatctgtgaatcatgccctactggtcctcaggtataacaattacggtacttaaaaaattccctcataaaactatctagttcatcttctttctttactcgatattacgtctcactattatgagttctttgtatctgttctctgattcagtgtatttaataaatccttatttagtgcttctatgtattaggcactattctaagtactttataagtattcatttttcctcataatgctaatgtcattgctactatatccttggaaaatttgctaatttctcagcagatatatagcatacacattatgtttaagaagtgaactatgaacttaacaaaaaaaattaacctaaataatttagttagtactgtatccatactttattctcctactaataccaatgtcaaagcctctaaaagtttagacaaaaagaagttgaagaactgttagtattcctattgaacaggattatttctgcctatgaaactgctcttgctaatacttcagagcacaccttgcttctcctgaagcatggcagccaaataaatctgcaggtaaaacaaccaaacaaataaatatgacaaaatttctgttgcatggaattaggtgaaacgagaaaatatattacacaaatttttgtgaggttaaaaagtgcatttcaaaaagcaattcaacaagaaccaaagtatattgtctaagttattcttattctagtaaccaaacagaacctaactctagacctggaacttagaatttaaaaaaagcttcaaagaaatctaataagcatatgagcctttctactattttttggtttattttctatggagatgtttatttttgagtgaatcttttagtcatattaaccagaatccaggggatatgaattttacttgtatcattaagtgtttgaaaaataatttgacttcatttttttgctcaaaatgagaaggtgtattatatgatctcgagactcttttggcctcaaacagcctatgatcctatgtttgtaatgatgtagctactgcttagaaataatagcttaagtaagcgcataataggaaaaattggggggaactaacattgaacacagtggaaagatttgtgcatcccacaagaaaatgcttctgtaggatatctaacgtctaaatctacagaaagacacgataaacaagataattagtgaatacataccacatcttttggcacacaaaaacctatcagtagacagtagatgttgcatgcacttctaaatgctttttaaaagaattatgaactgtctgttaaaatgatcatatctatttgtctccttgccacagaactattctccccagtatgattcatatgatgtcaagtctggagtagcagtaggaggactcgcaggctatcctggaccagctgtacgtacaaatgtttctcagcattttggagctttattatctttctggtttgtaaaatcttgaatggttgctcttctaggaattcagtatttttatggaattgtacaaaatagcttacccctactaaggttggaaaagaaaatggtagcattatcatgttctttctatcttattcatattattaaacctatttttaatcacatataaatttttactaaaaaaaaaaaccaaagtcaacacttattaacatctcagaaaagtgtttataagagaaaatggaaatatacaaactattgttttataaatttactatcagtatttagaaacagcatgttacaaaactgaagcatactgttttcagcttgctgaaggttttctagtttaatctgtatttctgaacaatgataaatcaattgtcctatgtatgatgattcttgcatgatcatataaatctctatgtcaattaactctgtgatagatatatcaacataattatgggacttttgggttgatttacattattattttagatacttgattataggatttctagtgtgccaataaatgtttttctgcactgagtttggctgccaagcgagaaattgcttcttcaccagtgcaatataaccctaacattgcagggattttcatagcattatgtactagtttttccagatttttaattcccttccttaagagttcaggacaacattttataacatttattaataatttatatagaatctgtgagaatttcattacagtaatgtttgcttgctaagatcttcattatagatctcatgaatagttatcaaaaagttatcaaaagatgagatatagttgttcatagttttaacaatgcgagtgtcattgctttgaagcatggataaagtgtattttgcattcatttattttgtttttcattcaaattcacattccagggccccccaggccctcccggtccccctggtacatctggtcatcctggttcccctgtaagtatagccattggtggtgttttcttcctcatttttagaaaaatcaaattaatatatattctgctataattcagccattccagcatgcataatcccagttaactagagaaatcataaccaagaaactgattaaggcttcaaagatggaattccatatttaattcctttccaccaacagttattagcaattgaaatcttggtaaaattaaaccacattaatttgcatgtaatatgacttttagttcaaaaccattcagttttgatggattgcaatgaatggaatgaaatacattaacttcattctgatctaaaaataatttggtctcaatatttataaactggagtaaaatttgctgattacattcacaatcctgatttcttactgtcaagatgtaaatgaattatatgaagattttgttactttaaaattatttacatattctactcactagggatctccaggataccaaggaccccctggtgaacctgggcaagctggtccttcagtaagtaacaattaaatttatatttagtaagtcgataattccatatggaacctacctttgttttctaaaacaagtataggtctttacagaatgaagattaaatttacccttaagtttgtaaataacgaatagcattttattgagtcttttggactctttcaattgttagctatcttagagacactagttaataaaggaattccctcatcattagccatcaaaatagtccacttcccagagctgataaaaattctgtatatattaaatatagatttcatttttctgtaaacactcagttcactcatatctaatctactgataaatatagttatatatttacatatgtaaatatacatatacatatatcttagacagtagaaataaacataatcttagagagtcctttagaaggatatgctctgtaaataagcaagtaaaatagtttaaatacaacatttcatgacatttagaaatacctttatatttagatatatttaatattcctaaacgtgtagaaatgcatttggatttataaatacacatacgtaatatatgatgcttttaatttttattaacagtaagttgatataatagaggtataatattaactcagtaagtatcattttcattatcagaaacattaaaagtattttctaaaaggaggttccttccaggaatacatacactgtgtaataataaattgtaacagaaaaatttacaaatctattcattttttatttccttattttcagggccctccaggacctcctggtgctataggtccatctggtcctgctggaaaagatgtaagtttttaaaacttaaataagaatacagcaaaatttaacttggtgtattctaaacagtatatgctttatgtcagaatcccagaagaaaaaaaaatgttattcaaaatattgttgtcttaacaacattttagttaatactaatttttgagtagctatacagtatttgcgtttctatatatatcatttgttgaattccaaaataaaatccttaaagtgctttttgactgcggagaagactcatccattgaatatattatttaactggaggagaaataggtgtctctgcctgcctcttttaatgatgaaattgataccactatttaatgaacttgagaagttatagataccttcaattcaatggcattccttctttccctcttaatctccaatggcaaattcttttcactggcttatgttatttcagtgattagaagcacctgcattatctctttataagcttatatcaaagtgggaaaggtcttcctcatgccttctaccaagaaagctgatctcaactatacattttgtggaaccattttaatgagtcctttgtgagaaaaatgcaaagtaaccattttgcttattggctacaatgtattttctcatacatgagcacctacgtattctttatttctctacctagggagaatcaggtagacccggacgacctggagagcgaggattgcctggacctccagtgagtcttcagcatctaataaattaattggaataatcttagcttgaaaactattatgtaattcaatggaattaaacttaaaaacagaaagtgttttactactagattgtgattctatttgaaggttcattaatattttttcattcattatttttagggtatcaaaggtccagctgggatacctggattccctggtatgaaaggacacagagtaagtagagtttctaagttgtttacaaggtattccactgggctatgtttacttgcctaaccaattttactggacaattatgtgccaaaaaatatgattctgacaattaattaatttgatatttttaagtctactaagtttgtttgttgaccaaactagtcattttttgcaaaataaaggagttgatttctagtgtataaagtactcttgaaaaatatcgttttcttactaccactatcagaaaaataaaaacattttgtgaattatgttttttattgacttaatatgatttatagattgagttgaacaactttattctatgcaaaatatttcgtacattcaaccaactgtgcctacaacctatcaactgaattataataaaatctatgaaactcatgtttgctactctatagttaaggcaactttcttatcagactaaattgcactttctagttttcatgttttcctgttgtaaaatcagtatgaaatatcttcaacccctttaaacaagttttaaattatttaagctaattttgcaagtagtgttatgaagaccaattagaaaaataccatgtaaactttatcaatcattctagattattaacagattttaataattttgctggttttatacatttcctagggcttcgatggacgaaatggagaaaagggtgaaacaggtgctcctggattaaaggtaaatcacaacaaaaatcatattttcataagtaaattcattaaatattaaagctacatataagattcatattgtgagccttaacttgttttctgaaatttacctgaattttacctattaggtgtgaataatggtaaccaattcagatattctattaacgcttccatgaaaaatgacaacttgaagagtctagattagaaatagttgagcatcttagtataacttatcaattacttcactttagtctttaagtttttaaatacagaaattgagatttctggtaaataaaatactaacagaaaattaatattgttaaaatgtatatctttttctaggctctataaacttttccataatattctgtatttaaaaatatataatattttcttcctcttttgtaaaatagtaacatattttatatgtatctagggtgaaaatggtcttccaggcgaaaatggagctcctggacccatggtaattatgtttcttatgtataattttcagttttattattaacctcattgttacctaaaactggctttgctcccaccccaactgttcttacacatgtcaagattagagtaaaaccatatttcaattttactctgtagggtccaagaggggctcctggtgagcgaggacggccaggacttcctggggctgcagtgagtatagctgctaacatcacacaattacaacccaaagtgacagatttttacagcctcagtaaagtttcaggctgtaaaaatatgttaggaaaaagaccttcctacaaaattatactcaatgatactgtgataaagttttggctatagttaaaaggaaatgaataattgttttacaattattatctctattgagaatttttgtgttaacttttcatatgtcatttgagccattatatctgcattcagtcctgaaaacacagactccaatccttctacatttgattgttgctgtatatatcagaattgtaataattgactttaaaatacataattattaagcagattttaatgtacttgaagaaaactcaactcacttgagtcagaattttggtcaaaatattactcatgaccagccattcagaattaaaaggatatttgatgtaaacttctctttttagggtgctcggggtaatgacggtgctcgaggcagtgatggtcaaccagtaagtaactttctatctcttatgtgttgtagggtaatgagaagttatggattgtggattatttaatattttatatatgtatatactcttaggtatatatatatgcatatgtatatctctaatatacacattagcatctctgttgaccatttttacaatttaaaaagtgaaaaaatattgtagccccaatacttaatattgtatatacactcctgtgattaaaactgacactgagcccataaacaaaatctaggttctgacactcattctgcttgatcaactgctaacatttgaatggtgctcccaatgttagttaatatcctatgtaagacatggcactttaaagagtcctacaaaatggataaaatagatgttacctccattttgtagactggagtacaaaagcccagggaaaagtagcctgcactaagtcacagaattcatggcaaagtagggagaaaccaagaatttctaactttagatttcactcttttcttattttaccacattgtttctctacataatatccataaaatatgaatatcatttttatctgcataaatatcttctttactttatatgtgctcacttatttactagtatgtcagctttcatttagttgaaaaagagctcttgaaattgtatttaattttttcagggccctcctggtcctcctggaactgccggattccctggatcccctggtgctaaggtaaacatgtgtttctatagaagggtataaaaatatcttggaggcaagagaaaagcattagattgcttcttgcaactgatttttttaatcagtcaaatggatagcttttatctatacatgtctttaaagccctattcttgattctaaaagaggtgttgtccctagtattcaactatcttgatatttcttctgctaccttctttttttccccagactctttctaggaaactgataatgcaatcacacacacatagttacatttttctctgcctttacgattaatgattccttgctttacctgcagtatagagtcccactactccaacttttgggagatgtgtttaaacaggactgaagggtgaagtggctaagtgagtagaagtggtaagagaaactgactacacaaggttttaccattagggtgaagttggacctgcagggtctcctggttcaaatggtgcccctggacaaagaggagaacctggacctcagggacacgctggtgctcaaggtcctcctgtaagtatcatagttgagagggagtaagcatagtttcatgcttactccatgaaagcatagtttcatgcttactccatgaaagcatgtgcttcaatatggctatcagtgaaaattactttgaaaaaattgttgcttagtgctctaaaatgatcctcctgtgacacatactgatttgattagtagtaaaaatgatagtttttgactgttgcactattccagaattcatgattttttatgtttatataaaagaatagaggatagactagttttctgatgctttcaagaatgtgccccaagctaatcaccaatcataaaaattcagagaagaaccaaattcaaaatctcttctatttatgtatcatttaataatttatacgaagtacatattatctctaatttatttagataatgatgattcttttgaccacatttcatatgttgtgttatagttggaggattcacttaatctctacaaagcataacactcatcgatacatttattttcacacaaacaacttcaaatatatacgaactatttgcattactattaatacattatctgttttttgtatacttagggccctcctgggattaatggtagtcctggtggtaaaggcgaaatggtaagctgtccccactcctcagccttatctcatccacacattactggcttcttttgcattttgcatgacaatagatttgtgatatttaagtgagatattcataaaagaacattcaagttcggctaatatagtgtctttggtttgttcttagggtcccgctggcattcctggagctcctggactgatgggagcccggggtcctccaggaccagccggtgctaatggtgctcctggactgcgaggtggtgcagtaagttgccttgttttttctctgttgactgaaaggtatagtttaattccatcaacaaaaaattaatagcaaaattttgctcctgttcagttgaatttatattgacttcactcttgtcttataacttataactgaattatgtgttactggtgatgatttgttagtcgaatcctccctgtgtttcaaccaagactttgttatactttagggtgagcctggtaagaatggtgccaaaggagagcccggaccacgtggtgaacgcgtaagttttactgcaacagatctggttatttcttgaaaaaatgcaacataattagaaagtaaacaggtaaaaactttgaactaaattcagtcataatttctttattttaccatcttttttttttttcagggtgaggctggtattccaggtgttccaggagctaaaggcgaagatggcaaggatggatcacctggagaacctggtgcaaatgggcttccaggagctgcaggagaaagggtacgttttccatggggcatctaaaagaaaagcagcatcactgtcatctaaataaaactaccttcagggtgagacagccaatttttcttaagttgagtgttcagtgaaaatattgtttaaagcattctatgacataaaaatatttgccactcaagaattatgaaaaagaattgaaatcctttggactgaaatacttgtctttcattattttcagggtgcccctgggttccgaggacctgctggaccaaatggcatcccaggagaaaaggtagataactttagtttctatgttcctaaatgctagcaccacaaatgggcagttcttgtatacaatttctcattcatgaaaacctaaatatctgaagaatatatattagagttaagaaaaattcctaatataatgcatcctctgttcaacaactttcctggctttgtaactaaagccacttacttaccctctatgagaatcctttacttatctgttaattggaaagcatttatctgagcatcgttgcaagagtacagtaaactaaaatgcctgaaaagtctttgaaaactctaaggttacatcaaatatgatttcatagcattaagatatttgattttagctgcacataattatatttttaagcacagtgaatactgttttattaagcatgtgatgttcacaaagttgctttaaaattttttcaatatggcaatccaagctaagataactgattttatgtataaatgtttcagcaacacacgaaccctttttaaaagttcaaatgacgtcctctctttgtaaccaaaatattgttgctatctaggttagtgaaggctattttaatttttttaaaatttctttcactacttagggtcctgctggagagcgtggtgctccaggccctgcagggcccagaggagctgctggagaacctggcagagatggcgtccctggaggtccaggaatgagggtacagagaaacatttgtttgaatgacactttaatttagacagaagaaaggcaagacaaatgaagacagatcaaaagcaacttaaatcaatcagattacatattttgtaaggcaccaaacaaaacaaaattcttttaagtaaacttaagccgagatagttcaaggagaagagaagatagaacacttgccttagatactttatagacaggaaaaaagatgtgcaaatctgaggcttcacatgtaagtgaaaatatcaaaatcatacaaatagtgtatgtagtaattttttattatttcattttaaatcacctaacaactgacttctttacttcagggcatgcccggaagtccaggaggaccaggaagtgatgggaaaccagggcctcccgtatgtacatttttaaaatctcattttaaaaggccagttaaaatggaatgtatatgttggcctatccttgagtgtgtgtgtgtgtgtgtgtgtatatatatatatgtatatgtatatctatatatatacacacacacacacacacacacatactatatatatagcatgctttaatcttctctttatcaaacctttattaatgtaattttttcttattagggaagtcaaggagaaagtggtcgaccaggtcctcctgggccatctggtccccgaggtcagcctggtgtcatgggcttccccggtcctaaaggaaatgatgtgagttccttcattaatttcttcaataaatatttgactggaaggcttttattttccatatggagtaaagaaatggtcaaaactcagtctcctcttcaaagcatggaggagtatatgaaaatcaaattgcatgtaggaagggagctaaatatataattggttatggttgtatgtgtgtgtatggagcaggcagataaaaaatatgaaacaggctgggtgcgctggctcacgcctgtaatcccagcactctgggaggccaaggcaggcagatcacctgaggtcaggagttctaggccagccttgccaacatggtgaaaccctgtctccactaaaaatacaaaaattagccaggcatggtggcatgtgcctgtaatcctagctacccaggaggctgaggcaagagaatcactagaacccggggggcagaggctacagtgagccaagattgcgccactgcactccagcctgggcgacagagcaagactcagtctcaaaaatatgtatgtgtgtgtgtgtatatatatatatgagacatatatatatgagacatatatatatgagacatatatatatgagacatatatatatgagacatatatatatgagacaataatatgattagttattgccctttgaggattagtaaataccgaccacttcttctttagggtgctcctggtaagaatggagaacgaggtggccctggaggacctggccctcaggtacgtagctttcctcaatttatttctagccttctaatagatgcgttcatctccaaccttctgacttctctctgtaatctgtattatttctacttccctaactgttcttgtttttagggtcctcctggaaagaatggtgaaactggacctcagggacccccagggcctactgtaagttcactcatataaaattggagatgaaaatagggtggaggtggggcaggaagaatgcttcaaaaattacataatctctgacaccatgttgttacagtttaccaaagcaatgatgaaacttgctgacctagttatctagctaaatgctagcattgagtttagagtgtacatgtgtgctttgggtccaggtcctcccttttcttcacatcactacttttataattaagcaacaggcctgttgaaatggatactgtagactaaatataaaaggatgtttacaacagagtgtatcattatacttttctaggggcctggtggtgacaaaggagacacaggaccccctggtccacaaggattacaagtaagaacttgttatttaaatgtcacggcatatctgactgtcaaatttttttgtgtccctaatagattataatttatctgaagcttaacttgtgattctgtctttcatctggaaataaaattttaggcaatgttaataggtaggcatatcttccatgtccgttccagagcacattaataagttatttaaaagaattaatgaaactcaaataattctatttggttacacttatttttattataacataaatccatatagccaagtctatcctgccatgctggtcaatacatttttacgtgtagcaattgaaagaacagagagagatgaaaatgggtttgtaaaatatgattatcacgtatgtgtcactggattttgagtggcacaacgtttctacccctacaagaccactggaacttttttttaatatcttgcagaaacatgtgtacatatgagaagcttttctataagccatgtttgaggtaattacctaatacaaatatgattctttctagggcttgcctggtacaggtggtcctccaggagaaaatggaaaacctggggaaccagtaagttacgtttcattattcaaaactcagaaacaaaaagaatacacactgtttgtttgtcaactattaacttcttaattttcttatgccatgatatttgagatttaacatttagttttgaaatattatcaaaacaaagacaaattatttaaaagataactattatatagagtttgaattttaccataaaatagagagttcatagtttcaagatttgaaaaattatacagtatgccaacatgacaaatgtgtattttgcttatatttacatatttgcttatatttacatatttgcttatatttacataaaatgcactctgatatgggcctaatcatataatgccaatctcccagggtccaaagggtgatgccggtgcacctggagctccaggaggcaaggtagtatttcaatttattctctaccttcttcagcaggttatagagcaattgattagtagtatatttttagtatatcaagccaaaatactctttctttaaaagagcatcattgcaaatgtttggtaagtacacttagagaaactcaagacactttcaatacattaaatttgctttaatctggaaggtccaattctctgacattcataatcactacagaatcaaatacgggcttaaaatttcaaacggaaaaatattgccaatatgttgattctatgtaggaaaactgttttggtaaaaagaactttaaaatgttgctcttgtgaataaaataataagtatttcaatgacagctcacacttaaccagactaagtatccaagttttattttagacactcttttaagcttctagttcccacccagctgttcaactatttttaagtatacaaatttctagattgttcacaatataataacctagtggcctgattcaaaatgatgcaagttaaggtgctttgtttttagctttgggttgtctaatatggttatttacatatttttgtcacagggtgatgctggtgcccctggtgaacgtggacctcctggattggcaggggccccaggacttagaggtggagctggtccccctggtcccgaaggaggaaaggtaactccacagcattccattcacctaggtttaaaaaatgcatttgatttccttctgatcatttattatttctcacttattttcagggtgctgctggtcctcctgggccacctggtgctgctggtactcctggtctgcaaggaatgcctggagaaagaggaggtcttggaagtcctggtccaaagggtgacaaggtgttgacttgttttctcttaattgttcaataaatcagtcattgtaggttttaaaaaaagcaacactcctggaaagtaatcgactgtattttcaaaattaatgttatcattttatagtaagtgaaatttaagatggattcctaaagcaacaatgaattagaacacccaatatatatccctacaaatcctgagagttactcctcttcttggctgattttcactgaagatactttgaatctgatgacattggcttttatttgacagggtgaaccaggcggtccaggtgctgatggtgtcccagggaaagatggcccaagggtgagtattcccagtgaggagaagcaggccttatctatatgtcatatgggacagtcctgcacttcaactttaattttttccaaaaactactcaagagaaattagatattttaccacctaaagacccgaatgacttgatttataatgaaatttgtggtctatatctatggctacttgatagatctacagtgactaaagaatgaaaaagcctcaagagtacgataaaggtcacaaactagcatttgtgagtcactaaaatctgagataatcactgaaatttaggataatcaatgctgctcattaagaaactaaaagtcatcaaaattcaatatagtaagtactcctcattaatagacttaatatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatggtgattgcacatttgagtatcttgattgaggtggtagtcaggcacatctacacatgggataaaattctatagagctacatatacacacacataaatgagtgtgtgtatcactggtgaaatctgaacatgctctatggatggtatcaatgtcaatttcctagttttgatattatattatagttgtgtaagatgttaacattaggggacgctgggagaaaagtgcacagaatttccctgtatattcctttgcagcatcctatgaatctataattcaaactaaaagtcaaaaacaaaacaaaaaacatctcctaaatatgattataattaagtcttttaataaatttatataatagttgccttaaagaaattcataaatgcttcgcttttgacagactaagtagataagccgtcattcaggtaaaaagagtgctcaatacttcagttttgtaatataagtaaaactactatttgaaaatttcaagttgaaaaatttaatatgtacaatgagactttgagaaaacatttaaattatcaagcaattgaataaagaaatgtactttaatttaaaaagacattactgtaagatcttacatgacatcctatttatcttctacaatggagataaagataaatgaatcaataaactattgctgaatcctattttctcccagagttatccccaaagaggcttgtgtttactgagctctgcagtatttacacattgagagaaaagcatagcattcaagccataaaaatttttaaaaagtatgttatctagtttattaggtatctatgtctatatactttctgtttgattaatgcaaaaaacgatatttgtatcttcaaaattaaaaaatatttttatttcctctagggtcctactggtcctattggtcctcctggcccagctggccagcctggagataaggtaacccttaatactacctggatataaaaagaaaatgtctctctcttttggatgcaagacagtgacatggcttctctttttccagggtgaaggtggtgcccccggacttccaggtatagctggacctcgtggtagccctgtaagtgttaaagacattctcaacatactttttaaccccatacagacagtagctacttatgcttccctttttggcagttttgccctcagttccctgagcctcaatttggagatattatcttcaaaaaccatataaggaaccatatagcatgcaagggaatgttaaatttcttaaatctaacattcacaggagaccattttaaatcaggatttctttcctaaataactttggaaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcttgcaaataatatcacagtaggaggcagaaggaatcaatggttctggtattttccactcctaattttattgagaagtggcaaagtcttcagaagtttattggctactctgcacatttcctgcttaaaggaaagaaaagataagatgataagatgacatttcctgcctaaaggagatgacgcacacttcactgtgactaaggaggatatttttctcttcagggtgagagaggtgaaactggccctccaggacctgctggtttccctggtgctcctgtaagtgtgaatatttatacatacatgtcccatagcccaggatctctatcttgctgaaaaattacaaaagtatagtcaagtttggtttctagtctcattttagctgctcattccctataggattattgtacccctattttgttttactttacccctattgtcgctctttgaaagatggaaataaaaacacctgtcctgcttttatgactgggtaatgaactaaagcagtatcatggatttaaaagcactctgaatttttgtaaattcttccattataagatggtactaattaaaattttctcttaaatccggtctttctcaaaaaaatttactggtgctgattttcaaatgtttaatccttagagacacttcctccctccctaatggcaaataatgcacagtttatgctttcttggtcatgttctttgatcatgaaaatattttgattggcttcattttgtcatgtcttcagaaagccttgtttttaaattttatttcaactccttccatctgaagaattctatattctgaagagaaataataataagccaattgtatcataaagagtgtcagctgagagattgctgttgttgttgcatgtagggacagaatggtgaacctggtggtaaaggagaaagaggggctccgggtgagaaaggtgaaggaggccctcctggagttgcaggaccccctggaggttctggacctgctgtaagttccttcctctttctctgtctatctatctatcatctatctatctattgattatctgtctatctctccctctctctctccctctcccccctctgtaagtcctaagtgttctaatggaaaaacatggaggtttatcagtaatttaatattttatactgagatagcatgtcatagtgtcaagaatataatctttatatgaatatagtccaagtatgaatctcagcaccagcaatctaaaagttattttaacctcttcatagagttcctggttttcaaaggcttaatgcttttcccaaattttgattttggtgctattcttacataatttccttccatttcatatagggtcctcctggtccccaaggtgtcaaaggtgaacgtggcagtcctggtggacctgtaagtattgatcctcttaactattattgaaaagcattaattgatatcaacctgtataaaagctgcatttgagacactagttccataaagagaatgtaaaaattgtaatcgctcattcatacatgagttatatgtaaattccaaggggaaacacaaaccataaatgactttcaggtacaatgcagatcatgccacacattatactttttgtttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagtaaaaaaagaaagaaaaaatgcactttttattataaatattcaaatttcaaacaattatttgtagggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccagtaagtaacttcatttttttaaattgattctactattttgatttttatcacaaatcgattagagaaaaacactgtcacataaagatgagctaagtcttcattatctgtattagggagctccaggcccacttgggattgctgggatcactggagcacggggtcttgcaggaccaccaggcatgccaggtcctaggggaagccctggccctcagggtgtcaaggtgagtatagtcattttccactacactcttccttcctttggtagccttcagagatcacttaaccatatcaaggatgaaaagtttttctgtcactggagtaaattagccaggagataatttttttttatttttagatttttaaaagcataaattttaataaatggctccagaacacaaaacagggcatatcatagacaaaccttgaatataaacacaaataaattaatatgatgaaaacaatattgccatctcaaacacctcttttaggaaacttgtgaatattcttcaatttgttgactgtcagttttgaagggggaaatagtgttagcttatagatcttggaaagtctttcattaatgctagttatccatccattcaagtcatcttgcactcctgactctctttcactagtattatattcctataacattctagtgcttagcatctaaaacattcgtttggtaaacaggataataaaattgcatttttattagggctcgtattatggcactttaagtacttctttcaacaaaatgttatgtaatattgtcataaaattaatatttcatatttaagtgtgttcaattgatatgatatttctggtaagtgtatattcttcagatagagacaaataacctaattttaaggatcaccatacacctctagtttcatgatggctcattattgtttttccctatactaatcatgtttatgtattcatctcagattacaatgtacagtattctgaattagataatcaatgtaactattcagccctttgccatccagagtcactgagcaagttagaaaatgcaagaagcttgctcccccatattttttcccatagcaggcatagttttaattttaaaattcaatgaagattaaataaaataagttttttacctgaaaataaagatatctgataacaccattttaattgatttcttaagttgaaacaaaatgtttttcattcctttgtatacagggtgaaagtgggaaaccaggagctaacggtctcagtggagaacgtggtccccctggaccccagggtcttcctggtctggctggtacagctggtgaacctggaagagatgtgagtagcagtttttattcaaccagccaggtagaatttgataatttatttcagcaaaggtgaaattgagctttaatgtctaagagtgtaaatatggccacatagcaaagttcttctatctctaataacagaaattctttcattacaatttaggatagacttaaaagctcttgttcattagtatttacccaatgaataatcatttgtggagaaaatattatctctaactaaattaggaaaaaagttagtggggagaaccacaattgacatgttttctgagtgaaaatattctacggttatctatggttagtcttttattatttttaaagaatttaaaattaatattatttataattaacaaatcataattgtatacatttataaggtacaatgtgatgttttaatatatgtatacaatgtggaatgattaaagcaaactaattaaactgtagatttccactaacagtttagatcactatttcttaaacttttatttattagaggtctgtaaagactctttttggatatcatttttctaatcacctctcctccatgaatacactaactatctgtctggacattgtgaccctttgaagggccacactgctttgtaatatctaagatttcttacccccaagaaccaattttaacccccttgagaattatattgccctgctgagaatgcatggatgaaatggcatttggaaggtttcaagaaattttatttcctttctcattttttaatcagggaaaccctggatcagatggtcttccaggccgagatggatctcctggtggcaaggtataataaacacatgtgcaattgatttgtgttatcaaaataagtgatcatcatgtttattttgtacctatgaatttgttcacagggtgatcgtggtgaaaatggctctcctggtgcccctggcgctcctggtcatccaggcccacctggtcctgtcggtccagctggaaagagtggtgacagaggagaaagtgtgagttcccaaaagcagcatctgtcttgtttgtctatttccttcaataaagacatttgtaggtagaaggtagaatgtcagatctgccaaccaaaatatccactgtcatttgttttacagttttaatgctagttgttccttagacaaatgtgtgaataagtcaataccagaagtacttggcagtagtcaataaagaattcattactgaaacccgaaatcatattaatcagaccaactatctatatgctgggtaaatgcaaggccaagttaacagggctcttgcccaacttttctgtctagatcccctgagaaagctataaacagggctttagcactttgaaggcaaaaacaatattaacttccaataattgcatgcatactataattctattataatgaaattatttacttttgaaaacgaaattgtgtcaacacataaaactagttccgtgtatgtcttctcaattgaatgttttcatcttagggccctgctggccctgctggtgctcccggtcctgctggttcccgaggtgctcctgtaagttttgtcattttttggttttattttgttttgttctttttttaactcattctacagtgtaggaaatattttattttccagcgtgttcaggaaaaaagaatgaatatatatatatatatatatatatatatatatatatatatatatttgttctatctatagatagatgatagatagatagatagatagatagatagatagatagatagatagatagaacaaatataaactttcctttaatgacaatgatatggaaagcagttcaggatctaaaagttctttggagccaaggatagaaacatcagttgttagggatccatgcaatgatcagtccaaaatgaaaacaaccacagaaacaaatctcatttcctatctgaagtgtctgttgatgggggattttttagctgatagaaagccataaaatagatttaattattataaattctattttatttttccaatatgtatgtgtgtatatgacttcaattcaaaatatgtttctaaagggtcctcaaggcccacgtggtgacaaaggtgaaacaggtgaacgtggagctgctggcatcaaaggacatcgaggattccctggtaatccaggtgccccaggttctccagtaagtgcattcattttgttggaaaatcccttcaatgtatacaaattttagagattaagagaagaaagctttccatctctaaaaatatgtactagaagagatgagaaatggatttgaaggctaatttgaaacaacaatcagcatgacacaatgggaagattaaagaaagaaaaaaaatttcatcatgatccccatgtttcttgatctgatcttgaatgtacagtttcccagtgctttttaaggccttcactcctatgtacacttcctttctttccagggccctgctggtcagcagggtgcaatcggcagtccaggacctgcaggccccagagtaagtagcacagaaagatattacaggtccacatgtttcagatgtctgcatttcagaaagatattctggcattgtgatgtcatgatactttcttagggacctgttggacccagtggacctcctggcaaagatggaaccagtggacatccaggtcccattggaccaccagggcctcgaggtaacagaggtgaaagaggatctgaggtaagacatcacttatacgtatgtgtatttaatttgctacaatcttccaattttcagaaacacagcgcattatgtttaaattgaaatagagagacgcaatgcatccactcaatttagaaactgaacaatgactttaagacattctccatcacattaaaaatgtttctaccacactataacaggagaaaaatacctttttaaaaatttgatcaggtatccatcgtatcagaataatgacatctgcccaattaaccaaataaaccctgtccacattgctatcccactagagatctcagaattacaacattcataattatctgcgtttatgtagtgcattttacttctcaaacagcttccatggttactattttgttaatgatactatcattcctaatactttctattccatgcctttgggtaaatgaaataaaaacaattatcccaacaaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctcaatgatccatgttttactcattctagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggtatgtttggtagtctttcatcttcatggcaataggattacagagaaagctgcttagattagaatgggaacgaaaaaacatctactttcaatggaaagctgaaatagtactttaagaaagttaactgaattgaaactgcttgatataaaagagtaaactttgcagatgtaaaatataacataacttcagatcatgccaaatacagaaaaatataaagacatttttgtagaagttgtagtataaattgtaagttatttgagtataaagtaacatatctttttttctcaggattaaatatacataatttgatgcagacaattataatctgattattgtaatatttacttattgcaatgaatctaattattaaaattttcaaattaaacaagtgaaaaatttcagaatactgtataaaattaaatagaatattgtaatagtttaaggttttgcatatattgggttaaatatttctgaaaagcaaaattatttcaagttttcaaatatcttgacatggaacactgcctttgctaggagtcatttctagaaattacttaaaataggagacaagcatcaatcatagggatttcagctttagaactattggaacaaatctaggttagacaaccagcttatattattaagcaagattacatataataatcatctttttttaaaggagagacttttgcaaatattatacagcaatcaaaaggtcttagcttagtgtatcatccttattagaaaccaagatgttgcattttatttcagtgctttctgtagtcatagctaactcttttacctcagcaatttcaatcaaaaagcttctctatcattctatacataaaatgcagacacattagcagtcaacattatgaatgcctttacaggtaaacaaacaaaatcactttattactggattttataaccaattcccattcttttttgtgactattcaggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattctcctgttttttgtcacttttcaaagatttaaaaaatgcacgtctacattaaggaactccagtaatcttgaaaaagtatattgaattctaactctatagattaataatgcaataatttttaagaatataaaataatataacatatattcagagtagagataatgctcaatgaggaatcctgcagatttttagatcatatttgcaggaacccctgtgggacatactggacactgagggcattctgtttgaaagggtcaatccttggaaatggtaacacagtaaatcaaggtattcccaaactgggaataataagggaggaagatgttgatagtttatcagaaagtaattgtaatacgggtctattgaaatatattaatattaagaaaaattgacaagtaccacatgatctcacttctatgtggaatctaaaagagttgaattcattgatgaagaatagaatggtggtttccaagggcagaaggtggggtggggttgggagattttagtctatggatacaaaattgcagtaagatagaagttataagctcaagagatctattgtgaaacgtggtgaccacagtcaataacaatgtattatatttttgaaaattgcgaagagagtaagtattctcaccacaagaaatgatgagaacctgagatactgcatatatatgcatatgtatctctgtcttcctacatatacatatatatacacatacatatatgtatacacacacacacaaatatatatatatatatatatatatatatatatatatgtatagagagagagagacagaactcaaatcaatagtatgaattaataaattagatacttggagttttattttagaccaagaaagatatctggaacacaatgttctgcctcctgtatttgtaacttaatgtatcacagagagtagttcatttcattatatatagctctaacttattgtgtgttattgatcccaatactcagtttaatgaacacacgagttaaaattacttgtttgcctatttgtttatttatttgctaccaagtatctaaagccctatctcattgcagggaagttacagttagatgagtcttggttgaggttagaggccatagacagttgctttcctaacctgtcttgagttagggtgtaggcaagtggccatgtgacctgagcttggcaaatcagagacacacacctgaaggtctcaatctggggataattgtattcacttcatattactgctgtagcaagttaccataaatttagtgacttaaaaccacacagatttcttgtcttacacttctgaacatcaaaagtctaaactgagtcttactggactcaaatgcaagtgtcaaacaaggttgtcttcctttctagagacactagggagaaactgtgtgttcccttttccagcttctagaggctgcccagcttccttggttcatgagccagttccaacatcaaagccagaaatatttggtcaagtctttctcacgttgtctcattctgacattggctcttctgtcttcctatttcacttttaaggaaccaaatgattgcactgggcccaaatggatactccaagctactctccccatttcaaggtcagttggtaagcaaccttaatgcctgctgcaaccttaattgctccttgccttgccaaaaaatgtaatatatttactggctctggggattagggtatgaacatatttgagggagcattattccacctaccaacaatagtgatgcaaagaagtaaaaagaattaaaaatccagtttggtggtgatcacagctatagttggggcagcaaccgccagatatcaaaagaagcatggccaacagtgccagaaatggcatccagtgtcttgtgtttatgatggctttgccaggttgcttttagggtatgattttgaagatggctctgaatgtcagcattcacttcattttttgttgattttatgcacctggattctatagctttctctgaattcctctgaatttcagataaaaatccataaattacatttttacttcagtgagctaaagttggtttagattgtttacaactaagcctgactaggccagcaattggtaacagcagggctggcaggaagcagaaatgcaagcaaatggaaagactctgagatcaaatgtttgtactagttaggggtaaaaatagaaaatccagcttgtatccgggaatgagaatttggaagtccatggaaataggattaatcatttatgattacattgagtgatttgcactttaaagacaaggcttaaggagataagtggcctctactacacaacagtatgtttgaatttcatgagaaattgcaggactgcatgtgaatgtggctgctgtgaatggtgatgaacagaaagagaatgacaagttcaaatccctaacttcttgatttaagacacagaagaaaatctatgccctttccctgactatgctaaaataaaagcatactatctttctggaaaaaaagaaaaaaaattcatatttttgccaaaggtttgagatactaaaaaccaaatacaaatcttaattctgcagatcaccagacttcaacataaatctaaatggattttccaattctctatttgattctctataattgggaaacagcaagaccctggaaatttaaatggggtttatggaagaattctctttaaacattccagtttcacattaagtttctttagacatctgaaatgggatctgcattccttgcctggtaattgttcccccattctgaaaatgcaagctgactacaagaaaaagccaattctcttcagacctcattctcaccactgcttattgtctccagatttgtaactgaagtcagatcccagaatgcctcagggggtagcaatttaaaggtcaatctcaggaggaggtttacacataaaaagaatggaaggatttaactaatttatattgtttaaaatctgagaaacgtgtgtaggagtggattttgagatactagacaaaaaagaacagtgaaatttggataaaatgtatcaatatatgaatgtaacaaagagttataggaacattataattattaacatggttgaactgaactcaggcctcagaggttgcccaaactgaatgaatttgagacattacaaactttctgacaggtggagaatgtaattcagaaacttaagaagatagaaatattggaatgaatttatcatatgtgatacaaccattcaccttctgagtatattctcaaggtggaccagtacggttttgagaaacacgtggtggcctgcatgccggcacctttgaataatctccttgtgtgtctgtagtctgaagaaggaagtagaaaaaaatctagctgaaataggcttcttgattcaatggagatgacaggatccgagcttgcagaggacaaagggcaactctagactgccggaaacaaagtgagaatgatattgtacaagatagcaggactgtcatggtagaaaaaataaaatggcataattcagaagtaatgttgtcggtggctgattgataatgagaatgatgagatgtctgggacagtcacatttatgtcttttataaacaataatgacaaatatatttagttcaggtaaaagagacctcagatcagcaaccacacaggcctcaagactttcttcaattcccagactataagatggttaataaacctagtctccttaaaggaagcataagttcagtgctttggaggaaatctcctgcaatagaatcacaactgataagcacttaccatgggccaagcattgttctagtcactttaaacttattaatttgtgtattactcacttgtggcatctcatctatttccataatgctagtcatcaattaaattaaagataattcacaaattgacttctggctttgtggaactaaagacccatatattctatggactaattgaaattcccatcaaagttttgaatatctgtaatgtagcaagtaatataaagcttttaaagagatcattccaggaagagagaagagcaatagcatgaggagaggaatgttctggatgtgtccaaggaaaaacaaagtgaatatggttgtgacaaaatcagtatctgggggaggagtacaagagaaagccataggaaaagaggagacaaatcatgtggagacctataagaagggtgaccataggtgcagctttgccttggaaagtaatagtttatgcctatgttcccaatgtctaataagatttagtattgtagaactcagaaatatcctgatcggatgacattatatggtcaccctaattttatctggccactgaggatattggctgttgcctcagttagatgagaagccactgtgataatggatgacacaatctggcttgcagttttagagtatttctgtgactgctgtttagagacgactgactgtgtgttaagagcagaaaccatgagaacagtcatgagtccattgcaatagtctaagccaaggatgacagtcgtctccaccagggtggtaatagtagaagagatgaaaagtagtcatgttctggatacattttgaatacagagccaacaggaactgctgacaatttggatgtatggtttaagagaaagagagatatcaagcatgaatccaaggcttttggtccaagtagctggaagaatagagttgcagctaagatggggaagactaaggtaaaaaatttgaggaactcagtactttgaagctgggcatgttacattttggatgcttatcgctcttttaagcagacttgctggaaatcagaggagaggtccaggctagagaaataaatttaagagtttcagcgtatggcttttacatcctcagaaatagaagagatcaggccaggcatggtggcttatgcctgtaattccagcactttgggaggccaaggtgagaggatcacctgaggccaggagttcgagaccagcctgaccaacatggtgaaacctcgtttctactaaaaatacaaaaaattagccacagtggcacgcgcctgtaatctcagccacttgggaggctgaggcaagagaatcacttgaacccaagaggtggagtttgcagtgagccgggatcatgccattgcatccagcttgggcaacaagagcaaaattacgcctcaaaaaaaaaaaaaaaggaagaaaagtagagaagatcatgaaataatagagtgtagaaagaagaaaatatgaatgcctgggatactttaatattcacaaattggagaactgaagaggaagcaacaaaggagagagagaaagaatgaaaggaaaccatgaaagtgtagtgacttaggtgccaggtgaaaaagtttaaatttcagaattgtggcattaagggaagaaatgaatttagagtcaatgtattccaagaccactaattatagatttttaaaagcaaggtcaattgcggttatatgagtttttctgtctataaatggcagatagtgatgcaatgcaatcctttatatcatagttacgttatctcgttattatctctttcatgatggaggattaaatacaactttcttcaccctcaaactgacattttaacaaagattattttacttccttgactaaaataaaatgtattttataaagattgaggatgaagttaatgcagccattataacataattagaacatgcaggaaactaagaagaaaaatagagtatacgtgttccagatcagtggctatttccttcaagtcttctaagcatattctaacataattgggataatactatttatgcaatattgtatgctgcttattttacttaacataatattactttatccataaaaatgtatttttaaatttttggtcaaattaggagaaatatagaggaaactgttcttacaggatgatggctccaaagttagaaatcacatcaaagggaactttcttttatctagtgtatactaaaatcctatttttctgggttctgtcttagaggaatatgcctatttttaaaagtgagtctgaaactatgaaaaaatattttcttttcatacataattcttcactgagtcataactcactaagctagcttgatacagtattggtgaaaacattctgtacaacacagcatacttgaaagatctccccaaatctccatattctctagtctgccccattgaaggttttcagaaatcttgcaaataatcacttgttgagtcaatgccataaacaaaaagactatcatctatggctaacattttttattaaacaagtttttatctgatattttgctcatcctttttcttttcattgctttaatcttcctgaaaaacatctttacctttaaaactcctgaatgttttcactaaaatgcattgaattactttgcatttttggacaatatctgctatgatatttattaacagaaatcaggttgccctttgaggtccataaaatttagaaataggagttatgatatttcacgccagtttagtgattttgtgggatatactttccattatctttaaaatgagataccccataatggagtaggaaaagaagcaaaagttaagctctgtctttggttgagttccctgaaaacagactgtaaggcagctaatgatgagcagaagatttactggggagtcatcttgggagatacatctgtaaggaaatgagaaacgtaggtttagacagagggggaagctgaccccatgcaattgatggaggtttcaggggactctgcaggaaactctggaactgaggtggcccttcagagttgctataattcacagtaagagggatgggtctttttattcctgaatcagacagtcattgactgtgggctgaaatttggaaggggtggaggttacatttgtaaagcagtcttcgtgactgagggcaattctatgtgagagacactgctgtgaactctcagtaacaactattttcagtggctgctatcagctgctatcaatgttttggctttgaaaagggcatacatgtggattaccaaattataagctcctcctatatgttcagtactcttctaaacactatagggaaatatatcacatgattgtccgtctttaggtgtgtgttgtctagggtagataggttgaacccaaatgaagttgcacaaaagcattcaagacaagcaattaagtgctaaattgtgctgagctaactataagagataaagatagtagatgagaaaaataattggtcaatgatgattatattttcaggactgtcttctttaaaaagataaaatgtattgtacaataaaaaagagtgttatttgagtaaacattggagaaaaggaaaaccactttggactaataaacaaaagaagagaacaaatagaagaatgattatcctatgtccatagcacagtgaagaacccaggctacctaaatccattcattttaattcagccacagtattgagcaattactaaatgcaaggctcagaaccaagtgcccaagattattcaaggagaaaaagagatcatgaaatttagtaaaagtacgatgacacaagcatgtcacaagacttaacataataatttgaattagagaaatacaaggtactagtgatggcagcagctgtagccatcatgcaggctgcagcaaggaggcacagggaggcacagctggggctgcacactccatggagctggtgggaaccctgacccttctgagttggtgcaggagctccccaggtgccactgcagctgcccaaactgcagctgcagacccaggtctcccactctgtggagcaggcaggagccctgccctcctgggtgggagtatagtcaccaaagctgtggctgtggatctgagcctccctgtgctcttcgagggggcatgagcttctcaggtgcagctgcagctgccctcccaggcccaggacctggacatctctgtagcctgcatacttgaggtcccgggaagttccccatcgctcatccccgtaggcttgagggtatctgctctggctgcttggcctctgtcctctgctgccgcagctctgatctcaccccgggttgcagctgagccctggggtcatgaataacagtgggacacagagtcctgggcagaagttggtgggtccctggtaaggccccaccttcaggctagagagggcctaaaggttacgggccaggctgcctgtcccatggaccagagtggggacttgtggtgcctctcccaggccacccatggccatccatgaccaatcggcaggcacttcctcccctgtgaggtccataaaagccctgggctcagccagagcagggcacaggatggagaggacagagagaaaacaggacaaccaactgcagagaggaactacccccctctgctgagaacttcagagacctgcagagacgtctgaatgatctgcagagagaagctaccctctccagggcttcttctctgcagagaactgaacactccacagatgacttgcctgcggagagaagttacccaccgtgggtctcatctgagctgctgtaatgctcaataaagctcatcttcgtcttgttcacacttcacttgtctgtgtacctcgttcttcctggatgcacaacaagaactcaggccgaggcaccatggccacaggggtttccagccagaaaattgacaccccgaagatcccgtaacatgagaatggcacaaggaatgaacagtcatgtccacttggaggctctcaagacaggctacatgaagcagatgacatgtgggaccaactttaaataatataatgtttttcaggtagcaagagaaaggaagaccacagaaaatactgtaaggaaagaggtgcagagttgggaggcatacttggcaatttaaattatcccagtttcagagggagcatgggtgtcaagcagtggtgttgtgagagacgaggctggaaatacagtctagacatgaggccttagaatagcaaggtgatgactttttattttgtctgcttctcaatctagagtcataaaaaggtattaaatattgaaaggctgttgcttgaggagagcacaaaatcaagggaaacatggggagccatggccagatttacaggcaatgaagagatacccattgtgggaagaaggaggcagattggatctccattttaggaaagatgaggatgagacaaaacaattttagcagggaatcagaacaccttttcttcaaagactagactgaagaaagagtcacagagtgtagacatacttgctgggaaaattaggttaaggagggaaatggggtcaggctgaaggagaatatcaatagtcaggcaagagacgtttccatttaataaggactgagtggaaatttacacaacctcaggcttactcgcagctttctacgtggcagttaaacgtggcagtgattcatttggaagggtggttgaacatgataaaatgtgtgactgattggagaatactaggtcagaggcagctaagtctatttggaaattatccttctgcagatggtggatgaaatcatctggctccaagatgaaatcatcagggagcaaaacttccaaaggaaaggggaaaagaacagcatggtgtgtacgtggtgagaaggaggatgtggaggaaacgtcaccaagggtctgattcgggatactgtagcttttaatcgtttttgaaaaggaggattcaattttgagggctcaggttgtgattaattcagggctatgaggagagagaggaaactgaacagaaggagggcttcattagtgctattgataaaaatgctttgggactgattttcaaattttgtcttgaatttaaaccacctggagactgtcctcagcagagtcagcaaaagcacagctttgaaagaggcgatcactttctgtaagaacccaacaaagcacagcattatgcaaggaaacgtcaaatgtctctgggaggggcttgtactttagcttcctttgagtctttagggctacaattctgactacagatgttttcaatttatgttgtttttttttttttctcattaaattggctaacaattgtgatcattctgtatctccagccgcctttcattataggatctctcataacagtttcaactgctgggaaaattgttcacattaccagtacagttctacctttctctatttattaccacttgaatctgcatttgtacttcacatatatgcagacaaattttctgccatatcaatggcatttaaccataactgcttatatgcatatgcttttggtatgcactctttaaaatgaggtgaatcatattctttgattaaaattaaatgcatctgtgaggtgaaggcaggaagatcacttgaggccaggagtttgagatcagcctggccaacatggtgaaaccctgtctctactaaaaatacaaaaattagctgggcatggtggtgcacacctgtaatcccagctactcaggaggctgacacaggagacttacttgaacccaggacccagaggtggcagtgaggcaagatcacaccactgctgtttaacctgggcaacagagcaagactctgtctcaaaagaagatatacaaatgaccgagaaacataggaaaaaatgctcaccatcactaatgattaaagaaatgcaaatcaaaaccacaatgcaataccatctaactcatgcaagaaatggccataatcaaaaaatcaaaaaataatagatgttggcgtggacatgatcaggaacacttctacactgctggagggaatgtaaactagtacaaccactggtggaatacagtgtggagattccttaaaggactaaaagtagaattaccatttgattcaccaatcccactacttggtatctacctagaggaaaagaagtcattacaccaaatagatacttacatgcgcatgtttatagtggcacaatttgcaattacaaaaatgtggaaacaacccaaatgcccatcaatcaacacagtttctttattcactcgttgatatatatatatatatatatatatatatatatatatatatatatgagatatatatatgatggaatactactcagctataaaaaggaatgaattaatggcattcacagcaatgtggatgagttggagactattattctaagagaagtaactcatgaatggaaaaccacacattgtatgttcttactcataagtgagagctaagctatgaggatgcaaaggcatagcaatgacacagtggacgttggggaatcgggggaaagagtggaaagggagtgagctataaaagactacaaattgggtgcagtgtatactgctcgggtgctgggtgcaccaaaatctcagcaatcaccactaaagaagttactcatgtaactaaacaccatctgttccccaataacctatggaaatacaaaatttaaaaaaaaaagaaaaagaaaatcaaaataaatgcaatcttcagggcattttttatcctgtaagatagtcacatatgaacgaaatatcatttgaggtttttgttgatagcatcaaaataaaatccagcagagaattatgagcaaatttttataggattttgctaaatttttacagttttatctctagagctccttattatgtctcactaatgcttttgtctagttcaattttcaaatagaattttcattttctttcatatttcattctgttggttttattgagtttagtcattaaagtataaaaatgagaataagagatgcattatagcattagacatggcttcaagctctcttttctgacttcacagttacctctaacatccgaggtttagaattctatgactaaaaagtaatattcctataatatatattcctccttcactcttttcctcttgaacatcagcattctccagtcgtctgttccgggctcactagtctccacttttgtgaatgattgcactcacactgaaatctcaaacaattactggatgtgatggctcatctatccttatgtataaccctgtctatctcaagctagatgccccatggacatagaacacatgtcctcaaggctgccccctttgctagtccccatctcagtacatgccagcaccttccttccagctacctaagccagaaatttggaaataatcttaaaatcttggttcctcatcctcactctttcatcagattgcgttgatgctttttcttaaatatctctcaaatcatctctctccatgtgcagtgacatgaactgctctttcctgctttttttatacattgttcgactaatctttctcttttcagtcttactcacattaaaaattcttccttcagtattgctgccaaggtgatctttctaacatgcaaatcacaacgtgtcttacttgccaaaacacttcaatattttgcagtgaaacttctattggtattttgggtggttcagattttgttctaagggattggcctacatacaagaatttcaacatcctgggctcatctacaaaatgcctaaaatattccccaatctttattacaaccactaacacccccctcacacatttccaagggtactctagagggtatggttacacacccagctaagaaccacagatactttccttaaaacaccttcaaaataattttcaatctctttatttctacacacaagtccctttatgaaacctcaacctgcttctctaacttcatctcccactaaccccttgtgtgcaatctattacagaaactgcccactaggggctccccaggcaagaccatgacttttaggaactccatgccttgatctatgttgttctttgtgtcttaccttccctcactgctcaagacgctgtctttaaccctcaagacactgtctttctttaaccctcaagactcattaagaaagagtgtattccagctactcttccttgcttcctctcctctccaaattccagcctagcttgaatttggctaggtcccatgcttcccatgtacaaacctaattaacattagttatcaccatgtatttattcagcttagttggtatgttggtctgttttacccactaaatagtataaacagcatataaagcatggagtgatttcctgtaccatgtgctgggtaataattttacattccaaagcaaaaataccagtatctgacatgaaatccacatgaaaagcatgtacccacaatagattcttagtctgtagtgtaaataatctggcaccattgtgaaattgtttttgtcatgttaatttttaagttctattctcttatatttattatatttacatttctggagctgttttgtcttttgttgttttttgttttacaaataatgttttaagttacttgtcatcaggtaaaatcaacagcccagaggacatcctagtgtgtactactctatcctcaacctctggctcacttttgggcctactaccttctcacatttatgggaactgtgaataaaccaattagagaaaatgactttaactattctttccactttccaggggaaaaaacagggggaaaaagtgtatgtgactgtttttctgcatcttctttgacacttaatagtatcaggtattttaatgtttgtccaattctgatagaattcaatatcttattgtttctgttgcatttttatttctaatgatattaaatatcttccacatttatcagtttttatattgtggcttttgtaaattacctgtataggactatgcatattttggaggtttttacagaaactgtattaaaccatttctgtaatatatattacataaattttcccaatttgaacatgctttgaagcatactactgacagttttataatatagttttctttttttttatggtaggatctcactgtcttgccagggctagccttgaactcctggactcaagtgatcctcccacctcagactactgaacagctgggacaacaagtgattagcattgtgcctggttataatacagatttaagatgtattatagaatctgatctttcatcattttattatttatatatttttttcatttccattccaggattattcaactactcaataatttttatgcaaacatatttagaggttttaaaaactgaacaacctgctcctgaatgactactgggtgcataacgaaatgaaggcagaaataaagatgttctttgaaaccaacgagaacaaagacacaacataccagaatctctgggacgcattcaaagcagtgtgtagagggaaatttataccactaaatgcccacaagagaaagcaggaaagatccaaaattgacaccctaacatcacaattaaaagaactagaaaagcaagagcaaacacgttcaaaagctagcagaaggcaagaaataactaaaatcagagcagaactcaaggaaatagagacacaaaaaacccttcaaaaaattaatgagtccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctcttaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtagtccagcatataaacagagccaaagacaaaaaccacatgattatctcaatagatgcagaaaaaacctttgacaaaactcaacaacccttcatgctaaaaactctccataaattaggtattgatgggacgtatttcaaaataataagagctatctatgacaaacccacagccaatatcatactgaatgggcaaaaactggaagcattccctttgaaaactggcacaagacagggatgccctctctcaccacacctattcaacatagtgttggaagttctggccagggcaattaggcaggagaaggaaataaggggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccatcaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactgtctgatctttgacaaacctgagaaaagcaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcatcatcactgccatcagagaaatgcaaatcaaaaccactatgagataccatctcacaccagttagaatggcaatcattaaaaagtcaggaaacaacaggtgctggagaggatgtggagaaataggaacactttaacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaataaaaaaaaaaataaaaataaaaattaaattagttcatttgggaactgttttggtataagaattaaagaaagaaacatgctttcaaatgataaatagttataaatttactttaatagcatttactggaaaaatgggaatttttttctatattaattataatacaggtacatagattcatttctaaatattttttgttccctatgactggtagctttttattatttttaaatatttacttgggccagggcccacctttattcaccacttctgttttggaggggattttctaatcacttttctagcaaattttttattccaatgagctttagaatagttttgtcaagttttctgtttttatgatcttatagggattttcagtgggagtatttattaatttaggaaaaaaattacatttttcaaatattgagcttccctatgttaaggtaggtttagccctaattttaatttacatgtctcagtcaagtgttatggattttttcaatcacgttctgtaaatttcttgtcacgtttaggtatacgttgtatgttgctattgttactggataataatcccttcttcaattgtgtttctgtccagtagtactaatagaaacagtaacataatataatggtaataatgatgtatgcttcacactagtacagaaatcaagtatgattactctctgaatgtatttttccagttacacatagtatacaatttttcatcattcaatgaatgtatgttgagcatgcacaaatactaagaaaatttttagatcctgtgtaaacaatccatgcctttgtaacaaatacaattaatagaaaagactgacacctaccaaataatcacaccctttataaaacattctaatttgtgctataaatataaatatttataagaagaaatacagcgtgccaagaaaatttaacagggactatcttacctgagttgtggtgaggagtgaggagcctagtaaagattttgtgaggatgaggcattgagaagagttctgaaaggtaaatacaagtaaactgggcaaagagaatacacatacaaatggttttcagcaggacagggaatctagaagcttttagaaaatggacaaaatcccatgtgagtggagcacagagtaacggagatagtggtgtaaggaagcctgggaagaaggcaggagtcaggtcatgccagtacctcatagtttgaagatttttgtctttatcctagaagttaccactgaagctttttataataagatgagtgcgtgtgtgttgtgttagctagggtggcgggggggagtgggaggtgacatattcagatttttatttcaaattgatttctctggctgtagtgagaagaatggatcagaagagggaaagagtgcatgcctgaaaacctgtcagaggctattgaaaaagctcaggcgagacataatattcatgtggacaaggataacggcagtggagatcaagagaaggatatgaccttagggaatatttagggggcagaattagaaatatttaagaaggacagtactctggcatggtctgagagagagagagagaggtgacaaaaatgactctcgggtttctggcctgcctaaatggatggataatgacgctgctgtctttttttaaatttctgttaattttgagaattttcatttgtattttttaaataaatcaacaataaatgtatgccaccatcctccccaaatgtagattatttcactttttatagtgtagaatttgaggtgtctatgggacatgaaagtaaagaaatccactgacaggtctaatatataggcaagaaatttgagagctttggaatggtctgggcaggcttttattggtagcattcccaaaatccaaataagaactgttatttctatagttggaaattgttagtgtttgtgacttaatagtattaccacatatttctgattcatctatatgaacttatataatcttatagtttggacttggaagtcaaacaaaactcacacatgtatttaggcatataaatactcaaatttaagatatacaggtcaaaatataaccagtttaggggaaaatgatgttgtaaactaaatattgagaatgaaactgaaaacaattaggctaaattcatatgtgatacactttgagacatatgttttattattacagtttattcagtcatgaaaaatctattgcttgccctttttatcaataatactactctgacatttttaagggcagaggcagtgataattggtgtcatgttgcctttgtgggtaatgttgtagatagattttcatttataagccagtacatacatgatagaaggtatccgttgtatcttttaaacaaatggcaaacaaagtataccaccacatctccttttcactattggaaatgaaatagatctaatatggtcaaaggaatttcacaaaacaaaaaccactgacatgacaaaagcgtgcatttaatttgatgctttgcagagatacatgaccaaagttgtatgcatggcttgtcttttgggatggtcccagctgtttattttaaaagaaaaaaattaaaatagagccaacaaatgcaattaagaaaaaaaaagtattgagacacaaggggacctacatgttctggtctaagaagcatgcaagtattacaaagcattccagatacagtatgacagaggaacagtgaacaagcattggaacgatgctctttctttcagaaacgggaagtctaacagttatgttttcacaatggtagtgattaaaccatctttatttttaaggaattttataggaagaattttagcaccatcattaaaggaaaaataataatacctttttagccctgcctatctccagtcttggaataataacagaagcatagcacctttcagtatctaaaatataaacaagaatagtaagtccatcccagcttctagagatgaggtagctcatgctaagaaatgttgggtcatttttcctatgaaagttcaaaggccaaatggtctaattccaatcatcacatttgattagagtcagctccacaactcagtttctagatctttttcttcattataggcttcaggatgatgagattgtacatgtggaagagtctcaatttagagtccttggacatatgtttgtaaagttctatatgtcaattattttgcattcaatatcttcttaaataagaaagtgtaaatgtattaaatggtatatactagtgtgacttctatcaatattgatagattgatcaagaggagaaagatatctttaaatttgaatgagaaagatgtctaaacttatagtcttttacaaaaatttaagaagtcgaagtaaattcactttgttctccaaaatgccactgaatatatactatttaaaaattctatttaagacagtgagaaacgtttttttttttttaagattctccttaaagagtctctattatagttacacaatatcaagacatgcatgtaggtctcgatcacaagttaaacattttaaactcatttttaattgacaatcttggaatgagaggtcacaaaagggcactaatttctatttttcaactgcagccaagcaaaataaacatgtgttgtggctctatataccccactctttaagctacctgccaggaagaagaatttcctcataaatactaagcaactttttcattacactgaaataaattgaagaaaacggagatttatttattcaatcagtttactttctgcaaaggtggtcattgtcattggtcatcttaaacctaaactgttgtattgaaaaatatttaaaatcaattaaaacttgaggattgtaagtaaaataaatattctgaaggataaggaggccaggcacttaagaccatatatacaatgctgatgcaggatcagccattacttcaagagtctcaggatcaacttcaaacagtcaaagttcttgtgaatggcggtggtcattgatggtggtgctcattgtcgatgtgtcttggcttactttacacaaaacaaactggcccaatttcaacgccgaattcctggtctgtgccgccaacatccacaggagcaagatctatgatgggcaagcgtgccacattctgtgttctatattcaaagacagtcttgcccacatttccattccgcttctgaaattaaatgatgcaatgggttaaatgtacatacaattttttccaagtatgttagacagcaaccttcccagacacttttataatgtaaaggcaatgatttttagagtactacttaaaaaaaaggaatgaaaacataaagtgaaatattagtgtacttatgtaacagaatttctttcatgctttaagtaaatttcctttgttcttctgcagcttcccaaatggtcactagcaacataaattatgaaagcttttttgtttttcacaaatgaaactataattcaccatttagtattattttcgttttatatctcaatatgcaagcggggagacttacttacaaattggtggaaaaaataaagtatcttggattaattacgcattttagaaataaggaattttaagcatgggactgagattcagtaagttaaataacttggaaaagaaccaaagaaagtctgcagaagaactggatcagatcttagggatccagttctttctttactatatggattcaaacctctatcatgcttcatgtgctaacacacacacatttaccctaaggaatgactataaacaaactgctattatgctcatatacaaggtaaaattgcccccagttctagtgctgtaatagtatttttaacaaaaataattttttttcctcaaccagatcaatgtagatcaaaaagtacttacagagcaagtgtcttgaagaacgatataccggaatctaatatttccctctgctttgatatctaagtcatttgcccctttgagaaccacagcttttttgaggttcttagcttgatcgtccatgtatcctacactgtttttacagatgtaagtgatgttctgggaggcttcttttgataaaaggcgcaaaaaagtcatctgagtaatggctgtattaggtgattggtggtctccataagcgaactagaaaaacaaagagtctttgtcatacacaagactgaagggtttcataatgccttacacatgtatagataaatatataaattgatttcagataaatcaattttgaagagtattactttaattcttgtcataaagtaagctattctagctgtacatctaaacatatcttaaaatgtctatgaatactcaaaagaacctctgtccttattaacccaaagggtaatgaaaccaataataacaataattcacgagaacaagcataagtatttttaaatctgcttcactcatgtatcaaaaataactcatttttattgctaattataataaaaattagaattaactagtagtataaaatcttttgaccccaactattacacaattgtaggaaatacatattaaaagttttccatgtgctaacaaaaataatcaaaaaaatttttctagagactctttcctactcaccttctactttagctttggtttcagcactcccatttgggggttttattttacatattatattagctaaattatatttcaactatttatatttaaaatttaaaattttgtgctcattaaataatgacagatactagcttatcttgtatacacccataatgttctcataatgtttattctgaacgtgatttctaggaaaaggtcagaagcagaagtgagaagaaaatttcaattaggctgccataaagagatgcagaatgaaatattcacattgcaacaggcagtggaaaggccagacagttgtctgaacaccagaccatgatagaaacagggtagactgggactcagaaaaatatcaattgacttcataacattacaaaaatgccttaagtttaaataatattaaaaattttacaaaatgattcaattatttagacattattatagtagttatctaatattaatttaccatctatcccatagtacaagagaccctaaactaagaattttatatccacatggaaactatggaataaatattatcacccttactttaaactggcaaaactgagtctccaaaaagttcagagactttataaggccccaaagtcagtacaagatccccgtgaggtaaccaggtctgctgaagctgaatatacagaaataactgtttatcaactatggcactatagtttatcacttctggtacactccatagtccatgtcacatacattagaggaacttacagtaaaaataattacttttctatatttcatccatgagaaaatttttaattcaaaatttatgttaacttcactcatagcaaaaccttgtttatgcaatggtattacaattgtaactaatgagactatatcacttcaaaataaacatggtaaaataagcctggtttaaaaaaatagcaaagtcctaaataaatcaaaaatatgtaataagtagtaaaaagtaaagaatacaattttaagtaaacatattaaattacctgagaccctctgttcatatcaagaccataccaaacaggtttattgtcaggagatttactggcccaccaggttttacgtggtacactggatgggtttgctgaaatacatgtttctcctgtttccatgttgcagtaaactttgattgcatcttcaacagatccttggttaggatcaatccagtattcacctatttttcaaaatagaaattttactaaataaagacaatctcaatcatgactataagtctccaaaagaattaacagagggtttgaaaatatacactcactgattaaggattcttttaagtgagagtgccccttacgaaaaaagtaaccggtatgcattgggggcctttctacattctagtcgctattgtaaggcactttgccaaaccatgtacttaaggctcaaaacatccatatgaaggaaatatcattacccccattttatagatgagaaaaccataccgaaaagagaaaatctatagtaagcggctttaccaaaatagatgtgtttccaatattttaaagcaaattagaatgagtgtaacaaaataatgtaaataatgtaataaaataatgtaacatcaaaactatgagtaaagtgaataaataagttgaattacaattagaatgctatgaatcatttcattagatctttttaaaattactcttctcatatataagagactcttaaaataggaaataccaaggcagtgcctggtggtaggcatacagtcaaatacacaatttaatatgcatttgcatacatgggtgtgtgtatacatatatttgtgtgtatattatataaatagtatgtgagaattgcattttaaatgaaagtgtcggaatgtaatgtatagagttaataaaattgccctttcttcaatgataataattttagctattcctgtcaatgtcatttcaaagttaacttaaattcttaggctctttgtagctcatttgtctcctgtgacttaggatccctcttctctaggtcatattggattaattaaaatgacagaataaggtaaactttaagcctggtacatgcaactagggcagaacaactatttgattccaaaatgtcttggaacctcataataatataatcctgccagcagagattccaaaagtatgactcatagaacattaaactacatgaaaggaattacatatttaaatgtgggaaatatatgcttgatgatccagcaatatgttaacattaagacacttataggtcatgcaagtaaataaatattttgaacaatacttaagcaagcattttccacatttccacgaaatgcttttattccacaaaaatatcaatattttaagatttctggatgaaaatggaactaccatcatgaaactggattattaataggatatatcatctattatagtacattttttttaaagttaacatttattttaaatacaaggggtacctgtgcagatttgttacatggggatattgtatgatgctgaggtttggggtacagatcctgtcacccaggtagtgagcatagtatccaataggtaatttctcaacccttgctcccatccacaccctcccccctgtagtagcctgcagtgtttatggtttcatatttatgtccatgtgtgctcattagctcttacttataaatgagaacatatgatatttggttttctgttcctgtattaatttgcttaggattatggtttcccgctgcatccatgttgctgcaaaggacatgatttcattcttttttatggccacataatgttccatcatatatatgtaccacattttctttatccaatctaccattgatgggcatctgggtcaatttcatgtctttgctactgtgaatagcacagtgatgaatacatgaattcatgggtctttttggtagaacgatttattttcctttgggatataccaaatcacaggattgctgggtcaaatggtagctctgctttaagttctttgagaaatctccagctgctttccacagtggctgaactaatttacattcccaccaataagtgtataagcattcccttttctccaaagccttgtcagtatctgttttgtgacttttttatttttttgagacacagtctcgctctgtcgcccaggcagtggcgcgatctcaactcactgcaagctccggctcctgggttcatgccactctcctgcctcagcctcccgagtagctggaactacaggcacccgccaccacgcctgactaattttctgtatttttagtagagacggggtttcaccatgttagccaggatggtcttgatctcctgacctcatgattagcccacctcggcctcccaaagtgctgggattacaggcgtgagacaccgcacctggcctgttttgtgactttttaatgacagccatactgactcgtgtgagatggtatctcactatggctttgattttcatttctctaataattagtgatgctgagcatttttttcatgttttcacaaaattgactgtttccaccattaaattataagctccatgatatgtttactatttttatctcaaatctatcactaagtagaaagtcagtaacatattttggaatgcagttgagaataaacaatcagaaacaacgggttttgctcaaatgggctgctgtctactcaccactctgctttgcggaatggcaaagctttaggtcatcacacgtgcgggctgggtgctttttcgagccatcggggctgcgcatggtttcaatctgactactgagtgacttcagggtagcatgaacccctgggtccgttttgtttttgtcatcaggagccgcctgatcttcagtaaactcaggaagtggatctggcatgctttcatcatagtgccccatgatatccccaagagcagctgtaaggtggccagggggacccggagggccaggtgggccaggctcaccaggagggccctaattaaaaagagattggaaagacatttaacacattgtttttgttttacttaactggtagaacttggttcatagggagttccaatgagacactccaatttgacagtaaagggagatctatgactcgcgcccttttgtaactagatgggggtggtctaacaggctgtaacattcaaggatgagaaatgatgctcaatcatttttcaggaaacatatcttcaagtcagcatccaagataaataaagatcaaagcacaaaatatttgctcaggtgtttaccttgaagatacaacatattttatgttaatagcatgcagatatgtatgttcatttgcaaactattttcgtcaaggtacaaccaaaatgttttaaaattatttttggatgaagctgaacaaagcatgcaggggaatagtggctgctggttctataagattacatgtcaataacaagaaaatacccacaggaaacacccacaagagaattatactcctacttctaaaagagagggagagaaacacaggaagtccttttatgtgcattaattcctgtacagataaaaattctctgtcctaagaaaaactgaagaaatagtattggtttttagagacagggtcttgctactatgttgcccaagttggattcaaactgctgggctcaagcaatcctcccaccttcacctcctgaatagctagaattacaggtgtgtgccaaggtgcccagtattcctagccttagcctttgaattgacataaataaagagccctcctgccttttttttttttttttgccaaataagacacactgaaatgagagggagataagcacaaaaagtggcagagactacgaaatggatcctctctattaattcccttctgcacttccccaaggaagaactcagcaacttgaaagaaccaggtgacaacctgaagagacacatagtccacatctcatgtagagagcaagatctgggagcaagaactctccagaaggctggagttctactattggctctgccacttgttatatggctccagacaagttgcttttaccttcagtgccaatgtttcctcactctcaaagggctgttacataatttttttttcttcctgtctctaaggtcatatactgagttcatgcgttcctttatactaattttaagagaaaagaaaagacttttttctaatatatcaaggcccactgaatcacaaagtcaatcaacagccacataagctgaaggtattccaattttctagctgtttcctattcacaattagagaaataaatgagtagaaaacatatctcttgtccataggaaatataagactatttgatccacataagaagtaaatatctggcttaacagtattgctatgaagggcaaaggaaaagtaaggaagagaaggtaaagaccaatgaggaagaaacaccagagagagaagcataagctcatatacaaacacgcacatgagtacacctgtgcatggaagatgtatgaagatgtttcccagacctgagaagcaaggatctaactaacatagtatacagctttgtatcatcctcaagtcaacactactgaaactttttacaaaaagttttaatcaaagtcctccctgaatgttttcaatggagaaaaacttcaatttcatactcttcattgtccagcatttctatggagttttcatgaagtaataactatacctcacagacatttaaaatattgcccttgagagcaaatcaacattttcataactttaattataaatacaattataacttgttctttgctcttgttagtatcacattatgttaatgtctgggtaggttggactctgattttatgtgctctaacttatctgtattaaaatacttgaaatagttacttatactcttgtgtgacttctacgtttgttttcggggtcccttaagtctcttgtcaatcgggctgcacagacatttcttggacggaatctgagctattgaataaatagcatttcttgcatgtaaacctttgtgactttacctcaggtcctgcttctcctacactgcctcgtacacctggaggtccaattggcccaagtggcccagggtttccttctttacctgaaggaccaactgggcctggaggaccctgcaagaaacaaagactgtagtttagattctatgaaggaaaaattttacaatgcctttctctaatcaaagaactattttacatatggagctgtaacagtgatttctaagattcattttcttactgattaataaatgaacttctggtactttgtaacatttatgatttcatcacataagaattttccatcatccatgcatggtaaaagacaaatatgagtttacatctttaatggactaatcacctacttttattggtagtaactttcattaaacctcacatattgtaaacttagaaattcaattaacttgaaataagaaaatgacagaagttggagtgtttaagtgaaatttctgtgcttatgcctcagaatgccatcatgtactattattctgaattttatgtatgctttgtttacactgtattcagatataccaagattctttaaattattttttctaattttttctacaaaatattttctattttcctaaataattatgtccaccaattgtcttatgccatcaatgacttattacaagcaacattaatactaatggagaatttctaaaagcttcaaatattggcttcattttattatttacttccaaattagctttatgtaaactacttctgaggaactatcactattacttaaaagacaaaatatatttagcttcaaaatctgtctccacttcatagtaaatgctattacatcatctcaaaaagtgaaagttgaatagaaatttaaattaacacaatgtaacaaaatgaactaacagaggaatatatccaaaccctaggtaataaattttattgcgggcccatgaggtaatatatcatatttcaagatatttctacttaaaattaattgctaaatagcttgtctcatatgtgtgttgccaacctcagagaagatgagccaactccagcttcaataccaggaaaacgatactcaagcattagcagtacatcaacaaaggcattattatttacacctgcaacttactactttttgttacttactcttgggccaaatggtccagggattccagcacttccttgttcaccatttggaccctaagtaggaatacaataaaaaatgttgccaaaatatttggatcctgcattgtgccattctcaaaaatgtgctatcattgactttagcagcatgaactactttgataaagtcaccaatctctgcaatgtctacatgagttgaccaatgttaaagacacctgtaggagtaacagtgcatatagcttttgctttatttcttccctacaaaattatagcttattattggcaattatcacttgttattcatcaagatattctttgaactgaaaataagatacaaacatatccacctattttacagacagataaatgttcgtgtcaagatacccgtgtattttcaactacagggcagaataatacttaaaggaataacttacaggagggccaggaagaccctgaagaccagtaaagcctctgtggcccttctgacctctgtcacctcggtctccatgatcacctttgtcaccacgaggtccttggggtccctagaaatagagatatggcatgaaaattacttgctacatattattgttgagactaaaatttactaaaattttactttttataattgtatttactacaattttgaacttggtattttatatggattaatatatttacttatctaaaaatagtattagacctagaaatttctgtttatttttcccaaagaatggtaggtgatcactgaaaaaagatataataagaatacttttctgaagatttattttttaaatgtttatcttacattcatactaaaattagatatttttgtttgatctagcctatctgaaatgttttttaaagattatgcttcacatatttagttgatattattatataaaaatattgctaccatatatagattcttttaaattaaaacatttcatacttgccgtgtgtaacaatgaaatgattttaaatttacatatgcaaataaactagctggctatgacagctgcaactatattaagaaattggcaaaaacttgcttgaacaaattaaacagaaatatcatctttaagccactttcctctaaagaacaaagcaactctaagttatcccatatctgcaatatctgtaaccaaatccagtgatcttgatgctaagcttgatctacggctacaaagaaagccgtagttagggatcttattttgagatagaagctatacccagagaagaggtgaaaattatctgatcaatctcagatgttttgttattgttggtggtggtgttggttttgttttgttttaagtcctgggaaattaaaaacagctccagggaacgagtggttcacagtaaactgacaagtggcatagagtcatctactatagaaccggattctgttgcttttagtgttttcccaaaagataactgaatccctatttatctgactttggaagatgactgcagtcatcaaatcaattggctctcaggttaatttttcccttattgttttgattttgaatttatatttcctaattatcatacagtataggaacccatttataataaaaagaagatgatttcagtagcttttgcatattttatataacaatataaatttaaatactatcaaaatcagcctgaagtttttcataatgttcgaaaggttcttttatttgggggatgacccaaagtttcataattaaaactaaactaaatcagaaggcacctatttgaattattaactacaatgtatttattcatagaaaacaaaattacaatgtttctataactgctcaaaacactgttcacttgacatgctatgcaactataaaatatttgccagtcaagctcaaattaaagaggagaattatttaataatatggccatgattttcaaagtataattgttctttttgagaacagacattgatttacctgatgggcatgaaaagcatatgacctattagattacacatgagatgattcattcatggtaagacatctatataataatgttaacctgaaagtcactgattgcaaatagcacaaagatcagaacatagaaagaaaaatctagttgaaaatgaaacataatatttgaatagtgcttttcaagtttacagagagctttcaaatccattttcctatgtagtttttagaatagctcagagagaaatgcactataattcctattattttaggagaaacctgtgactttaaaaacctccatgattattgatataattcatggttaaattcagaagaattgtgttaaaattataaaaataaactcgtattactttaaaaaataagagtaaacttataatttttaattaatatttttgttcaagcttgaggaatttcatatttttcagttatgaatcttaaattatacttctttgggagtatattttatataagaaaacattttttaaaaaacaaaaaaagagaacttacaggtaatccacgtttcccagctcgaccaggtggtcctataggaccccgagaaccctaaaagaaatttacaacaaaaaaaattggcatgtaaaaaagatattcacatattacatagatacaggatgtcaacaatacgtttatagttggatgcatatatatatatgtgtgtgtgtgtgtgtgtgtgtgcatactcttatgattaattaattgaaatcaggcaaatgtccatgtgtagataagactgtggtcactataacttcaatgacacttttacggtcaattttattcattgacttcattgaataagtatcaccttagttgaatacagtaagacattattcattgacatttaacatgatgcatacttattacattttcaaactacagcattttcagatgatggaagtcaaagcatcagtatcttctattccctcttagaaatgaaattttgcctttcagactaagaaacatatagtagttcataattagctgtttaccattcattatttagagtccttaacgaagtgcacatgtatgactatgtgtgtgtgcctatatgcagcttataacatagcatatgggtgtgcaaaactgtcagtgtgaaattgactccctccttaccggatctcctctttgtcctgcatctcctggagcacccacagggccaggagttccaggggcaccctgagagcctggcagacctgcaggcccagggtctccacgatcaccctaacaagaataaccatgatattattttttaacatttattctaaaacaacaatattccatatgttcatgttattcttatagtattaataatgggaaaaaataccctttaaaacttatttttacttattattttaactattttacttatatttattaattaataaatcaaattgaaaagaataaagttatttcttcctaatttcaagtctcatcctttccctcacctactccctattgctcgcacgtcaagatcattggagtataggagtgatcacctccagaatttaacatgttttctagagcaccaatctttaagctggaatattggtatacttggaatacacaaagactttccaaagactgtgaaaacaaagaaaattttaaggaaaccaccttctagattttcctctccttatgtattctttcagaaaactatattttgattatccttccttacttcccctaaataatccaccttctctcattttgtaaaagaaaagcagaaatcataccatctgcaatcttattatgatgcaatgtcccaaggaataaatacctctaggcactgaactaagggacttttccagaatgcatagtttacttgagtataaagctacgaaggatttggaaaataaagaggctcctttttattttatccagatgacacaattatgacaaggctccaaatattacttgtctccttaagaagtcagaggtgagataagcgttatatgaacatgtctaaacataaatatttgacttgaaaaattgagtcagactgtattttctgacaaaaaattgtcttatttgactgataaatttatcaacctagataaactttggcaattaggttatagaacagacacataatacattgaataagctgaattggcaacttcaaggttttgaaaaaaaaaaaaaaatacttgcccgggcacagtggctcacaaagtgggctgtaatcccagcactttgggaggccaaggcggccggatcatgaggtcaagagatcgagaccatcctggccaacgtggtgaaacccagtctctattaaaaatacaaaaattagctgggtgtggtggcacatgcctgcagtcccagctactggggaggctgaggcaggagaatcacttgaacccaggaggtagaggttgcagcgagacgagatcgtgtcactgcactccagcctggcaacagagcaagactctgtctcaaaaaaaaaaaaaaaaatacttaaagcacttgtacatttagaatttaccaggaatcacctcctttgcaactatttaaacttgtgattttaaaagggcgatggcaacttaaaataagtagagagatttaccgattttcataattacttcagcaaaacctttgaagatggttgcactatatagtatatattgacaaaggaaaaagcccaagttgccaagagaatttgcagtctgtggattatagtagatgagcgggacttagcccaagcttcctccaaatcctttcttccccttttttttcaatatgaggttgagtgtctatcctgtagtggagtgtttaaacatgtcatttaatatacaaatgcccaatggcatatgtattaattatatttaaagcatttgaaaatggaggttcagaaaatctgcttaagattacacagctaattacttagggaaacaatattccaaatcaagtctgactggctccaaagcccattctgctacatgatgagctttaattacatcataacagactttggagtggggagtgattttgccttcagtggcccatctcagcagcatgagatgactgtgcaactgccagaagggactggggcttcagagaaagttggggacatgttcagttcagcacattctaatttaaaacacatcatggaatatacagtgtttaaaaagccacatggcttatattctcatacggcattcactttagatggtgaatggaaaaatttagacattacacagcactattttggctttcatgcttttgttaatgagtttaaaatttagaacacttcatatatatcctcatccaaagcctttatgttaaaccaaagatggcttcaattttatcttcctgctctgaaaaaataccatcttaatttgttgcatattcaaatatcatttcatttacaagatataaaaattatggctttacagaaacagttgttattcagaaaaatcagaagtgtattggaactatcaggaaaaatgacagtttttagtgtaaattaaaaagatttcagatttgcatgactttagattttataataagtgaaatggctcttacacgttctccaacagcaccatcccgtcctggggtaccatcattgccagctggaccctataaagaataatggtttgaaaaactacttaactgagtaatgaaaaaaatcctcattccaattgtcaaaaaatgacagcatgttttacacctgtgttttataaactgtcagttagcatttatgcaaatgtcagcagaagaacggtttctacctctttttcattattttgaattactgtaaaattaacatattcttacttaatccatattcttcatttatatttcttattttgaaaaacaaaaaacccacaaatattttgaaatagataacaattacattcttgccactttatgttttgcttgtattaacaatgaaaggcttttcttacatttacttcttaagattattcaaatatccttaaagttttgaaataaaataactgtttcaatattaaactactttaagaaatagtcttccttttctattttattgtgatttttttcataaatatgtctttgctatttgatcaaaaattgttccaaaggctattgattctttctttcaataaaatgttacattaactgtttgatgattcactccttaaaatcctgaacagaggatattccagcctttaacttctcaaattgcctatcaaaaactgatttcctcccaaaagtgcctaaaggaacatgatatccattatgttactttatagtgatatttaagtaaaatgatctctactaactttgcccttttcacaagctggaatagctatattaatcctatcaccaaaaaacttggcaattttgataaatatgtcattacaaaatgaaataataacaagggaaagatgaatggatgtgtcctttcaccctcaaaacagtttggcaacagcttaaatgaactaaaatacttagctccagactagatgaaggtcagtgcaaagacaccgatcctattaccttttctttatgtcatcacttagccaactctctagggaagtagagtacatcaaataacattactaagaaactttcttaaggtcaaatatgcaataaaattctaaatcaattgctaaatgaaaaaaattgtttccatgacaccagataacaagagaagagttattttcactgtagtactcacttctggtccaggttcccctacaggaccattggagcctgggggccccacaggtccaggtggacctttatctcctgttgcaccagttggtcctacttttcctggtgttccctgaaatagaagtataaatgtcaaacacttgtgaagaaattgaagaacgctagttcccataaaggctaagttttcaaaatggtgcctctgggctccttctataataataattttgcattatcttacaacactcatgtaatcataatgctttcttagaggcctgcccacctcctatcagactcctcttgacgtatctaagggaccaaaaaccaaccatctgttgccaccagcacaggtgtgcattttgggttctaatcatgtgtaccataggtgattctagctgcccttctggaatttgcatcactttcatcctttttccccgctctgctttgtctgttcattttatttctatattctgatactttgatctcactcttgagagattttactttcacattcttggctcacttctgataacaataagacatcccttagctcctactttgttggtttcatatttcaacccacatgtctcccagttctaagatcccatacatctctctgtctacattccatatgaaaacatcattaatttttttcaagcactgtaatcttttagcaataaaatttagtctcttcaaagctaactttgaatcaaacttttatccatactccagggaatataaaatcctaaagcaccctccagggaacaggagattaccttcagatccttcttcagcattccccctacattcacctcaaatattactttagctcaactatgtcttccctttgatggtttactgtaaaatatggtatttttgttaagcatgtttacttaaaaagacactacctattcaccagaagattatccccctcctctagctccgggatctttttaatctttgaagaaggatttaaaggtcaccaaaaatccatatccttatttgcctacttttctagtctcagggttaaacaaatatatattttcaaagactttgtaaggtagttaagaatttgacatttaagatcaaaagatttttaagagactcaaaaattaatgtccctacaatactgtttaaatctattcatcaagcaaaaaaaataaaatcaattctctaaacaatttgtattgcacatatgagataaaatattgaccgatgcagctactcaccgctgggcctggtaggccgggcatgcctctctctccacgttgcccaggcatgccaacaattcctctctgcccggtcgttccagctggaccaggggggccatctggaccctaatgttgaggacaaactaaaatcagaaactatccagggtaaaactgtacccaaggaatttacaataagttgggtacagctttacaggtttttcagtatgaaaaagaagttctctgtttctcaaaatcatactgcatatgagtagtcataaattgtaatccgcacagaacctctaacattatttaaaggtgaaaacagctcatccgttggaaagaaactgaagattaatgtgaatactgactcaataaaagaggtaacttcagagaaatattttttcttctttataaaaagacaaaaagaaagtttaacaataaggaaaaaagagttatctaaacacaatatttaaaggcatttgcatataaaatataatatacatatatttttaaagttattcatacacaatgaacatttaacaaataatttttttgggtttagtttttagataccatatctattactgctatttttaaaatctatatatatacacgtttttcctaaagccttatagatttaatgcactttaaaaattttaggaatgtgcccagcataatatttaagcatttttgtgacactgatcattatgggtttctatttgtaaatatctcagttgaaggtggtctggaacggatacgccaaacttacaggttgcccatcttctcctgggtcccctttgtctcctgggccaccaggggggccagctggtcctcgatctcccacacgcccatgagagccagggtccccacgaagacctggaggtccctccttcccgggttcccctaggggtcccgcaggtcctggagctccctagtataacaaagaaagaaacaccaaggagggcaaaatggaaggcaagtaagagtgattgacataacgctgtctgcctcagatgcagatgtccaagcctcgcaggttcattttacctgttagataatcagtcattctataggatttaaacaaaacaaaacaaaagaaaacacagctgtagattcattccccagggggaaaactaaatatcatttgcagtcaattccctttgaataatttttaaagagtggtgcaactaacttgaattttcaaacttatttaaagctccactccaatgatgaatatataatactttattctgagataattatttattcttatgatttgatcttataatgaatgacatttattaaagaaagtttcatagttgcatcttaactgaagagaatgattattagcacataatactgtaagtattcagtatttaaacggaataataataaaacattggggctaaaaagaacttgcaaattagctcctccaagaaatactagattattaaggatgatttgctttgctgaaataccagcatgcattattggaataagagttgttaaataagaaaacataccattaagaaattaaataaaataataaatttaactcaaatgtatacgtgtgtgtgtaattatttcattatcagtgacttgtctcactaagttgacttacagcagggcctggaggtccaactctgcccgcagaaccaggaaatcctgtagcaccctagaaccagaatatcatataagcaatttttaaggtaatataaattagttacatgtattttcctgggattttttttcacaggaagactgaagcctttagatttcctttcatgttgtaagcaatatttttttttcttcgtacgaatcccatattttggggaattaatctagattaactggtaggaagggcactattttcctttttccatgcaggtagtactagaatcacattgatattttatacaatcaaattaaataaagtgctttcacattgtttatttactcttttatataggtagtatgttacttacattacaggtgaggcacctgggtctccaagattacaaacttgattttaacccaaatctccatctgagttaagtgccctttgcactatagtacagttgatacaggtaataatttgttatttcagtctcagatgaaaattatcttttacatgaccaggaagcactaggtaactagaattagctgtgcatactttgcagagcatcaaataaacttacaggcggaccttgggttcctcgaccaccttttagtccaggaacaccattaggaccctgaatagaaacaaacaaaagagcactatagtgaagcaaaagaggctgaatgtacactccaaacatggggcacttgactcaagttatgcctttttcttgttaacttacatgagggccaggggatcctgctaaaccttgtggtccaggagaaccagcatctcccttctgtcctggctctccaggttcaccttttactccaggctgtccgtcaggaccctataaaaaattatacaaacaagcaattgattataagacttatagacaaattactttagagtaattattactaatgtatcaattaatcatatattgtgaaacagtgctttataatcagtattaaagcatactaaaggaaaaaaagtactctgatgagatctttcaaaacagcctaaaaaataagctatcccactgcatttttattttaacaaataattatagaagctcaactagcacaaacaagttttgtgccagtctataaaaaaatgtattgaaaatgagaatattgtctagaaaactgtaaattttccagaatacgacttcaaaacatatgacaatgatcattaaacttattataacaagataagtgtttatttgtaaattagggatatttgaaaattatacctggggtccggcaaaaccaacagctccagttggcccattttcacctcgagaaccctaggaggagacaaagattactgtagctttcacacattatcctaaacaggaacagtattttaaaatatgatcatataaatctgatagttagacatgtaaatatagaaaaattacacatattgcttaaggaaggtccttaaggattatataaagatataggtcatagaacaaaattcccaaggtcagaagtctcaaaggagcctccaaattagttagtaaacaagctgcctaactacacttaatagattgtatagcagataatttttaagtttaattagaaaagcaaaagctaaaaaccaggaagttatacataacctaaaaccaataagcattgttttatataaatataaaaacaaaatgattaattgttttattgctcaatctcacactaaagaacaccaaaatactgtcacttacaggattgccccgggagccaggagggccaactaaacctcgaggaccaggttcaccctagaaagcagattttagatggttactgtccaaaacagtagctaaacataattttaggacattggtcactgtgtaggaggagatagtggaaaagaactctgaaatgatcttgctcagataccatatgttataaaatgaaaagatttatgaaagagcctgctattcaggactcataattttgagtgtacaaattaacaacttgtgacttaccttttctccagtaggacctgccggacctggagggcccaaaggacctggaagaccctgtcaattaacagaacataggcatattgaggtaaaaaatgcacagaaatcttcatgcttagcaaatcaacaaacaaaaaagaaacgactattttgttataatttggctgcctttgcaaatcattatctataataaatgatataatctatatattttcaagagttttctgtctagtttaataccatttccaccatattttctccacacagtgttttaatctctttcatgcaacctaattcatgcatacataaaactgttttcaggcattagcactacattaatgctaagctacaaaaatgtttctatttcttagcataattagctttgctaatatttattcggacatttgaccacaaattgaaaagaggctttccttcttttgcatataatattatattcttaaattataatagcaaaatatcacttttttacttttaaaaattgaaattgtgttaaggcattttaggtgttttttcctttttttttttttttttttttggcacagggtctccactctacattgcccagaatggagtgcagtagccattcacagatgtgatcacagcacatgcatctttgaacgcttgccctggatcacgtgatcctcccatctcagactccagagtaactgagactacaggcacaagccactatgcctgacttagttttcttcattttttttttttttgagacggagtctcgctctgtcgcctaggctggagtgcagtggcaccatctcggctcactgcaagctccgcctcccgggtttgcgccattctcctacctcagcctcccaagtagctgggattgcaagcgtctgtcaccaccacacccggctaattttttgtatttttagtagagacggggtttcaccatagccagggtggtcttgatctcctgccctcatgatccgcccacctcagcctcccaaagtgctgggattacaggcgtgagccatcgcgcccagccagttttcttcattcttttgagatgaaaaggaaaagtagctaaagtttacagcctaaaaccccagctactttgagatttatgggcataggagagctaacacttagaggacagtacagctaacacatggggacacaacctgagtcttcttgacaggtaatcacaaacttgaaactgtgggaatattgaagtcctctttaaaacaagttctctatcttataactgtgtcttgcctcttcatatgcagcccaaatattctttcatcgtttaatttctgtatgtacaactaaagaaacttaaggaacaaaaatgactttaattttatagatttgacaagaacataagaaatctgtgttcttatagtctctggatctacaatggaatgatatcattccaataatttatgtaatatacttctttaaaggatttgatgaaatataaatatcacttcattacttatgtttatagattttttatacagagaaaacatgttattcattttttccctactatgagattgcagtaagtgctttgctctgcttctttcctgcaacaatgtagtgtcctcattaaaaataaagcagtcattgcttacatcctggtcctatcacattgcaatttcaaagttagttcataggcacaattgatatgtattttagattttcccttaaaacaaactgccaatgcatcgttcctataaatagtactgcactacttatgcattccaggacatccatgatgtaaaatattaaaaatatgccagatttacttgactatttttgaaatattaaattaaatattagatttaactaaaaggcaaggtgtatcttttgtgcataatttgttaaaagaagtggtgcatccttaattaaatttgcataaaaaggactaattacccttaagatgaaaattttctactacatttcactatatttccttaatctaaagctattataaccaatgtattaacaatgactcaatgtgcagaaccaaatagcagttctcttttattatgttacaactgtaattgccagggcacacatgacaactaacagcaaaccatgtcatactgaaacagaaatcattagtcaaatatcaggtactattccagaaaatgatggatgtttaagccattgtgactagccactcttacatgaggaaatcatttatgtctgaaaatatattgtccttcgagtctgattgtccttggaattgtaaatgcattctaatttcaaagacctaacgcttgttaaatgtcaatttctgacatgacattaaacaatgctttgcagttgaccatccttctggacattctgcttgttcaaactgtttattaatgataacattaatgacgattcactgtgcagtaaatttctcaccccaacatccaatatactgagaaacatttatcacaactttggtgactccacaaagctctacttgtctatgctggaatgaagtattggccagctcactagattagcattttaacagaaataaaccttgtgtatgaaataaaaagatgatagagaaagataaagagggcccccatccccttaaggcacttatctcataggcacaataaatatgtttttatttaagtttcatttaattcagggtaagcaaaatgaataaaccgtggttgaatcacagcagatctcacatgccattattctccaactcctgactaccaaggaaacatgactgactttattttggaaggttcagggaaactcatatgatactgtaatgttggttcctagcccagctagaaaaggaatactttcacttactcttgcaccatcatttccagctgtgccttcagcacctttttctcctatgccaccctgggaaaacacacaaaatacaattgattcatttaattgtctctttcccacacttgtgtgtaagtttcatgagagtgaaggctaattgtcattttcctagtcgtatccaggtgagcctgggatggtgcctcacactgtgcattttctcagtaaatgtttattagaagaatgaaaaatgaatgactagtgactcaggatggtagaaataaaagcctgctcaagaaatcatttcattttcagcagaaagtctgaataaatgaactgaaaaaaaaaaaaaaaaaaaaaggacttactctgtcacccttggggccaggagttcctgcaattcctctttctcccggcataccttgaagacctggtgggcctgtatctccaggggtcccagatggacctggactgccctaaaatgaaccaacattaagtgaccataccaataatattaagattaaactaatgaaattgctttttagtgggtcaaaagtagttgtcagcaatttcatgtagttcaacttagtgcttatatttttcatctgagaaagttgtctctgagtgagttgatattttgaaattaaaaaaaccagattttgtttttgattgctgctttatatttttaacttttctcttaagaggcaattgaacgctatttcaaataaaaaggatagagttgcctttttttccctctgttggcaacataatggaatatattaagaaagaaagacattacatttagagaaatatttcattctctctttaatgaaactgatatttgatattaacctggttttcaggctaatatagtgtctaaattgtagtagactgcatcaatcactctaaaccctgaaaataataaggggtctcatgtcacatgaccatgaaaaattctacttcaattgtttatactgaagttggccacattattttctaccaatcactaaatggcacacatttctgccttatgatgcattatattttcagattttaaaagttccatattttcacatatgtagtaagcagaattgtgaaacctgagacaaggaaaatggagcatattattagaaaagcctcctaataaattatgtaattttctatttctttcctctgtttattcatagaagccactaataaaatgtacataaacattagaaatgtgtttgtatatggaagtctatcaccatgtgcactaaactacaatccccatcaaagaagagagtcttctttttagctgacactttagttgcaaggaaaaagcctagtaagcgctcattaaatatttgtggaagaagaaaatgatataatcaaattatctttcaaaaacaagacaaatgcattctcacaccatcatgcgtttattaagcagtaattttaaagcattttaaaacactgagatcactatgacacttacttttgggccatcaggaccatgtcctccagccattcccttctcaccagggagtccagttatcccaggttctcctctttccccaggatttcctcgttctccctagcacaaaattgggatgtcaaataatctcaatacttgatctaaaaataggtcaaaatgtttctgagaaatggcttctactgcggaaaaattcagaaatgagacattactaaatctcaattttctaatttagtgataagaaataaatttgaagtaaggatatgctagtttcatagcacaaaatatttctcataaaattaatttttatccagtcaaagaatttataggttaaaataaatcccagtttaagattttaaaagacaccttttaaaactgaagccagtgggaaacaacattaatcatgaagattaaaatacttactctaggtcctaacgggccaactgctccgggatctccaggaacaccctataaacacattttttttttttaatggaacaagagctttgagtttaggcatttatcagaaaactttccagttcatacacctagtttctattaatgtgccattagaaggctgcataagccaacaatttaaagaaagaaaagtacgtatatttttataaatgagggaatattacatgttttagatgaaaacatttttccaaaaaactttgtattatacctgaatgtttgatttttggcaatgagaacatgcaaagtactatttcacaaagatagagcattagttttttagaggcaacaaaatacatgctaaatgtctttttttaaactaatggaagatgaaaaagtttaaataaagaaaagttatataaaaagggctaaagagttggtcttttaaatagaaccaatccaattctactcaattaagtaaatctttcttgagcctataatatggacaaagcactctactaggtattgtgcattcaaaccagtgcagtcatgtctaaattaaaagtttgtttgttcttacataaaagaaagtttgtcaatttgaaatttctttctttgataaagataactttatcaaataggcctccaatcttattctccgaaatggactgtcctcactgtggcctgatctccctaatcttatcatattactccttccttaaaaacccttcttttttcttttctggttttttttttttttttttttttttttgagacgttgtctcgctctatcacccaggctggagtacaatggtggcatgatcttggctcactgcaacctccacctcctggattaaagtgattctcctgcctcagcctcccaagtagctgggaatacaggcatgtgccaccatgcccaggtaatttttgtatttttagtacagacggttggccaggctggtctcgaactcctgatgccaagtgattcacctgcctcagtctcccaaagtgctgggattacaggtgtgagccactgtgcccagcctaaaaactcttccttagcttcccattactctaatgatgaagaacaaattagaatcaaattaaagccctccataatcaggcccctgagtcaccctgcagccccctttctattttccccaaattacattacccactctgatttgtaagcttgtctcatttcctggaggtttttcctatcttccctccttcatcattatcatcattcatctctcagatctcataaaagatattactttgtctggaaaacctttcctaaaacccccaagtcttatttaggtgcatcttttttgtttccataaacatagtacctcccttattatagcatttagagcatgctattattgtaattgtcctatactctctgaatcctactatactgtaaggacagcaaggtccaaatccattttgttcagctggttcaggccagtgctttgtagaggcaagcacacagagtgttcagcaaatatttattaaatgattaaatgaacaaatgaatcattcaaagaaaaataaataaatctatgagccaggaaaacgacagaataaaattgttagtatttgtccataactgtttatataaagtggttaagaacacatcttgggaagcagatgacctgggttcaaatctattaactgtgtgactttgggaaagttatctaacatctgtatgccccattttcctcatctacaaaatggagataatgatagtacctagtacatagggctgctttgagaactcaaagagataatgtatgtaaaggaaagcacaacagagcctcacacataaaaagtgataattgagccagcaatgtatagtgttgccattattattatttaaacacttacttgatcacctggttttccaccttctccaggaggccctggaggaccaggaagcccctaaaacaaaagtaagaaaataaaattgtgaatctgtgtaagtttaacaggctaccagtgttaacagtttaccttttacaattcatggggtctccaagactatattttcaatgaaaatatattgttcagacattttaagtaaaaaatattgttcagaagcattaaaaaaagactaccaataaaacacaacagctagtcaatttataggattgtattttcatctgcacaccacttagcaaaaaaagagataatgtaacaggagcttcttcatatttatagagtttttatggctctgtgaacaatattttagactgctagaatattatttaaagtcagtccagaaagttttttttacaaattatgatcttcctcctattaaataatgtacatactgatatatgtagataaattatgaaactttgttcaataaaaaattctagtcactgtgccgataaaacaaaatcagccttaaaatggtttcataaactttgttgagctatcagaaacattttattcctgatatctttttattacttttttgttattttttatttgttttgttcataatttgcaggtttgatcagtttttttagaagcccattcctttactttgaacaaaaatgttcgattttatccaaatgtctatactatctactaaaagagggatgactttttgaaaattgtagaatttcaaatcttctgaccatatctttttttttaaaaaaaaaaagcattttagttaatggaagatgaaatggaaaaccgaattagtgcatacctgaaaacctgtggggcctggaggtccttgttctcctctttcaccagctagaccctaagttgtgaaggagaaaataattgtgaatataaccagatctttgtctgcttcctctctacgtgaaccactagaagtactgatatttatttgtatttcttccaatcacatgtttttctctttagccaggtaataaactagtattaatagtaaccaaatggtattgtttgaagtctctggaggtgagaaaatatcttctaaagccagtaactgataacatgtatttattttttgatccaaacttaaatgtctggagccaattgtaaacttatggggaaattggattgaatataggaaaacccattacttttgtatatgtaatctaaaaacataatatttttattatagtttatttctgaatgtcttaagaattatttatcaagacttcaaaaacagaatgactaaagaaagcaaagctaacattttagaaagatttaaactgccccacccccccaaaaaaatatgccaaaatatttcggataaacacttcatttgaaagtcctaaaatgaaaatagacctcaaagaataagtattattccttttatgtcctaaaaaataccttaaataattttttttttttttttggagatggagtcttgctctgccacccaggctggagtgcaacggtgtaattttggttcactacaacctccgcctcccgggttcaagtgattctcctacctcagcctcctgaatagctaggattacaggcacatgccaccatgccaggctaatttttgtatttttaatagagacagggtttcaccatgttggccaggctggtcttgaactcctgacctcaggtaatccacctaccctggcctccctaagtgctgggattacaggcgtgagccaccatgcccggccttacataaatttttataagatgcattattgagagaaggtaaataattgagtatctaaatattttaaataaaatattttataaaatatttgttacacactgttttcttcagttgatatagtccttaactgtgacatataaaaacctttgcagtcagagttttacagaagtttaaagtaaaaagatcaatcattatatttaaaaaggcagaagacattatctcacagaaatcaaaagagaaggtataacagaaattcttcattcccatacattcttattcactttccctgaaacttacccataagtcttgaacaaacatcatcgaaaaaatgcaatgtgtgtatatatatattctcacacacacacacacaaaaatcacataccggcgggcccacaggaccagaaggaccaacttcaccatcttttccaggagctccctagtatcacacacagatatttgtgaggtgagtctatgataatttaaatagtacctacattatttttctttagcagaaaatgtatatttaccctctgcccaggaactccagcatttcctgcttctccaggtttcccagggtcaccctaaagaataaatgaaacttttgtataattccttcaatttgtcaaaaacatacctcctccaaatgaggatcatgatgaggtggccaacatattatacactgtactcacactgctacctttggggcctggaaggcccatgctcccgggctgccctctgattcctatggagcctggaggacctggacggccatcttcccctggcgcaccctatagaattgacaggagccatgtaagtttcatgtaagttgtttctaaacatagcatcacccaaagtgtcacctttgcttactatcatgttacataaattttaaattatcttgcattttcatgttaaagaatcaggacagttgaatgggttttttaaaaaacactgaagtattttaagtaactagaagagagattttattcttattctagatatgagcttcctcatgatgtctcctgacagtcatattaataggggaaatctttcttctttcatttactctggtttgtggtaatgaaaattcaggacttctatttcacattgcagaacaagggaagatcttagaatatataagttgtcaaaattcatacctacttatctcttaaacatataaaattagaaggatataaaaatgagaacattgctaatagacaaatttcaccaacattaaaaactatatcattttaacattttcactgatgtcaggcagggaagcaattcaatctcaaatatttatcttagtaaaaatttgatctacatttttgtcaacttgaaaatagatcctaagaatatgcttccagaagttggtacaaatatgtcaatatgaccagcatccatataatcaaaaacattaacctaaataaatatcatttaagttgcatgtctgttgaaaaatattagtggttgtggacttctgtttaaattacttaccaaaggtccaagttttccttcaggaccttgaacaccaggatttcctgtcaaaccctgaaaataaaaaaccaactgtcagtttgttgctgatatgcagttgaagtaaagattcttaagagtaaaaatagtgttgcatttttgtcaactgaatagaatgacatttctgtaaatcaaataaatttttaagtgatgtattgttaaaatttttcagaatttctctgccaaaattactttatttgctatattgctataaaagtatatttacaaatatttataaattctttacttgctaacaagttataaaatttgacaaacaggatttttttctcatgccaagtgataaagctattaatacatactgctttgagagagactagaagttaccgtgttttctatatatgataaaaataacaaaccagtattttttaaaataatgaattggatcaaaaccataaaaacaaagaaatgttctaaactgtaaaaacaaactaaatttaaaaacaaacaaaaacccgaccaatgcatgctcaggagcacttctcccctttgatgtagcaaacacttgctatattcttacccgagcacctggaagcccaggttcccctggacgtcctggatccccctggcttcctttgggtcctgaagaacctacaggaccccgttctccttgagcaccctgtaccgaggcaaagcagatgcatgaagaaaaagagtatagaaaaacaaaagcaagcagaagtaaaattatcgttttacaaatcaaggcactaatataacatacaaatcaaggcactgatataacgtataaaattttgtcaccacattccgccaactagcatccttcccccctatgcctcttaatacaggaattacacaagagaggattggggttaggcctggtatttgtatccatctcctttctggatctgagcccatgcaggccatagctagatcaccgtgctgaaaaatggcatcttctggagcaccccccacgtaagtatcaacattgacagggcaacctcacctttggcccaggtaaaccatcagagcctggaaaaccacgattgccaggagcaccctacaaatgaccaaaatgtgattcttaattgttgttgatatttttgcaatatgtaatgaataggtgatttttatttttagcactataaagttttaggagccatcatcaagccaacatggctatagatatgcatgagaaaaatctgactcgatggaaaaactttaaaattttgaagaatatataagtactgagccaaataattcctcaaatcaagaaatattctgcactttgggaggccaaggcaggcagatcacctgaggtcaggagttcaagaccagcctggccaacgtggtgaaaacctgtctctactaaaaatacaaaaattagctgggtatagtggcaagtgcctgtatcccagctactcaaaaggctgaggcacaagaatttcttgaaccttggacgcagaggttgcagtgagccaagatggtgccactgcactccagcctggacaacacagcaagactatgtcagaaaaaaaaaaggaagaaaggaaggaaggaagcaaggaaatattctaacgattcatagtaaaattaaacagagaaaactgatatctagagatgagaggcataggtaccatctatagcaattaaaatgtcaacaatgacatgcattagtgacatttttgtgaaacgctttgcattctccaaagctctagataaatgtgagattactgttcttcttttcagacctgtctcactgtgctccagtcacagctacctcttctggtctttaaaatcaccaggtcctttctgccctcccagctttgcatttgctttttcctctgctaagaatgttcttccttccaagttttctactggcttatcatcatcttcaggtctcagctaaaatgctatcttctcagaggatcctctttcctaaccacctaatctaacattacaacactgacatatatgtgtagttactctccaatgtgtcatgtctttacttagtgtgtgtatggcattttttaaagtgtgtacatatatttttatttacccattgacttgtttattgtttacctctccactaaaataaacaactatttactagtctccacatgaggactaggaccatagccttcttgttcactgatataattccaagcacagatggctcaaattggcatagactagtgatttaaccaatattagttgaatgtatgaataatgattagtcagttggctctttctatttgcacataactgtactgaactgtgcagggaacctgcaagcatttctcttaactgttctagttttccttactgttctcagacttacacacataattccctcacaactgtaagaatgtgttgtattatttaaatttaccctttctcccactggccctggaggaccaactgttcctgggtcacctctgggacctcttttgccttcttcaccgggtgggcctatcggaccctgaataccatgtggcccctgttaaaaacagaaggacagttaccagaaagacccatccaaccagtgaattatagttggaagcctaatttaacgaagtcagtcacaaattttaaagtatatggaacaatgagatattttcatctcaagctattataattctcattattattttaaacccttgagcattttgagctgtacacttccagacaatactatgttctacttatcattaaaacaatgaaaccttactggttccccttttgggccagcttctcctttgaaacctggaactcctggatcaccctgaaaaaaatatattgatatttgtaagaaccaggacatttagctagtccaatctgctcaaattagttacaataaataggctttaaaaattctctccagctgagtcggttttgcatcagtagtataatataatcatttttaaatgaatgcatgtgaatatgttaatatgtgtaaatttttataaaattcagtataatttggaagccatttaatttatagtggtctttaagagatttatttttaaaatcatgttttttatcatgtgtagtagaataaatagaattattgagttattattcaaatttgaaaattaaaattggaactatcaatgacaatttctatagataaatacatttaggctgtattttaggatgtgaacttgtttacccagaatcaaaataattttatatttatgccgtatttattgagaatttagcaacttcaaatagggcatttcactcttggaatgttagagggttttctgtaggtgtgtctttaaataccaactgaaatttaagttgtaagaactggattgcaaaattcagaacttggtaaaatcaaatgtgacactagcaacactaatgatttaataaatctgtcaccagcactttaagagaatttatcagcatgaccacattacttggaacagaattgtaaatatttatttaaatatttatttttatacatcaagctaaaagctattaagcacaacttctcaatgtgtttatttgttatgggttcatcaaaatattttttctaataaataatttctgtaaaatatgaaaacattcaatctgacattcaatctgattaatatatttgaatcactctttaacaataactctgaagaaatagttgttgaaccctagcctaattgtcattataaattcctattgaagctccatattcctcacactggcttgcataatattttcataatatttattattcaattattcataaaattctatgaggtgaaccataaagttataaccttattattttaaataaaagaacactaaaatttaacatactgcaataatgttccacttagaatttaaacatctaagttgtacctcaacatttagctttcacttcacaaagactcccatcttcccacatttggataagtcacgttatctatgtttcattgcatcacatgacatgttattactcttggccctcgtagttagattacactaaaggatgatagttctttcaaaggtcattaccggttggcctcgaattccctgaggaccagtgctaccctgaggtcctggagatccaggaggccctgctgagccaggaggaccagaggtacctggagagccctattaaacagcaagagtgatgtggtaagtagagacacaggtagcagtctggggccaatgtctaaagaatcatgcccatttgagcttcacatgccataaatgcagtactcaccgttgggcctttggcaccaggagtaccatcagttcctattgcaccctaaaaggtacattaaaagtatgtaatgaaatattaagcaatatatagatacaaatgtgctagtatacagatgtccagccatcttcaaaaaggaagtagaagcattttttaaaaatcaaccaccattatatcataaaaattacttttttgactacttctcctttacataaaataggtaaaacttacagagttgacaagggaaatatattttttcacagttgtaagcactcattcagaattcagagaatatattaaattttatatttcaaaatagctagaaaaagaggacttaaaatgttcccaacacatagaagtgatatatgctcaatgggatggatatcttaaataccctgacttgattattacacatcttaggcatataacagaacattacaggtaccccctaaatatgtacaaatattatgtatcaattaaaaaaataggttgaatttgttctgatgttacaagaaatgtccagctttctgggctggttcttaaatatgctagaaacttacaggaagacctggagagccaactggacctgggggcccagtttcacctctctgcccctgaggaccttcagggcctcgcgcccctgtaggacctgcttctccctaaaagggtgcaaagggaaatgttaatttaagaaaaatacgagagtggcattgtacaaagttgaccgcttatttggaattttacatttgaaacccaaatactgaaagaggccaaagaggattacaagagatgcgtgcccaaccaagcttaaggagcgcactcactttcccacttccttcttaagggatgacgctggtggcctcttcactaggaatattctccatatccaatctccagttgaagaagccctacaccagggttagcttaagttccctctcctctgaacctccacaaaatctgagatttttcttcccacacctatcagaatttacacttattacatattaaacagtttagataatctaagttcataaagaaaaactagaaacagccctacacctcaggcacactgagtctactcaaagaataagatagtcttaaatatcttttatttaagatatttatcaaagaatagatattcttaaatccacatggtttacttttagtatgttcttacataaatactcaggttattcaagcccatttctgtataaacagtgtatacattcggactctttaacacaaatcaaatgaaggagaaaaactgaccaacccactgtgcttaaagaggttgtttctgttcaatgtaaagctagatatttcaagtctaaaaatttactacaaaattaaagcttcatgcaatcatcagaggataaatcatattattttccaatatttataaaacaacctaatatcagctaaaatgtgctgcaagattagacaatagttttccaaatctgtgaaactcactgtaaaaagtctatataaaatttcataccatcattacagaacaataaattgtttccttgctatataagcaatataacaaatcatatttcagaatataagatttgagttgtaaaaactcagttccaccgaccttcaagaaagcatttatcagtaaagtgaaaaacatctgggctacaactttatttaagtctaatcaacttaatttttggcagcattataagcaaaataccatctatttttaaaccaaagaaacaatacttctttgataagaattaaaagatactttttaaagtgcaacattaagagcagagtgaagtggttaaggtaacttaatagctccctttatttcaagccaagatagtgagtccagctggcaaataaaaatgcctagttgagttttcattcatataaacaacaataacttttagcataagtttttcccatgcaatatttgaggcatacttatactaaacatgtattctttgctcatctgaaattcaaacttaacttggtttctgtattttatctggcttattatgtacctatgtggatctaatcctaaagaggcctggaaaactaaaattctaagccttaggaatctcatcagtatcagtaaagcatattgaatctctgtttcacttcattgaaatgcaaagaactggatttggaaatttattctttagtcagagagcagagaccatggcagaactttgtaggaaaagcaggatcctgtccaaaaacaaagatccaggaattttatggtggagagaagcaagaaggaaaacacagaaaatttctaacagaaacagttttgctagatatttgagttttattgagcagttttcagtagccaacaaccagtaccacaaacacccaggaggagagagaagtaaccagagtgaatggttgtgtaaactatgattgctagtgaagttaaagtaaaccccatgaaagttgtagtataaacctctttctgctaattcatagatttgtgagtatttccttaaccagaactcaatttggggacggagggtctcacaaaaagagggaagggattttgcatgttttgataggggtatatagagagtctgggccagagtctgtggtagtgacattattaggacttcagggagcagatcagattcagaggagaacccaacaagatcccacccacttgagttcacattgagttctcagtgaatgcagggaaaggaattaaggcactattttaaagcagcggcatccccatagcacagtgtttgaatatgtcattagagagagcctacagaataatttgacttggtgattctcacattttcaaggaatatctgaaatgtcagctacagacatttttcttctggtttgtttctaagtttaaatccaatttgagtagcacaactaataagaagcacgaacttacattgagggtgtcctctgcataaggccctatgtgatgagtttacatagatggtgtcacataatcctcaacaaaattccatgagaaaacaaagtttagaggggccaggtgactgtccgtgaccgcagtcatttttgtacagcataatcttgtgcataatctcttcaggattaagaatgtctttgcaaagggaaacatggcatcaggggaaatcagatgtgttatattgcttacaatttgaaagaggtgttctgaattaattcaccagtttatctaatgtaatcctaatgtccttctactgtcatccttgaatttatcccaaagtactgagagaaagaaccaattgtgattcactacaaatattaagtcatcccacagaatactttaatccattcccacatgaagagccaaatattctccgtgcccactcctttaatggcttcatagaattggattgtggagctgggggagtgcagagtgataacaaatgttaggtgaaaatgttagatgccttttgacagcatctaatttattttaacctcctaacctcctattgtttggaacattctgctgtttattacttccaggtactctattcaagaatagagaatagagttcctattcagtttaaagctcctattccttatagttgttttgactggctggcattagagtcctaacacatcaggttctttgatattataagggtacaattataagtaattctcctttaattatatttatacagttaattttattttttaatgtatctttttccatgtaataatgaaaaatgagcatactctaggctctttccttagttaaaagtaactttcacacttttcaattaattaaatgtcattcttcactttgggactcatgtaatcatgtagcgttaaatactgtatattaacattaacatcttaccttcattccaggatttcctggaaaaccagaagagcctggtatcccaagaggaccctattaaaagaaaccagaaaagtaatcagacatgtattcaattagtatctaattaggtcattttttagagtttggcgtcattttgtattagacacataagaataacctgcctttcactttaaaattacaaagataataggctaatttcattataagtaccttcaacatcaatctaaagtaatactaaaagacatatccaaggtattaaacataattggattactcaaatagcatataggattaagtcaatcacaaacataaagtgtttcaaacaattgcctcttgagagatgtactttctttgtgttaatcaaataatatagtttttagaaagttatattttatatcaaaatctagtacttcattctataaaaatgatgcttaagaaccatctggaggccaggcacggtggctcatgcctgtaatcccagcactttgggaggccaaggcaggcagatcacctgaggtcaggagttcgagaccagcctggccaacgtggtgaaacccagtctctactaaaaatacaaaaattagctgggtgtagtggctggcgcctataatcccagctacttgggaggctgaggcaggagaattgctggaacctgggaggtggaggttgtagtgagctgagatcacgccattgcactccaacctgcagtcagactccatctccaaaaaaaaaaaaaaaaaaaaaccatctggatattttagagaggtttttcaggcaataagtggatatttatggatatttatattaccctacatttgggaaggcatgcatagaatttaaaccattgattaaaagactaaatttaaaagaagtgagtataaaaggaattctagtacagattactctaactctaaggattgtactttagtctcatcagttttcaattaatagaagccctttcaaaatgtacatattttttcatcctatgttttgtttcctacttatgagaaacaagggagaaaagatccttggggcaaatgatttcaatttctataattatactttacttttggctaatagctttaaatttattttattttatgatcgttcagtcttggcccacgttgatcatgaatatttcctacaatactttctctctttccctcataatattttcttttcttggtgttttgttagcataatttaccttgtagagcttgactcagtttttcctgttgcagcaaaataaaattgttccatggactatttatttaggagcattttcagtaacaactttgtgctcaattactacattaaaaaatggctatagaaaacattttataaatatatttgtgctattacaaaacaccacttcttggtttcctgcaacagctatccacattgatgaccctgtgaaatcatctgtagagctttaaaaaatactgatttctgagtctacctctagagattacatttaaattggattggacatcaatatttttaagtttccaggtaattctagtgtatagccaaagttgagaaccactaatttcatgatgaacagataaagtttactacatgatgcctacaatataagtatgtacattttactagcaaccagtgttaataatatatgaaataatttattctagatatcattacatcttccttttaaaagtcagggcaccactattaaagtcacataatttgatgggaaaagcacatgtataataagttgctctaaagttcagaaaataactttatgtcttgaagctctttttaaaaattaaattagttttgttttgcttgtagagatataatttaagtgtccttgactgaataatagtagagaccttgatccatagcactgttacaattaaaatctacttcagttccacacatctcttaggatcctttgtacctctgggtaacacagcagttaatgggcagcaattgaggctattcacaagggagaactattgcaagtaatggaattttaaaaaggtaatatgcttgaaatgtgtcaaatttaaaatatttgcctttgtttataatttacatttgattctatgtttataatttacagatgattctttagtcttagccatcttcatttcatcatccacattacctggagatgatctttctggtcataaagttcctatgtttaaaatctctgaatgatctcacactaattattacagaaaagagctcaaaaaccctttaaatgggtaagtaagtatagccctttatgatctagatctagttataagtattcagattttcatcttcaagcgtgaattaaaggttcatagttacagaggattacctatgaaatagtgcaagatggtctgaagcaaaatacaatagccttgtccataccaagcacaaaaaagcacaatgtacaaaatattggtacacactgagacctcatcatttctcattccatgttacatttttactcccacagctgtatttattgcctgtatgttaaaaatttccaaaactacatttgaaattcaaatttctatcctgagctccactcttgcatatctaatcacgaaattgaattcatttattcccattctaaactcaaacccacaaacggtatgctgttcctctttctttatttccaatttcagataaattacatcatccatcaaacactttaaaccagaaatctactgggccatgcccatgagagttcttagctcattgacatgcagtcggcctctgttactaccataataactttagttcacatctttgtaatttctttctggaattatgccagtggtattcaaactcattctttattcttagccatcttcatttcatgttcaacattaccagcagattatcctctggtcataatgttcttatgtttaaaatccctgaatgatcgcacattaactactatagaaaagagctcaaaaaccatttaacatggtaagtataacccttcatgatatagctctcgcctctcaatccaattttaccttcctagaattttctgagcccactgtgttttgtcatctatctatcctatggacaatgctatattcttgcccattttatatattaaatacttatctttcaggacttggcttgaaagttgttcccataactgaagttgtatactgtattatggagttaacaattatgttatacaacaatattaatatctctctcttccttaatagaacagttttgaagaagtactatgtgtccatcaactttttattccaagtgtctggcatgtggtgagtgctctgtaaatgtttttgaatgtacaaatggaagaatgcatgaataaattaatgaattaatatgaaaataatataactcaccattggtccaggttttccaggcataccatgtgcacctcgttgtccctaattaagagaaaaagagacaagacaggataagattacattttagactatattttctcttatttgccttataaaaaatttccatattgcaaattgaagaataaatattaaagttaactgacaataaccctcactcagttaatagcaatataaatacatttacacaagctgatatggtagtcataaatgcatctatccttatagcaataagcaataaaatcaagattgagaaaatgaaactgattaaaatgattcttttactttaatgtatcatcttctaacatatgaactcagagacaatgaaaatttgaacacctcagtattcttaatagccagattaactcagagaagcaatgtccagaaaataaaatacacaagagagataaattaagttatagtgaattctgtaggtttcacccagagctcccttaagtactgaagtattcatcctgccagctggaaatataacctgctgatggctcactattgatacattccctaggaattgccctcagctaaagggaattagctctctcaagactgtgctctttccttggtcaatgcagggatacaaagcattggcccttatttgacacaagtctgcaagagccatctcagctccatagttcccctgaaattgactgagatctctgttgcaattgcaacacaattcaatttctccctctgaaaaaccctgcttttattcattccttccttcaaaaatacagtttctaagagcactcaccaataaatttcctgtactgtatacaagtcacttttttgaggctgtttcctaggaaacctgacctaagaccctaagaccattaatgtcagagtggttacaagaaagcaaactctaaagtgggatttgtaagctggatttcccactggtcagctggtgacagttggagtatgaatcacccttggcatgccgcgatggcacaatggaaaatattgtcaccaatggtgaacagagatattttaagggaatgggctagtaatgcaatatctcgggcatttgagaagaattaagaaaataacaattataaagctgatggaattgcatgggtcttgtatagtgcatctattggagaaagacactaaaaggctgatggtgataaatcaccaaagtaagactccttggcagcattttattttaattctcatctgcaaccagagagaagaaaaagctgaatatcaggccaagcacagggcttaatgcaagactatgagagctcttgggatggctgaattctcaaacctagaaagtctgttatgtcacagtcagggtcctggattgggaggagtcggattctgagatttggcaataggatatgtgggtcaacacactgaagaacttcagctgggcccggtgactcatgcctgtaattccagcactttgggaggctgagacaggaggattgcttgaagccaggagttttagacaagcttgggcaacaatgtgagaccctgtctctacaaaaaaaattagccaggaacggtggcatgcacctgtagtcccagctatttgggtgagagtatcgcttgagcccaggagttcaaggctacagtgagctatgattgtgccactgccctgtagcctgggcaacagagtaagaccctgtcctcaaaatttaaaggaaaaaaaagaaatttaaaatctcaggtccatctaaagtcacttggcctagagaagtggcccattccccccattaatagttggtagttctctcttgttgaagatgatacctaagcctctaatttggaagacaacttaagcctcacttctggacaccacaccaataactaacactactcctgattttttaaaaagatatcatacaccaaagcacctataagacctaaacatcgggtagaggcgggatctgagaaagaatgtatgggtcttggtcctgaagatactgtatcaaaaaaacagaatacaaagttggaaaattttaatgatgtggatacactgtctcgtgatattgcaatttaataccctggtaagaaccctgagaaatagtgctgacatgggagacagttcttagaaatgtgggaagagcaatagccaatgctggggcagaaatgtcagacctcccttggcagacagtagaagaaagcacagagaagtaagcatactatattgatagacgatgttagcctagataagccaatagctgactatattctataatattctctatatccccttaggacactctgcttactaaagtgataaagaatggcctggtgagagggtcttacactttccaaatcagggccctgaatttggtattgttgagtagctctgaggtggttgtcctctatgggctggaggtaatagcagagacagtgtaaacccgctattgctaatagtaatggggatgatcggatcttgaaataatagaggaaaggtggcagtccttaactatctaaagcaaggtaggtccaaagtaatgaactataagtctgaaatattagtcagcatagcctgatcttcagagaattgcgaaaagaataattagaatatgcctcctatacaggttcaagttacataaatagtctgcaagagtatttctcaatctgtataattaaaatgaatcaaggacaggtgatcaggaggctcacatctttcaaagagtgcactcagagtaaccaccttttaggagtatgaggaacataaaatgcttggaagaattcttggcatataataagctcttgataaatgtttcctattattgtaatttcattagtatatccaagtttgtgtttttctatggactatattccatgctgttatatgtattcattattttcttaatttttgtattaaagtagatgacaaatgtactgtggctatatgttaacattaaagcaaagggaaggttgttcaagaattctctgtactttcttttcaacttttctgtaaacctgactttattccaaaagaaaaagaaaaaaaaaaaaggtgaccagtactattactttcatttaaaaggcaagttcagtaaaccaaatctgaaaatgaattgaaatacacatctcagcagtataagtaaaagcagatatacttacaggagcaccctgtggcccaagtctccctctctctcctggcattcccctcggaccctatagacgatagagaagaaatgtctcttgaagcacctaatttgaaatgtagagtagtctgactaccccactcaatccaattgagattcaagataattggccaccaagcagtagtatttccaggggcaatgttgggtttgaaaaactatccccatgtggagataaataacctatcacctcttacataaatagatttcacttaacctggctttaatgggctaaatctgcgataatcttgatttgatcactgagtatagaaaaagaataagggcattcaaccgttaagagaaacagtgaaatgtgggaaaccttttctgttagaagggctcaactctcctgtgcttgtctatcagctggtaatcaagattattttactagccaacatatgttgtccatttatttttatttttcatttaaaaattctcttgttgtaatctaaaaggcaaggaaatataaccttagaaatttaagaaacaagaaaacgagcacataccagaggacccatggcacccattggaccagtggggccagcttcaccctaaaaaaaaatgagaatacattacagtatgagaagcctacaaccgatacatcactttgttctgtgtgtgtaattttaaaagcatattttcaaagaggacatatgaaagatgtacttttgatataggatctcagaatgttgttttattacctcttctcaaaatgcaatagtagtgtagttttaaagaaatacatctaaaataatattggggacttaagattgacggaaactatcatacctagccacagtaactagtctcaggaaaggacttatctggctatgtctgatacgtctcaagtaaaactttacaaagctaaaattgattgtaacactatcttaagatctattctaggagacttagaaataaaaaaaattttaaagccaaatgattttccacattaggtcatgatgctttccactagaaattcctttatacttccttgatgttttttctccctgtagaaatacaaataaattttgagaagaaacaatgaggagaaggtcttggtattaaaggggtactcaataatgggactaatgaactatctaaacctttcagatattttttaaaaagaaaaatgaatgattgtattttaaaagatagattcatagtgccatcttcatatgaagacaacactcatcctacactggcagacacccagtgctatggaggctattcttggaggcatatcaagtcatgtcatggtaaagccattgccactcatctttgaaaaattatgtttatttacctaaccatttgtttgtagccctctctcctgctgaattaaggtggttctgaaaaatgtgtaaacatttgaagcaaaactaagatgccaaagtgaggttacagtgagataattataagattaccttggaaccaggtgctccaacttcacctttagggccttcaagacctttgtgtccctgagaataaaaatgtaaatttgtatttgtatcctgtttttttcaatcctcaaaggcataagaaccaaaaataagcttgcagaaattgccttataaaaatgaatatcaaatttaaagttgttgctcaaaatactttcaaattctcaaacttttctgaaagcttattcaaggaaaattagagttttcacctttaaataacattttcagcttgcagtgttctcacccttcaaacacttgtgacttcatagaaatttaatctgtagctacaaataaaaaccttacagtggctttagaggaaacacataactacagagttcatattgttataaaatatcatttgtattcaaggtgaatgttcaaaatacttaataatgagtatagcagcagacatcttaatcaaaatctcaactactcaaaacagaggccagtgtatattgattgaatatcactatttgatattatgatagttagatagatgatagattctacatatgtaaacaatatataatagttacatcgtaattatcttcagtaataaggaaggcattctattgctttccaagtctaggtagactgggtcccttctgtgacctagtactctctatctctaccatgtcacctattacactatacaggaattgcctaccttttcatccgtatcccccattagcctgaagcttcaggctagagatttttctcattcatcactgtaccctcttttgtagcatagtgtccagtacatagtaagaattcaaaatatatttctttatcaaatcaaattaaactcaaaggaaatgtattaaaaaattgtgatttcagtaaccacagatgaatactgcaaccatagacagttaaggacaattgacaaattgacttgtaaagattttgaaggtaaatctccccagagcctgttcactaaaccacagtatctgagaggattacaatagattgaacttactcggtgacccttcagacctggaagaccaggagccccaggaaatccacgagctccctgggaggaaaacatagatagggcattttacagtcattaataaggatgcaaaattccttaatatatcattttttcccaaaaaatagctagtacacagttttccagcaacatattaagaagaacaaaaaaaagcagtatacttttatctgtcaaaatatatctgggtgatcaaaattagcaaagtaaatatgctattagaaatggaaacatgacttatacaaggatacaaagtaatgccaggtattgagttcatgacattttgaatttttcacatgatatcactgtgttataattagtagtgaaaacaaaacaagaacataagcatgaatcaatatgtccaacatgagaattgactataccaaggtagaaaaaaaatattcaggagagaaattcaagataaaatatccttttccttctttattgtgctttatttatggtacacgattaaatgtctttgtagcaaaccaatgtctttattttctatgaatttctgaatattggcagcagaatatgatgggaagaacagtattataatgtggtcaggaatttttaaaataaattgtttagaaaaaaactttgtggatttatgattatttaaaaaactaaatgaataaacaaaatatccaacagaaaagaaagtcaagaaatatgagaatgcttggtttcttgactaaataattacttaatttctgcaaattctatgtagctttcacctaaacacattaaataaaaaacaatagaaataccatagaaaatcaaatccagtggcacaactattttgaaatgatgcttgaaactttttccttatactgtcttaaaagatactaagctaatgacttaattatttacttattattatggcctatattaatttgattttgcattgaattgccattaccactgccgccagtatattgagcaccttgatagcattgattgatgtgatcacttattgattattattcttaatttatgtatagctggcacttagccttatgtttggttaatggacattcaatgaataatcactggataaacaactaaataaagaaatggtttgatatttcttactctcatagcactttaacctttcctaaggaatttctcttggcctagcatgatcttatacagataaaaaatccttctgctctgcaaatcataggtttcattcactatttctaaatggttgaataagcaactcaatggatgaaattcatataacaaaatcaaagcaataattcgtctgtgacctcttgaaagaaaattatttctttagtgttttagagggttatcacagtaggggtaaaacaaatcatgctctctgaacaaatgaagtcccattaattcttctgtttacacaaccccgctcaagaattctttcacatcaagaactccctttaagtgttcaacttaatgcctcattttacagagatttgtctcctctccatccttagcaggcaacttagtgcagacccgtctaagcctataggggaattgctgagctatgttatttcaaataattagttaacttcagtttttatggtctgcaagagaaattctcatgtgattacatatccctaatgtaacaagaaaatgaaccagatgtcctaatgctcataaaaattctcattctgctgacccaggactgtcattacagtgcaatcacacattgcactgagcttgcacagtgcatctgtggtgtgctggcagggcacccttcctccccatggagggcccacactgtgagcatgagcaagagtgcagcaggacatgggaagttcaaacctggatgggttgaaaaggacatctgtgctaatgactaaacctcatgtctctgtctgcatttatttcccaggctgatcgaggaggaaagaaagcagggagttgggaaattggtttatatttgcaaccaaataatcctttgagccttgcaaatttcccttaaaagataagggagcattcatttgtttaaaacatttcctagcattgaacctcatcaattttcagaaagtaaacagaaagtaatgtggtactgttgattgtactgagtggcagaaacataaggaaattataggaaatataataaatgggagagtgaatgtttaggggctgttgagcaggagaaacccaagaagtaggaatgtttgaagaggacttttgcttgcttatcatactctaattttccccatggccagcgtaacacattctagaagagggcctagcaaagcaatttgagtgacaagagacaggtgggttcagagaacggcaaaggggccaggtcttggattctggtggagtagttgccaggagtctattcttttagggagccaaaggggaagaaaacagctatgttaggagagctggaaatcagtgtaaattgtcatgattttaggacccagaacattaatcaagaatttcagccaaaattagggtttggggagcagccaaagaagcatcccatccataatttactgtctctagttgataaaaaacaaggcaacaagcttttcttcaagctattatttagacatatgtgacaatataaagtaaaaatattaaaaagattttaaagagctaaaataggattgaagtgtgaattgtaaacaggtcaagctggtaactcattttatgaaaaaaaaaaaactatttttttctgaattttctgaggatttgaaactcagtttggagagcattcatgttatgttcaatatacttctctagctccagaaggcttatttatggtgccaatgcaaagcagacaactggagttaacaatcactctggcaaaacgtcctgtgacattttacatttttacggaaacaaacaatgctgtttgtctccatttacttagtgcctgatacatgtgcatacagagaattgtgatttaattcaatgttctttatttttcaaagtttgcctttatgttgagtataaacttaccggagatcctgcaaatcccacttcaccaggatttccatttctgccaggttcaccctttatggaaaaaaatgtaggagattgggaaggcaaaagtgattaaaaggttcttctctgaaactaaatgataaataaattactaataaaacagtcttctttagaaagctaatgtacaattctctaaacagtgcaaaaaataaagtaaaaataggctctattccttatattcctgatagtactccattctatcaagttagtctgtggctttcattaatttacccagaagaataaattgttgaaaattttcttggtctgatgtagctcactattttatgaacatcaaaatttatacacataaacatacatgtatgctataggatatatactatagaattctatatgatcacatgacactgaattaaagtattgcttcttaaaatactactttccatttctttcctgtggttaaaaagaaaagactatcagaaatatgtgctctatgtccaaattcaatgtaacctgtttaaataaatcttatgactcataaagagaaaatatttattaatacttggtttagtatcatatagaaattaatggcctacccataatttgatcctcaactttggtacaactaagaatctagaaatgtaagtctgctattgcacactgttctctgattacatgttcttaatgttaaaatctggagttgggtcttaactttaattaaaaatccaattgaagaaatcattttttcatcattggggagccatattggcactatactactaacacgttttaaaaattccttttaaataagacctcataatgatgtattgccatcagagcaacatattttttctttcaggtaatttcagtggttccactaggaaaagttgttgctactgtgacaacaagcctagcatctaatggagaaatcttaacaaaaacccagggaattcaggaagagacagtagtacctaataacataatactacgcaaattaagagcccttttagatatttgtaaaattccattctgagtgctcctgtttacattgaatttaatgcaagctaaaagggtggggaaatgtaatggaaattaatacagaacattcttgttaacattttaaccccttcgcctcttcaaaacctgaatggaaaatgaggaaaggtagcttacatcttccccaggtttaccaggagggccctctggtccacgtgaaccaatcggaccctaataacagaacaaaacaaaaggaaaaaaagaatatttacctttacttgccagtaatacaattcaaaacattattgagacaaatgaaatgtcaaactattattgaaacaaatgaaaatgataaatattgttgagacagagaaaatagttttattaaagttttgaattttatgttgcatccccagatcatgtgctcaacaagaagtataattgcacaaaagcaaatcgctcagcactgtctaatgatcataatctttgaatgtaaatattctttgaatttttaaatttaaatttaaataaataaatttaaatagtctttgaatttaaatattctgctatgagaaacatatagcttaagaacagttcatagaacaggactcccaaactggattgttatttcttcctacattagggaggacctgggaagataaataactcaatatttgacatcattataatggtggacccaaatgtaactgggtctacatgcttacttgacatttaccattggtccaggatcaccaggttcaccaggaggtcctgtaggtcctgcaccaccctacagttgaaaacaaagtatatatacaaaccaaggaaaaatagaatattaaaccctgtactctgtcaatatacagtgtaattgtttagacagttggctctgccatcttccagctgtgtgactttgggcaagttacttaatctgtctgtaactgtttcctaatgtgtaaaatcagaataatattggtacttactttattaggctgttatggctgctgaagtaattaatgtatgttaagaacctagaatagtgctggcacagtgtgtgagtgctccatcaatggtagttctcctcatcaacatcatcatcatcaccatcatcaaccacattttctagtcactgatagcttgaagtaaaactccacacacatgacaatgacaatgtggtaaccttgactgaactaaaggttattttcattctttcttttaaaatattatttcctgatgcctgttaaattgctataataaataaaaatagttctacatcactattttactggcatctgataggcattttaaaagcatattgtattatattcttcctaaagatcccatggaacaaacatcttgattcttatttctaataatactacacggggattgcctcctatgatctgatttcatagcttcagagttggcatataaccaattgtgaacattttcatgacataacataatgaatttcttacttcagatgcaaagtcatgtaattttgttatcgaaggtcagtcacataaagaaatcagatgataaaaatttatcccaataaactttgcaaagacatgtggcatatatttctaaataaaaactatttaatatatcctgtttgaagtgagcattacaatataaaattttaaaaccagccaaaagcagtcatgtcacagagaccttatgtaatatatgtgtgtgtgtatgtttttcttacagcatgtaattaattataaagagacttacttgctgtccttgtaaaccctgtggtccccttgggccaacaggacccttaaaaacaaatgaggagaaacgttgcaaagtactcatgacaattaggtcaaatatttcaaaaatgttgaatcatctctagaatctggaaaagtgaagttttgacaaagggggatgatgacattctccatctgtactcatttggaaggcagctaaattcaaggagattaaagcttggacaacatttgggatgattttatacataacttcagtgttataaagagaaatgagccatatgtctgtacacacccaatgtctttagaacaagaacacttgcatgtttaatggatggttctgttaagtaagaacatccgaataaagaaaaatcttggctgacataagttagttctcaaacttcctatttaattcttcagattcacagcagataattcttataacttaaataagttgaattaaaggtttatgaaacatcaacaataatgactagattatattaaatgtgagttgaaaacgatttggggcactgagtttcctgggtgatttctttctttcacaacatagattgaaactatccacacaggctttcctcatttaaacatgaaatcgttccactgaggcataacaaaaggaagaaaacaaaaatgcgattttagaacatttattattatatgtatattactattttttaaatatcatactttaaaaagtaaaataaattaaaatcaaatttattctttttggatttttttttagacggagtctccctctgtcacccaggctggagtgcagtggcgcgacctgggctcactgcaagctccacctcccgggttcacgcctcagcctcccaagtagctgggactacaggcacctgccaccatgcccggctaattgttttgtatttttttttttttttttttagtagggacagggtttcatcgtgttagccagaatggtctcaatctcctgaccttgtgatccgtctgccatggcctcccaaagtgctgggagaacaggcgtgagccaccgtgcctggccaaaatcaaatttattcttatggcaagattttaattttttattttgaatggaacatatagtaagaaaagctccatttaaaaaaaaccacacatatgtaatttaaactccaaatggataaaaacatgcaactcaaaaaaaagttcccaaaagaatcactaaatgatgccatattactagtaactttaaaaatatacaaataatatttaaaatgctcacaacgctggccttaaggatggatagaaggggtggttatctatgaggtctgattttgcacttcttattgcctgaaatgctattaacctggaattattttgaactatgctatgagcaataaaacatgggagagttggttttaaaagtgttaatttattcaataaaattggattgctccaaatatccaggaaaaaaatgggagtctttctgatgttgaagaaattcaaaagagggtaagaatattgagaagactcagccaggaaaccatagagctgttggaataaggcagccagaggatattaagtagaaaataataaaaatgaaaatagcaaaacatctcatttcaaaattttaccaaaccactgtttctaagagcaccataaaatagttctgctttttatttataaaggtttaggttttactattgtggctgtggttatatgtcttaaactcctttattttcttccaatattaaataaaatgtacagatagacctttattaatgtcagcactttgcataattatgaatgaaacacactgggcttttaactggcatacagtagagtaaataagttaattaaatgaatgaatgaatgaatgtacgactgtgtttaagaagatgcatgttattctttgactagttaactcaagattctctttttaaaataatttttttcactgaagtacttcaatgatcagtaaaatttatgcttaccacagagccaggcattagtcctacttgactcccaagtccagatttttcatccaacccagccatttgagctgaaaacggctgtaaaagcgatatgttgacattatttctacagtaaaagacatacatcaacgtccttttcatatggataaatgtacactctctagaattcttatagaatgactcttctgagaatcattctaagtgcttgactttaaagcctggaaaaagacttaagttgctttgattgtttgtgctttttattgaccattctttcccagagtattgtataagtatgttgctccagagcagtttctgaaacagggcaaatgtctgatacttgataaaagcatggattgttctgataagcactagccagtctaattgattgcaggtttaagtctctttaactgatttcttcccacagttagagatgccaaacatctaaacaaagcctaaaagatgcctttaaaacatttgtcctaaagattccagattccattttggactgtttttggatgatattctttctttgttcaatgcccagtaaactttaaattacatttatgtaagttgataacacttttatagtccttttaatgaatccctgaatgttccaagtttggaaacagtttgacctactctctttcacaattaaaaaaccctagtaatcaaactgaccaaaattgttcatatacattttagtagtcacattagtttccaaattttgttaggaaagaatgtgtgtactgtttataaataaattggcaatttattctacaatctgttgagaaaaatgtgtatgaacttttgtaaagcaaaaatcatattcaggcttcatatgtttccttgttaaggtctcaatctacaggcatgcctcattttactgtgctttaccaatattatgtttattacaaattcaagtcttatggcaaccctgcaccaagcaagacaaccggtgccatgtttgcaatagcatgtgttcactctgtgtctctgtgtcacactttggtagttctcataatactttaatattattattgttcttattatatctgttatgatgatctgtgttcagtgatcttgatgttactaaagtagttgttttaggtgccttgaatgatgcccatacaagacaataaacttgatcaataaatattgtgtgtgttgttctaccaaccgggtgttccccatctctcttcctctccatgggcctccttattccctgagacacaacaacattaaaattaggtcaattaataacccaacaatggcctctaaatgttcaagtgaaagaaagagtctcacatctctcactttacattgtaagctagaaatggtctagtaaggaaggcatattgaaacccaagataggccaaagctagacctcttgcagcaaacagtcatccaacttatgaatgcaaaggaaaagttcttaaaaaattagaagcactacttcagtaaacacacaaataataagaaagtaaaacagccttaatgctaatatggagaaaggtttagtagtctggatagaagatcaaaccaaccacaacattatcttacccaaaatcgaatctagagcaaggccctaaccctcttcaattctgtgaaggctgaaagaagcaaggaagtggcagaagaaaagttggaagctagaaaatgttggtttatgaggttaaaggaaagaagccatctccataatataaaaatgcaaagtgaagcagcaaatgctgatgtagacactgcagcaagttatccagaagatcaagttagcatcattgatgaacgtggctacactcaacaatagactttcaatgtacacaaaacagccttctgttggaagaagatgccatctaggactttcatgtttagagagaaaaagtccatgcctggcttcaaagcttccaagaacaggcttattctcttgttaggggttaatgcagctggagactttaagctaagaccagtgtttatttcttattatggaaatcctagcatccttaggaattatgataaaacaactctgcctgtaccctataaatggaacaacaaggcctggataacagcacatctgtttacagcctttacagcattgtttactgaatatttcaagcccactattgagacctattgctcagaaacaaaggattcctttcaaaatattactgctcagtgacaatgcactaggtcacataagagttctgatggagatatacaaggatattaatgttgttttcatgcctgctaatacaaaaaccattttgcagcccatggatataaataaatttcaacttttaaatcttattacttaagaatataatgttcaaagtaaattgagaatcttctggaaaggatttatcattctaggtgccattaagaacattcttaattgattggtgaaaatataagcctcaagagaagtttggaagaagttgattccaaccttcatgaatgaattttagtggctgaagactgcattgggggaagtaattgcagatatgatggcaatagcaacagaactagaattataagtagagcctgaagatgttgcttaattactgtaatctcataataaaactttaacagatgaggacttgcttcttatgaatgagcaaagaaagtcgtttctcaagatgcagtctattcctggtgaagatactgtgaagattgttgaaatgacaacaaaggattttgatatggcaaacttcattgttgtcttattttttaaattaccatagcaattccaggcttcagcaataccacccttattagtcagcaactatcagcatcaaagcaaaacaccctatcagcaaaaagattatggcttgctgaaaggtcagatgattattagcaatttttaacaataaggtatttttaataaagaaatataccttgttttttagacataatgctattacacactttataacagactatattgtggaaaaacataagtttatatgcactgggaaacaaaaaaaaattcacataactcactttactgcagtatttcactttattgaggtggtttggaactgaacccacaatatctccatggtttgcctgtacttataaatcccctatgtctgacattaacaattcaaagaagtcggtattgaaaggctttttgtttgactttacttcaagtaaaaaaactaaaattgaagaaataattaggtgtcatttttagtgtcaactcaatggccttctcatatccctcatcatggatgtgtcatcctctcttgtggaggatacggagcagatttttttggcattctgagcctagagaataggacagataaatctctcatttcatttaaagagggggaaagcagtggttctttagaatcaatagaaaaaacaaagcacatagagtctagagctgacattgagaaatacaaacaatttgaagcagtactttagaaaatacttcttccaatttttccaacaattccctgtgggtttattagttctactgtccatagcagtgttgaccttatttaactgctcttacagtcaagtgtcaatatctgaacagacacaatttaaaatcctaacaatatatcaataatttaaaacatgacctgtacgtgacatcaaacaatgcacacaactcaccctgctcaagccatcgggtcctgggtgggacggatgtccaggaggtcctggagcaccaggttgaccaggaacacctggttctccatcaattccctgaggtccacgagggccctggaaaacaagccagttaaaattagaacccactgccaaatatacacttagtagaaagctaaaggcacagacttcttaatggcaagggagtgtttattattttaaaaatacatggcaatctagccacttagagtaatttcatcagccatgtcactactgatttcagcataggtctgaacttctaccattcggatgtggtctgggtaagaattttatgtggtgtgttaaatacccagaaatcagcattcttagaataattatttttaaaattttcagttcaacagtattctaaagtgaacttccttatttgattgagtttttgccgtgcaagggtatttgatcaacaattataaattcacttgtctgtcactgaaattacagtggattgtcattggattacagttaactatgtatacgtctgcttaacttctcccttccccccaaaattcaagaatcccttgattggagtttgtagagattttctgtctaattgtttaatgctttgcatagttcctggtacatactagacactcaatacatgcatattatattgttacctttcagtcctctttaatactttaaagcctggcacactttattttacttcccacccccagaggaagactagaccattgagaaattagaggcaaaggcactgtgacccagccaagtctaagttctcagagaagtgagcaatgatttctagctgccaaattccacccttctcctaacccacattctgaaggcagcttggggaacagccacgtcctcagttctggaaatgctccgtcctctaacctcatcattcccacaaggctagttaagtattttctggctccttaaccctaaagaatcttgaaaggcttcaaaaagaaaggaccaaaaagtcatcaggcaatatgctttttataattataagcagggatcaagggaaatatggtaaatgaagtttaatagttaaaaaaagaactcccatgcttaaacatgagaatacctatgggaccacagtaagcaattcaaataggagctgatagtgcagagggagcaaacacaggacaagctcaggtggtggaggtggcagtttgtatatgatggttttggggagggtggcatcatagctattcagaaatttaattattttaatatatttaaacatttatatagacatatttacttcttgcagtagtgggacaaacaagcaaatttatctattaaatagaagtagaatacttagcctgaaaaacttatatttaaaaatgatatcttagaaaattattctcagtttttaaaaatcaaaacttttctgactcctaaactactaacaatttacttcacacttcattatacacaacagaggctgatttcaattgttctctaggactcctggatcatatgaatgagagtaacatgaactggatatgtatatgacagcacagacaaaataatagtctggtttattcatacagccttgtgtagaaaactctgattctgttcttgcaatgctcagttgctaattaataaccagatattattacatacaaaaagtgaactaatgcataatctctgctcccaatgagagttccaaagagacatacacaaaactatatttattgtcaacaggagtggagataagtttgagaaatattcattagtcctccaaagagattgtgactttctccattcttctgtaattaacacttcgtatttcaaagtctgatcctaagattgttttcattgacttcagattcattatatgtctccacggaatgccctctaaatagcttatgaaatttactgttgcacagattaagattaaaattaataaaaacgtctataaaaattatctaaaattaagtgaacacaagaatgtttaccggtaaatatcaaaagcaaattagaatttgggagctcattaaaagtatctatttttatatctccaagtgagctgaattacataattcttatattaaggtaaatgttacatttattatcattcccttccatttccaagatactcaaatacctccgcagtaatctacaataaaaaagtactttgaggttgccactaggtggcgatgtttaaacatccacaagtagaaaagacgaatgaccgggaactgttaaagaacttcatttctctcgtttctctctctctctctttctctctgacacacacacacacacacacacacacacacacacacacacacacacacacacacacacataaatgttatagatgttaagatctagtatatttcccattttacagatcaagaaacataccaatagtggttaagtgtcatgtgcaactagaacttagcacatcattgacggtccatctcctgacagtttgctagcttgtcactatgaagttatctgaacaatacacttaaaactgaggacgtgtgatgagagacagtcatgaaaatcattggctaatcctgaaggtcttgtaggagtatctcatactgaactactgacatactagttctcagtccagagctattttgcctggatttggcaatgtcaagaaacatttttaactgtcacaattgtatgggggatggcagtttcaactggcatctagtgggtagataccaggaatgccgcaaaacttcctacaatgcatatggaattatttggcctaacatatcaatagtgttaacagtgagaaaccatgctgtacattgtgagccttccgtactgtttgatggtaatataatggtgggggtgggggaatgctatttatgatattgtgacagccataattttagtccagctaagcagctcccagaaggcttgagacatgaggcaaaacattctacctatgggcattctgttacatcatgcccatcatttcatatacatcatttcatgcaaagctatacatcatttcatatcttgaaatcggtgtaggcaggcattaaaagatttgttaaacacttaccatcacaccagttctttgctaggattaagagaggaacagatttcctacttggatatctgccagggttgtctcacttgattcctcctaaaaatctacccccctttctccctctctctctctcgctctttcatacacacacacacaaacacacacacacaacacgcacacacttatacccaattcacattgattgtctcaggcctaaccaagacaggaaattgaccacatcacaaagtcaaatagggaaaataagtgagaagggttggggagtagattctttggatcttaaccaggaactctggaagtctggtcctacaacaacttctacctagacttaggacccaatgttatcaattacttacagtgtacaaatacaccaatgcaaaatctttttttttttttctgtcacgaccacccatcctccacccaactgatgttattttctacctatttctgtctttctagatctaggagagacatctggagacctacagcagtgtttaagctaccaacactagtgagaaaactcaatacaaccacagtgaagaatggggcatataataatctggacacaccccaagatatggccaatctcttggggcactgctttgcacctacatgcctgcaagtaacatccatagtgcagccccgtttaagaaaaagtactgacatcacactatatatgaggtgaaatgagtagaaggataatgtagtaacaagaatgaaactagtggcaagagttcctaggcatatgatctaaaatatattttatcctcatttatatattcaaacttgtctgctgtttgcttatcttctaatcctcccatttaaatatggataaatatatatttaaaaggataaaaatctactgagagttttaatagatacattagagaaaaaattaaacagtacaaacaaaattttctaattgaaacatgggataatgggagcaatatacaaatgaatacagttatttagtatatgaaagacattagattttagaagtgatacataagaaaaaacgttgtagggaggccgaggcgggcggatcacatcctggctaacacggtgaaaactcgtctctactaaaaaatacaaaaaattagctgggcatggtggcgggcaactgtagtcccagctactcgggaggctgaggcaggagaatggcgtgaaccagggaggcggagcttgcagtgagccgagatcacaccactgcactccagcctgggtgacagagcgagactccgtctcaaaaaaaaaaaaaaaaagaaaaaaaaagttgtaactctaacacttgagaacaatatgtattctgtgcagataggtaataaaagaaaacctttggtatatattatataatatcctcatgttttatctcaaagatattgaggtcactattttattgtaaaggtatttcacttgtctagtaatgggattgctgatttttaaaactactcctttgctatctctgcagtggctgctgagtgaaaaaggcggagtgctacctgggaaataaacttgttgtgcaaccacttgaaagaaaattttatcctctaacaattttttcccgtatccagcttggttattcctgtggcaaccacagatcatataacttggatgttttatctcaacagtgcattcttggcattgcttactcatgagtgaaactcatgacatgttaactatgcttccttaagttctactttattttgatttgacctcataagggacaaggaaatatcatttgtgttatctaataagataatatacaattattattgtatttttgtaaaatttaatggaggtgaaagaggaatagtgctcccagcttcttgctgcattcagagaacacagtgtaaactgactggctgtacgttccccacaaggagccctcctgtcaacttacaggtcttccttttggccctcgctctcctcttggtccctgtgatcctggaggtccctaaaacagaaaatgatgattatgcatgcaaaaatgtatactttcttattgaatttttaaaagtctacttgataaaagaaaattggaaaacagaaataccacacttaattcagttcagttgaagactatagagaataaagccatgtgcatataaaagttctgtacgcttagaagcgttgtttatgttatcagtgacatttaaagacctatgaagaactaggtgcacattatggcatcatggagcatagtgagctaaatagattagcttgactagtaattgcaaatttttaaggatcatatttgctgtcttctcccaggtaaagcctttgccactaaactctgagcacaaaaacttacaattctgattttgaaaattacataaatgtgcaaaatacaaattatcaattattccagggactgtatgaaatcaaattggtacatgataccccaaaatgttcatcactgttcaagttgctgataaaagcaatggaaaggaaagcctcttagcctactacagtactgctttatgtacactcaagcatcttttctttttactttacttagaatattgcattacttcccttgtatgtttaaaacccacttagaaatttccaaatcttaattacagttacttttcccttaaataacaaatgactattatatttcaaaagtggtgttattgtgctgatatcttaaaatgtttttccccccctgggaaatggctgttgccagggggactttgtttctctttaaaagaggatttaaactgagttatgaagattatattgtgtatttactcaacccaacatatagcatcgtttaaaagtgagggcttcagaagaaccagagtgagtccattaaagctaacttagtattttaagctgatttgatgtgtttaacatttacatgaagtgtgtgtatatgttatgaatactgctgataatccaaacttgaaaaaattaatcttttatactaagccataaatatgctctcctgctgtatgatttctcaaattctactgcaatatataattttattaagcagataaaactagcctaccattaatcatagtcaaacaacacacaagtatgccctaatttcagtgaacaaagtcacactaaaattaacaaatgtaacaataaagtgttttgtcttttacataaccaatagcaagactaacataatgtttcttcagtttcagaataaaatgatcccttatctaccattcattgctgcaaagcaatgtctaacttgaagatggtttaagacaaaatgttttaagagaccaagtatcattgtttaattcttttatcttctcatggatataatatctgtaaagattttcagtatctcaaggaatacaagagtaccaagaatattgggagaaactacttactgccggtcctggacgaccacgtatgcctgttacctaaacaataaacaagaaaatttgtaaaggtaaagtttctgcagatattcagagaggtcaatagtaacaaataagaataacaacaaaaaccacagtaatttttttaacaaatggatgttgtcaattgatgaccatttcctcctctccttaagatttaagatattatctagttttaactaatatagggaggcagtgctggcgtaatgataaagagcaccaacactggagccaaggggcctgggttcaaatcccgacactaccctttaccagatgtgtgactttggactaattacttatcctctctgttcttaaggatcttaagtggaaacttaaatgtaaaatggtagtgatgattaggtaattacctccctcatagagttatgaagacaaataaataaatatttgtatttgtaaagcacttaacacctaagacatagtaagcacacataaatgctttttaaaattaaataaaacaatatgaattatttaagttttaggtaatcttcgttaaaaaaacaagccaattaaaggcaaatagagaatgtaaacactgctaaataaatcaacatgcatattctttttgtcttgacagactgatgataacacctttaaaacttaggagaatgaggccaaggtgggtggatcacttgaggtcaggagttgaagaccagcccggccaaactggtgaaaccccgtctttactaaaaatacaaaatttagccaggcatggtggctcttgcctgtagtcccagctgctcgggaggctgaggcacaagaatcacttgaatctgggaggtggaggttgcagtgaactgagattgtgccactgcactccagcctgggtaacagagcgagactctgtttcaaaaaaataaaaataaaaaataatgaaacctgacagaacgacagttgaagagctttaatcctgtttagtaacatacttcttgatccatttacaagtttaaagaagtcttaggaattcttatgcaacagggaattttgctcaggatcagggcatgatgtatttccagaagtgtggaataataaactactatactaactagtactaatattaactatcagtgtatatccacatgtaatatatttaactttttaaaacaatgactttctacctttagtcatgggactataaaagtcaggaacacagaatatcaaatattgtattaaataactaatctgttctggtttgcttgtgttatactaaaaacttgtttttaaaataactaatttatttttgaaagtatgtacataagcaataatatacaattatactataagctaagtttatttaaggtacaaggaaacaatgattatacatatacttacaacaggcactaatcctggttctcccttttgtccctgtgacattaaaaacaattcaaaaattcaattagcacaatataatggcttgctgggcaaaaacatgtcaccctagaatatgccatgtaaacacagggaatttctatgtaagaaatgcaaaaaactacaaaaagaaagttaacaatttttaggatatttagtcagatattactcattaaaatattactgctcacctgaaagacataaaaaaatccagcgtgtgaaatatgtaaagctattttgcttcagtttccacatagatcaaatccaaagagttgactagagcacaaaatagttgcaacaaaaagatgtaaagacaaagcaccagaggaaaaactactgaaagactgaaaacacaaaaagagccagaaattgtaatacataaaaattaatataaattaatatatacaaattttcacacttttatcatatgacacatagttttcaggatctaatcagatgccattcctgaactactagcacccttttttagtactcatggaagggcattaaaaatgagtacatgtgctcatctttaataaaaagaaagaaaaaaataataattccactcagatgattctcaatacctgaagaaaatctaggaaaaaaaatcaattgactaagaaaatcaaaaacaacataagaaactatcatgtaagtaaatagggtcaggtcaatataattgcttttataatagatatagcaaatgtaatagatgtagatagaatttattttgtttcttagaacttttctcagaaatggaatcctcattgcatgatatcaggtacatagattaaataatattggatgaattgtagctttatctatttctacttaatcatttactaatttgtattcttcatttcaaaatttgtcttcgaacagattttggtctcctcaaagtcatggttgtgtcttagtctacttcacatgctcagcatagcaaatggaagcattcaatgaatttttaaaatgtattactttccattaatatattaagaaataatgctttttactgggcaattgtgtaggatgaatatgaatttaacatctctaaaatgtagaaaaacacaagaagaatgagttctagtttattttatttctcctttcatatatattatcctttaatctgattataaaaatactatgtgttcatagcaggaaattttgaaaatagaagaaatattttttaaaaaaccctaaatatcctactcaacaccccggagataaccactgttaatatgctggcattcttagttttccaccatctacatgcactttgagtatctaatcaatgcctcattatcttactcttaaattttgttttcatttttaagtttaagaatgacattaaaatgaatatctttgtttataaatgtgtccatggtatctctgattaataccttatgatatgtttttagaagttaaatttgtggactaaagacattttaagtttttaacccatatcaccaaattgtactactaaagatacaatctacttatatccttccaatactatcctgacaaaacttcatgaagtgaaatgatggacttaagggcggaactaataataactcagtcacagttgctgattctaatgttgaagcagcgaatactctggaagtaaggaataaattgagaatccaaaagaaggaaagggctctccagaagcaggaggcagttctatagggtaagttcaagattgaaacactagggactaatagccaacctacacaaagcctaggacaagaaagaatcaacatatatgggcttcaaagtaaaataggcttatttctgcatgttcacatccactaacttctagagtctttctattttaaaaaatacaaaaataataaaatttaaccatgtaagagctataataaaagatatttttcaaaatgctgaaagaatttgaattgtttagaaagggtacataaatttttgtgcaataaacaaaggactttatgatgctgaaacaatgctccttctagaggaagactagaagaacaaataaaaagagaggacaaattgtttcagtcagaatgagaaaaatggaacagcctgctaagaatagttgtgaaatttccatcctaagagacctacaagcaaaatgcactttatacttgctttatatgtaggggaatagaactctctgatacctgtcttacctaaattgtaggctttttgatatatgactgttctgttgctgcacaatatttaaaaggggttaagtgttcaattataagtttctaataataaattccctaatgattctatagatttcttattttggatataagccacaaatgtaaatatttgtttctattgtttgtattaatataggctttgaataagttaatttgtatggaataatggtctgtctaaagttttactaaatttaattttcatatccactgagaaacataaagttcatgtactcagatccagatgtgcattacaattacttatcatttaataccatgtggacatgctttgtagaatgtcattaccatggaagcagttatagtgtttttctcacatttgcatcatctataccatttgcctcatagccatataaaaaaggttcagtaattatgttggagttaacatgaattaatgaatgaatcaatcggtcaatgagttgtaagtaaatatcaaagtggatataaacgaagaacaaattgcatttttataacattgctttgctcttgtgtttctgatgatacctgatgacaaatgaaaacaagtcatgaagatagtggcacataaccacagtctgctacattggcagctgctttgagtatattcttcacccagctctcccacactacttttggagaaaggcagcaaatgacacagcctaccagttatctctctaagtcgggtaactgctaactgaattaaaatgattatttcatggcagtactcattgttaggattttttgttgtttcatagattggtctgtctctctatctgtctatccatgcatccatgcatccatccatctatctttcacctatctgtcaagtttgttcaaggcctataccaatctgctaagtttcaatttattttcgttttcacaataaattaaatgtgaaatagcatttgcagcccttctcctttgacatatattcatatctaatttattccaaatgagacaaatttatgatattgccctctgaatcaaaatgtgtaaaactggccaggatctccccttgatagcatcactcttacttatcatgaatgtgtagcattgctttatctgttatctgataaatcattttattaaagttccactgtgtgcaaaagtaaagaaaatttatggaaattgggaccagcaacagtttctactgccttgatccctgtgcccatctcatttggatacaactgaagtaaatgccataattttcaagataaccaaaaaacagagagcactcttgggcaaaaagaactatcttcgcttcgtaggattaccttattgatggcaagtgaccaagctgaccagctatactcgggtcatggatgcagcctaccctgttttcaagtgtaaagcttgtgtccagaattagattttaagctctctgaaggtgaaggaggggagaggaggggaagaaatgtctgtttggtaaaatgttcaattaattctggatctttacttcccaaccaatgagagaggggctacaggcccattgaagtcaaattgacattcttcgttccttccttccttcctccctcactttcttccttcctccttcccttcctcctatcttttctttcttccatcaaatgtgtattgtacttctaatatgtgcaaagtatgtactatgcaatgacaaatgcaaagaataaaaggttaatcagacattttcaatccctaaagatgtcacaactttctggcagaaacagatatacaaacagaaattaaccataaagtgaatggttaagaggcatctgtcctttggaaacacagtagctgaactgtgcttatatacttgtcacaatgtatttgtatggtactttgtacttttcaaaagctttcaaacgtttcagagcacagttctgtgtggatagtattggatataagtctgcttatgaaaaagaaaatatgcaaagtaacacttacctttcttcctctacctgtaaaaagaaaagagtaaatgtgttattttatgaggaaacaattattgagaatctgctaaatatttactttcaataatagatttcttctggagtcagaattacagtgatagtgattacactatcagcagtaagcagaattcaaaaggttttggatcaatacttccataaaaggcaaaaaatgcatctttttggaaaattctaacatgatattaatattcttcacaacatttatatgacatttaaagttcattaaattattaaattagctattaaagctataatgaattatctttcatcaatattctccatttttgctttttataattttatgagcaaggctgtttattcatatggttcaaaagcaaaaatgtattaaaagtatacaattatacactaaaaaatgtcattccatctggtcctgtgttccctatttccactttacccccacccccacaggaggccactattattggtttctcgtatgttgttctcaagtttagtttggaatatttaagaaaattattacagactcatttttctactttttccatactgttcttcacttgtctgtatatcacatagttcattaaatcttacagatctttgctcatcagtatatagtttctttattgtttttcttaatttttttataagattccactgtattaatctaacacaatctatttaactaattttgacctttacccattagggacatttggattgtttctaatcttttgttatcactaggatgtactttatcatctaaccaggacacttttaagaatgaaagtgaaagttattgtttattatgccaagaaaattgatgtaatttggggttttcctaggcaagctagaatgaaggtcatgctggctattaaaaataatattgtaatgagtaattgttacgtatacgctacatgcaagtatatttgtaagataaattccccaatatcctttttgagttaaaggtataggcattggtaacttgatagatactaccaatatcctttcatagaaattataccactttacactccacaaataatggacacatttccccacaggcaatatgcagtgatacccagtatgctatcaaacattttaattttggccaatctgataggtaaaacatgatagctcagtatagttttcattcacatattttattatgagaaaatttgacagttttgtcatatattgaaaaatcatttgtatttccttgttcgaatgattagctaatttcccttgcctatatttttattaggttattgatattttaattatttatatctagtatttctttatatgtaaagaatattaattctttgtgaattgagttgcaaacatttctactttgctcattttttgtgtcacacaaatgtttattatttttgtacatttttatgccttctgggctttgagtcagaattcataaagtcatatattttagaagactataaagaaattatcctatgttatctttgaaatcattatgatttaatttttctcatttaaatcactgctttatttataatttgtgctagtgtagaatatatttttattattcaacttcatttttttccagatgattgcctagccattccaacaaggtttatgaaataattcttcttttctccactgctacgatgccatctttattgtattcaatctgaccatgtatatttggatctacttcaagattttattttattcatgtatctacatcacattttttaaactaatgaatcctttttaaaatcttgtagggctagtcatccttaattgctcttattcttaaggatttgcctgattattctttcttgtgtagtctatgaaaattttaacttgcaatatgttgaattctcaaagaaagtgtgctatgtttatattgagatcatgttaaaatcactaattaacttatggagaatttatgtgagtgtaatgtttagtctttctaaccaagaacataataggacattcagtcttttaaatacttagtttgaattagcagtattaaaaaattttcatcagatctcatacattttgtgttaagttatccttaagtgtctgttgctattacaaatgaggaatttttattcctattatttcttctatgatgtaattgtttatacatagtaaacctattaatttctgcttgttaattttgcactctcatgtcttactaaattcttttattttttgtagttttatttttactcaatttaataggtttgtaagcatacaattgtattttctgcaaatggatagtttttgctcctctttttagagttttgaaacctctgatttctttttttaatgtcaaattatttattcaggcacattcagtactgttaaatggtaatggtgataatggatactcagtctatctttgtgtttagtagggatgcttttagtattaagcataatgaaacttttaagttgagatgtaaatattgtattatgttagtatcatttattaccaagttagtaactgtctttatcaaaagtatttactgatcattgtcaaatacttttactttaattatgaaagaattcatatactttctcttcatagatctgttaagataattatttttattaatagcttccttaatagtcaattattttgcacttgtggaataatcgccactttttcatgaataattactctcttaatatgctaatagacttaatattttatttagaattgtaaaaaaaatttatgagatcagttcatagttttttgtgtgtgtcattgttattacttttgctgtaaataatatacttccttcatagtaaaactttgaaagtttgctgtctctttcaatgttcaagaagaggatttaaaagcattaaaaccatctgatttctttttaagaccttttagttgtttgacacaactgtgaaaacacctggacttgctgctttgggaatctagctgctttgcaaatttctctgtttcttctaagaaaatccatgttctaagattttctgtttctaccagagctagtcttagtaaattacattgtcttagaaaattattcatattagttttcaaatttatgaagatacagttgaataaagggacctcttaatgattctttcatgttgttttactttcattaggtaattttttctttatcattttttgctttaggttagatcttttggttgggtttttatgggaccatgttttggatttacatattatttctactatatttcagttttctcacttttcaacttctgtttttatctttacaatttttttcttccacttactttcagtttattttgttgattctttttaactttttgagaaagatgctaaatgcacatacttttattctttctttttatttatataagcatagaactatgattttttgttaaaattttaaaaataaaatgtttcactgtgttttcaagtatctttgtttggtgtgttagaacttcttatgtttaaaaagatttatatattagttctatcaattatattccatattctgctaaattatgttaacattcttttacattactcatagatctgtatttgtttagacagtttctattagttccactaaaatgagcaatgataaaattgacagtgtttcttttttcttacatgccgctcaggttttcttctagcattccattttaacaaggaaatgttctttttagcatttatttttgtagtgttaaatgtgccactactttgttcatgtgatttgtcaggtttgaatgatattatctgactttcacctttaaagatgaggaattaccaaactcactctagttcatactttcttttgcctccccctttcattatatatgttttataattatttctgcattgtcagaagctataatatttacaatcccatctgtcaccctaagttacacttttgttttagtctttttctagatttaaatataataaatgctcacataagttctttgacagtttcttcaattaactcttggttgccttgcatttagccgatggtagtttccctgagaaatttatagaaacaataaccccacagaaatgcttttactgtagcttttatatttgaaggagagaatggatttatatttaactttaattaaccatattatctccttaagaaatatgtatatattgctccactgtcttctgacactggatactgtggagaaatttgtgaccagtcttaacaacttttcccttgagaaataatctgttcttattctttgacattctaaagaagtatttatttatctttaaagtttaatgacttcattaagttacatatgtctctgttaactcttttaggtcaatttttcagacatgtggttgccatttcaatattgacattaaagttttacttcataaaatttttcttgtattatattgttatttgttctactcaattgtattaattttttctttgggtgcccatcttcagggttatcccttgcttgccttctacatctattattttttaactctttaaaaattgtaattcattattttcctattctcatggcccttgctttattttgtgtgatatcaactctccttatgatccctcatatttcatcttcatttctttgtgatgatttgattttccttctatttcttttctgaccattacttatttctgctttatagccttctttcttaaagagaattactttattaagtttttttttttttttggttcacggtaaaatgataggtcagaattttcacatggtctatagcaatatattttctggtgtgttatctcgtaaatttagctgaactcaaccactttttatcttatggcatctgtgcataatgcaattgccagctcctagaccaactatttgaaggagactgtatattttggtgtgttttctgatatttgccaccattgttcccatttgctattcacttatccccacggatttaattttactttattcctgggctgttttgatgattgtatttgctttgggtagctcttatatgtcttggttttaattctttcttttatatatttcttattacattactgaaaagtgagtgtaggtatttacccaaggcacattgtttctgttcaagaagcagagaaaaggtaagttgctatctatttccatatacatactgttgaaacctttattgtatttgctgttatttgcaatgaaattttgaaaaaaaaataaagccttgatattgtcttgacaatgatgaattagaagtctcatgactgctaacacaaataacctgaaggtttaatattgctcttaccttgtttattgaaacctataaatataaacttgtttccctaacatgtatctttaaaatatgtactcatactgaaatacataatatctgttaaacacagaaactttttcttcaaagaagttttaaaagttttactttatattattttttctcctggaaatctatttcattctttacctagccaacatgaaaagcattctgcatttaagagccaatgtaatacagggtgctgtggcactgaattacattaggaataagtattccattcactaggacaaagttggcatcattgtagataaatgtgttttctagatcttctctcaggcattaatggacttaaagggaaactgaaaaataacttggaggcactcatcatgcatatggtaacaaatgatcatcttaagtgattcaagaaattctcagattagacataaccaccaaaattcagccccaaatgcttcagatatttaagaagacaggaaattactgtctgcttctatctaactttagatgaagtgagtgagcaaaatcattaatcattaaccccaaaagccaccaaaaaagctgcttaattattctcttgagttgctgaatgctgaaagtgaaaaacactgcaactataaaggtgagtaactggatcaattatgagttggccctaaacattcttaccaaaattggtattgccacctccaggtgtttgtgaacagacaggacagcattccccagggggcgttacagggtcggcacagtccagcacatcctggcattctatcttgtcacagagaatggctccattgtcacagacacagatctgacaaggggcaggtttccaaatgtccctgtttaagtacatctggccattctgagtgcaggctatttcttcaccatatccttctaaaataagaaaagaaagaagaggttagtaatctgaaattatagaattgagaaaataaaaggtgagccatcttgtggattctaaaaaattctggactaagaagtaaccttccaaggagccaaacacagatgaactgatttcatttcataacaaaataatatgtaattcaccatgaaataatgataatgtatccttgcatgataggggaagaaataaaagtgatacaatggaggtatattttttaaccagataatgcttccttcaagattttattcttgaaggtatgaatgatgaaacatgagaatatcaataaagagggataaaagagaaccatctgaaaatggggagaaaatgaatagctcaaaggagaatataaaatttgaatgtttggtgaaccctattatgacttgcaactcactggaaactttagtaaattccacaacaggagacagtatgttttcatgtaccatagaaaaaaacttcaaaaaagaaaaaggtgtatgtttttattaaaattatttttaaatgtacagtaaaaaagtataaccatgtcccatttcatggagtagaattctatttgatatactaaattgatggtgtttactcaactgtggcagaaatgcaaaacttatgcagataatgagtgaattatgtttgcatcaaaattaattaaggaaaaccatagccaaaataatacagtgagttaatatatatttgtctagtgcttttctacatttacattacaatttaagaaagtttgggaaaatacacacacatatatatgtgtgtgtgtgtgtacacatattgctcaagagcagttctattatacatttactaacaagtaaacacatatattacatcattaactttgtgattttataagaaatactacagaattttaaaacataatgtggatcaaatcatccttgcttaaatacatcaagaacttcccaactacttaaattcaaaacttccttataaaggctaaagaccttctttcccatttcttgcacaacttgaccacttttgcccagcactacctctccttccttcatcccaggcccacatggctatctatcattacttacttcaatgtcatctccccgcgaaattcttttctgactaccctgcaaaaattagacttcctttacccaactgatatttttcagagaccttttcaaagaactcattcactcagccattcattcatttattcattcattcattgtgtattatatgctaggtaattgaagagatactaaaatgtgaacaaataggcaaaaatcactgccctcaggaagtttattagaatgagtattaattttttatttttgtttagtttatctccctcactagagaaaaactagatgaaagtaaggactaggcgtcttgttcatcactgtatttcttttcttttttttttttcttttttaaaatggagttttgttcttgtcgcccaggcaggagtccaatggtgcgatctcagctcattgcaacctccgcttcctgggttcaagcaattctcctgcctcagcctcccaagtagctgggattactggcacctgccaccatgcccagcgaatttttgttttagtggagacggggtttcgccgtgtttgccaggctggtctcctgacctcaagtgatccacccacctcagcctcccaaagtgctgggattacagccgtgaaccactgtgcccggcctcctcattgtatagcttgatgctatacctttcatagaacagccatttaataaatatttgtctactggatggatataatgaatgaatctaaactacggtaaactagtttaattgcacagcatgaactttgtacttcataaaaagatgttttaatgtagttgtaatcagtttatgaaagatattatcatttggcatataaatatattcaaatgataatgcaaagctacatatgaaaattattttagtttacaatacagatattaatacaaaaatctgctttatataattattatttgtcaattataccttaataaagctggaataaaaacatttttctcactgtcctgtggaatattttgctttatgtatttagtctttcatcacagatatttggcaaacggaaaattgctttcagagagtaacactactatatcctaatggtttgtgtgctgttttataagatgaggacacaagtttctaatctgttttatcttcattaaaagacttgtatcacataatacatatctaatcaacaaaacagtattagctctatgtccatagtgctattatagtcatttaaaaccaaggggaaaatagaaattatgttttaatatgcttttctggaagattattttgaaaaaatgagaaatgtattcatcaaataaacagtgtgacttttagatgaaatatcactttaacacagtgtaattccatgaataacatttccaaagacacaacctgtataaaaatgggcttatgtctatagttcactgaacaattccattaagtagataacttaagggtaattttgctcattaagttttatgattgagaaggaaatatccacttacaaatgttaaatgctattacctgaaaatgagatactacttcaattagcttgtttctctcattacacactcttgggtgggggtgctgggagttaagtgcatatgtgcctagtactaattgtgcaaaatattgaaagcatatgtggctgggtgtagtggctcacacctacaatcccagcatgttgggaggccaaggtgggaggattgcttgaggccaagagttcaagaccagcctgggcaatatagtgagatactatctctgcaaaaattttaaagttagccaggcacagtggcttgtgcctgtagctccagctactccgaaggtgaggtaggaggatgattttagctcaggagttctaggctgcagtgagctatgggaacgctatgctactgcactccatcttgagcaacagagtgagacctggactcacaaaaagaaaagacaagaaggaagcatatgtgttcctttctgtcctcaaaatatatattattgtggagtattatatatattatatatgttacacatataacaatatatgtatgttttatatatataacattgtggagtgctatatttgttatataatagatgaatataattaacttattatataattttaattatataatatatgtttgtttattgtataaatcttgaaggagccatagagaacaggataagttatcccctgaagatttataaaatgaattattataacaaaatatgttattattggatatatattatatataaggatatatatgctgatgggataattagatatttggaagcagagaatatgaaaaacaaaaacaagatgacacgtaatgatgtcaattaaatattaaaatatgtgaggaactcttcaaggagtagcttatcttcttccttgtggctcctttagggttggaataaaaagacacattgtctcagtcttgtgttaacacctagaagagcagtttctttctgaaagtttaagacaacataacttcaactcaaggggcaaagaagtgggccactggattactttctttaaatgataatgttaaaggttagttttatactctgagtcatcatggcttcccttctcctgagaatttataattaaatttaagatgatgtggaaagttagttggaatgcttttaaatagcaaggagacgaaaaaccacattcactgttaaaccttgtcttctcttcactcagacaagaatccatacacatcacagagggctcaaaaactcagtgaactctcattgtccatgtctgaatgaaagacatgtacaaagaaacagtgggtagaaaatacagggtgtcttgcagttttcacggatctacatggtagttgtacaccatatgattaagttgtcccttctgttttctacacagacatttacttaaacgaaaagaaaagtaaaatagaaagcaaaattgcagccaatttgttgaaaaatattgcagtaaagttgtcataatagaattattttataaatgacaacacagtataaaataacaaaaattttcaaatgacattctgagaaattcaattctgtcctcctgatttctctatccaaatcataaaattaacccaagctgacgtccaaagcttagattcaaggcccaggacttaaaaaaaaaaaaaaaaaatgtttcttaaaatacctggatattggggccggtcagggagtagggtggggttgcgggagggagagcattagtaaaaattagaaaaaaatagttaatgcatgctgggcttaatacctaggtgatgggctgatgggtgcagcaaaccacaatggcacacgtttacctatgtaacaaacctgcacatcctccacataaaccctggaacttaaaataaaaataaaatttaaatttaaaaattagataaatatttttatataatctaaaaaagaacgccaaaactataattttgcattacttgtattttttgctgtttatgtttaactttcctaaaattgattaggactggtagaaatctgataataccatcactattttgtaattttcatgtttatctcccaacctacaagattcttttaccctcaccaaatgttccaataaattgaatccattgtgaagtcattcccacaacaattgtggcactgatatattacagaaaagagatatattttatctgatcacattttatttgaaatcaactcaatttttctgtttctcatatatcctcatagatttctcttctcataaatcttaagtgcttttaaatttagttgtaagaattcagttcttaatcactagatggcagaccaaatccaccatcttattataacaattagaaactaaattatcacaattgcagcttgccaactatatggtatgccctgcatccacattttttcacacaattacacctgtgggggaaaaaaaaaaagcctgcatagaaacggccatattgaaaccttggactggccaagagagacgactgtatttgcatattaaattattggagtctacttacaggctttgaaaaatatatgaaataaaagtccctaaaattatgttagatattctctagccattaactaaagttctttcaagcagaaataatacacagcacacacgtgttataaaaattttaaatctcttattcagacacaggtttgtgctgatcattttcccctgtgagctgtgagactgtgagctcctcgacagccagaactgtgtttacctcagcaaccttcacatttaatgttatataatccgtctttgataaacgtatgtgtagcattgatgaatgcagatgtgaatgaggaaagtaaggaactagttcattgatatgcctattaaaaagataagcacttttagctctctttcctccttccctaatctttccagagaggatgtgctcttaggaacccttttttgaatgaaagggaatggtcacttggtggttcttaccaggtgtgtccctgacattcaggcctctgtgtgaccagaaaggaagaagactgtgtcagtcacaacagttcatattttagaacaaccttcagaaagctacagcaacccttcagccttcctgacccagcagatttaggtcccttttgggattgtgaagatctgggctaccattacttaaagtttctctgactgtaaaggtccttgagggactataatcatgacactgtcagctggtggcctcatgaagtggagagagaatgccttgtgggacaaaggaggaggtaataaagccgcccacgtgtcagtctggatgccacagatgctgcctttagtaatgcacagcagagcgtgggctcctggatggggttccagagaacctaccaaggaaatccttcccttccttctgctctagggcactgtttatcattagaagggaaagacgaagagggacagcattcaattccttctttagaccatgcagaggagatgccaaaaattccacattcctcattttgctttccttaaacaactcccaaatttgaaaagttagatacatatgaagccaccagggatacctgagggggatctattacatactttgacaatttttttctatctcagcctcaagatctatgggatggtgggaggataagtatgtatggggtaggcctatggggttttacatcttctgttcttcaatccactgcaaagacttttactttctagtgagccccgcaagcttaaatctggttttaggatagttatccaaattattactttttctgtgccctgctccttttttccttgtaccaactgaacaagagtaggcattcaataattatttgagctgagttaaatttttgttccactaaggacaatcatgttttatattctaaagcaatataatgacaattttgaaaattttccttgaaatctgaaaaattgaaaaggagatgactcatagaaagcttcatttcaatgcatttcagtgagcatatgaatttaaaaaatttgataaactgtctgtgaaggtggttggtttcttcagtgcaaccattaaatgttttccaatctcataagcaaagtttttcagttaactagtaaaactgctgtttttactttacttaaaatggaaaaaatagaaaggaaaaactctcatattaggtatacttaagtttttttccatgtatcattgggaaatctaaatgactgtggccaaaacgtgaaactaaaactacacatactgcacatgcaatgctcatctacagttctgtctggaagagcagatttcagtctgctaatgcatttgacatagattttttttcccacatacctcaaactactaaatagctgcaaaacagcacaaagagaattgagccaactctataatctatacactagaaatttcagcagtaatttttatagccaaccttagttctaatcttaaatattaatcctcagtgaataagtttggtacagagctatgccaaatgtgtctgcctacctaaatacatgaaacatttgtaagtgttctgaatgatgtctacttaatctctcctagcctaatattgcttgagatcaacaggagagacaaaaatctgcttaactgtttctctttcaaaggagaagtaaatattcagtaatatatagtatccacattccagatttccttcatctccttctggtcttagctcaaatgttacctactctggtcaccttaccaaaaaaattgcacatgactacacacacatacaaccataacactctcaattcactaattcttactcttttttttttttcttttaatgtagtagttaccactttcaagcctactatatattgaatttattatgtttattgtttgtcaccccatgatagaattatagctctgtgagaacacatataatttattttgcttcctttgttgatatattctgatatcctagaatagtgtcaggatcatagtaaatgctcaagaagtatttgttgaattaatttattgaatattagttgtttgcttaagaagctttatatggtaaagtcatttcataatattcttttgtatataaaaagggatttttatatctaaagtcaattgttaagaataccaagtaagagatctaggccatattgaatacaaaatgatatgcttcaaccctgggctattacctgatttttagagaagcgccattttagctgcttatttaaatgtgggccaaacctacaaagctttaaaataccatgaattataggaatatgatgtattatcatttattcctgacattatatcctaaaaagaacatatatttttactcatttttgtaattgaaaataattattattgtattttaagagaatattcattattgtatactcaatgagtataaaattaaatattttacataaaacattttagaatcaatttaactctgtattttattatgtctttgcagctgcattttgcctcctttttcaattttccctgatacagaagaatatttagggcctctagagaaaatccagacattgtagtcagcttatttcttccaattcattctttattctctgcccttgccttgagcaagttgaaatttcttttacaatccaccaaacattccacagttctcaatggctctttgatcccattcatttcagtaccaaggattctaaaatattttgaagaaaatttctaataggaatttaaagggatgcctctttctgcattattccctctggagctcagttctggaggcatgggtgaaaggagactagtgctgtcatcccaaaggccaatttctaattttatcctcttggaaatatctagtgacttgaattagtattcagttttgttctgctttacacagatttaatttacatctattttctagctattaaaaaagtaagtgattttgctgaagaacaaaactaaaactagattttactcttctttctggcattcctttccaagtcacttccagaacaggtaatagaatctttaaaaaaaaaactgtaattgttatttcagaacctaaattcatctcttaatcttcatatttagtttatcccttataatgtgcataattgcatggaagccaatttatttattgcatgtttaagatcaaaactcaatatgctctgaatctcaaaaccagccaaatgccatagtcatacttggtatgagaaaaagagttgttgcctttattggaaagttatatcaataactttttagatgcacagcaaagctcttcattgggtaatttctctacttgtagggagaacaaaagacaagaaaagcaaacagacaaggaggatgaagagaggaaggagggagaggggtagaggaaggaggatgagacaatcatcttctttccatgtaactttactacatcaagaaggaggttttacaagtttctttagaaaacaacagaattaacctgaagatacttctttatcctattagggaaaatacaaagaatgaatcggagatttttcacctacaaatccatgtgcttctaaggagaagttgctattttccttaacaagtaaacatgggcaaactttattagaatttcaaaagttttagattattacttaatgttattcattcagttttttaaattctgaattttatcattattgtataattcacattttaatttatttaaacatggtgactacgaataaaatatctataaaggaaaacaatactcttgtcattttctttaaatacctgtggaaagatttaaagtttctaaaatctttcaaaaatttgcttaattccaagtaactacagaatacttatttcttgctaatacagtcattagcacatgctgagatcagaggagaaaaatatataacatttcctaaactaaggagtataaaatttagtttggacaaaagattaactaagttgtttactagtcaactggttattactaaattaataaatgaaaagtgtgcctcagtttttctacttgttaacatatagaaaaagataaaacatgagcctttacttttgcagataagaaatatttaaagatgtcataaagaagtttgctttaaagtgtgtttgaaagctcatcctaaatttgtcaatctggaaaaaggaatagaggcattagttaatccatttaatcgatagttatttatctagcaaatataataacaattttattaaatacttgtttagtacaaaagaaaactttggatcagagaatgagacatttggagttcaacttccttgccaaaaacaaccaaaatatacagaagctgcaaaagataatgaattttttgtagaatgattttgctcatatgtgtatttcactagtgcattctggaaaaattacatacacactgaaacttcataaactcattctattttttcatttctctaacctatatgtatcctggggccttttgaattattggtccttatcttggaaatcttcctctgtgttttgagaggttttgtctaatgctgtttattttcattaactacaactaagtctggggaacatcaacctgaggatttcctagaatccaaaacaaaaacaatcttcaatcattatggaaatataaaattctgtttataaaagcaaacttcaaattagtaagggtgaacagaatacagaataacattacattcacttatgagtatatcatctattgattctcctttggtgtcctatttgataatgaaacatattttaaacccttagacaccaagacagtctggatacatagcagagagaaagtggaaacccataaatgcaaatcattcaatgatccctcagaatataccagccataataatggctaaggccacagtttagagatcctctgtgtgagtttcagtcctccctgtatgttttagtcttccaacacctttggcattaagaatgtgtttaaatcataaaataaatacacttattcttgaagcaaacatcaaaataacataatgtatgcattttgataatattgtttatttattcaacaaatatttatctgttattttgccaagcactgggaatacagttaaagtaatgaattcctctctacctttacggagtttacagactactgagagaaccagtgcagtaacagattattagaacataattctttaaatacaaaattataggcaaatcttggttgttgtgggaacatgtaggaagggcatatcatctaggctggaggtcagagaagtcaaaagaaatctgggatttgagttctttaacttccttatttcctttctttaatttattgttttgggggttgcttttttttcaagtgagaaaattaaaatccaaagcagttttttccaaaaattcatttccaaggtgtataatattgttactcctggctccttcctggtaattggcaacagattccttctctctaccaactggccaggatggatctgaaggagaccaggtactccctctcaaccatgactctgattttaatttctttaccatctcttcctttgactgagggtaaaacaacagcactcttgtttctaaaccaactggtatgtccatgggaaggtgccttggaggaggggtggggctcttgcggtggtgcgggccagcagtccagaagccaagacagtggtgcacagcaacatggcaggaaccatttgttgccgatgactaactcactctagccacactgggacaaactataaaagcatttttcaggagaatggcatgaacctgggaggcagagcttgcagtgagccgaaattgcaccactgcactccagcctgggtgacagagtgagactccgtctcaaaaaaaaaaaaaaaaaaaaaaagcatttttctaggtccaattccacagtctttcttcaattgtagatacagaattctggattattgtgttttgacattttaggaagtcaaaaaaatagtataatgtctagtttgaaagaagctgacttttgtaatttagaaaacactgtgaagtaagatattaaatacccatactaaaagtttattttacttatacttagcacatccacttatactcattttcatagattacttaagtatttattgagtctacttactgtatgcctgactatataccatggaagaaagatacaaaagttaaagatacacaagctactccagaggagcttagaggaaagtttataaagtcactcttttaacaaatatttactaagaacattcaaaatgtaaagtatcttctatccagttgtttcttcaatgaccacaattagttgaggtagcaaatagtttatataagatacgaggtttgagaattacaaataagaaatctgaaaagatggtatcactataagctgaaattatctgagaaagggtgagtagaagtgggttcttaagcaggccttgaaaaaatagaaggtatttgaggtggtgggggtaaggaaaactctgcctgggaaagaggcagggaaccacctaaaacaggaatagagagggaggaaaacatgtcatatacatagcttcaggaggggatggtttaatttatcaaaaaaaggaggtgatgagaatacttggtacatgtgatacctcttccactaggaaagttttaacgacatgcccacatggaatttggtcattctcttctcttgctctcatctcaccttatccgtacacctggcaaatacctgcaacattctattacacttattggtttgtttgcatgtaaactctactgggctgtacatttcttgagaatgaaaaatatttaatttctctctatatcatgagtgtattaaagtgcctgatacatgaaatgcttgctgaataaatgaaaaaaggtaataaataaaagaatgtataagaagctttcaggaatattaacgtaactacctaattaaagataaatcagaaataaatgagaccaaaggccactagtggaaaatgttatactggagttaggagaaacagtagttatgagaacagaggtaaagccacgagacactaggtagaaaatacgaagggtttgatgaagtttgggtgggataaagtatttaattttttttttttgagatggagttttgctcttgttgcccaggctggagtgcaatggcacaatcttggctcaccgcaaccttcgcctcctgggttcaagtgattctcccacctcaacctcccgagtagctgggattacaggcatgtgccatcacgccaagctaattttgtatttttagtagagacaaggtttcaccacgttggtcaggctggtctcaaactgctgacctcaagtgatccacccacctcggcctcccaaagtgctgggattacaggcatgagccactgcgccaggcctaaaaatttttaaagataatttcagagtctcagaaatgaatggaggaagaaatatctactgggtactttgggttaaattgtgccctgctaaaagatatactgaattcctaatcctctgtacttcagaatgtgacattatttgtaaataaggtcattgaagatgacctaattagttaagatgaggtcatactggaatatgatgggcccttaatccaatatgactggtgtccttataaggagggaagaggggaatagatacagagactcagacactcatttctgttgtcataagccacccagtttgtggtactttgttatcaagcacccctaggaaagtaacacaggtgtatggtctagacatcgaatgaaataaaagttttggagagataaacaaattttattttaaaaatcctaaactctatttaaggcatgttggagtgaatcttaaggaagaataacccagtagaaatattaatggcagctattaattgtgttctaaaagttatgttaagtgagtgataaaaattttccacatagtcctaacaaccatcctggtagaggcttggggtcaatcatgatcacaaagctagtgagtggcagagccaatatttaaaaaaaatatacgcccataactattatacattgtgttagacaaccagattgctatgttagagaaaagataaggggatggcacatttacatgtacaaaagtcttaagtcacactctaaatgtggattttgactaagagagtggaaaagtgacaaatagagctcctgtgaagaatgaagagcaatagaagcctgggttaaagaaaaaacaggtaaagcatggtttaccttagagatgagaaaaggaagcgattaagaagggtgttttaaaagaaaatgtgtgagaacaagaagcaattaaaatatactaagattgcgaaccccattctttctattcatttcccaactctaaatggaggaaatttcatttcctggtgttccgcctgtgtagccaccaaatgttaccatgctaatatccggtgaaattccccctagcttttctgaggcctcacaggatattgatgggggaaagactatctccatgacatgaataagtctttcaggtattttaatgagtagggatagtaaatgattgcataccaactattatttagttctgtttagattagtttatagggcgcaggaaatgaaatttttccccagaatattcagcttgcattatataaacatgactccgttcagcaaacagaatgcaccatgcttgctatttcacttaaactaaacaggggatgataaaaaagtcactgaggaaaaattcaataaaattcaacattataaaatgcaatttaaagaaaactatcaacttctgctttttaaattacattacattcatgttttcattttctttcatttttctgaagtctgaactagtattttaaaaagttcttaactgtgttttcttttttttttttttaatttaatctttgctatagatttgaaaatggaatcttcctaccaggaccaacttataacttcaatttttttcctgtttagtaacggtcaggttagtcacaatagattcaactggcaataaggattagaaataaaagcaaataatgaaataaatgtaattgctcactttgttttatagcaataaaagcatatgatctaataaaaaattctaagtatgatccatttgcatactgatttaatggcagataactgagtgaatctggatattcttatagtgttaatggaatagcaatgactaaaaattatttaatggaattttacgggctaaatatcaagtataaagaactatgggatttattatgaactcaaccaaacttttcatgactggaccatattatcaaatgagatgacaagatgtgctagatacaaaaagaaactcaaggtatgtatccaccaatagaaacttctctgatgttgtagaggttcaaccataagggaataaggccattcacagtatctgaattggtaaataaaacagttaagtagatttagaggcattattttatgtccagctgcatttaccaatgacttccctgggaattaggaattctaaggcatagacaaaattattctgcatatccacaccaaattgcacatacagcagtattcacatacagttgaatcttgagcaacacaggtttgaactgcatgggtccacttataaggggatttcctcccacctctgccacccctagacaaaccccttctctttctcctccttttcagcctactcaaaatgaagataataagaatgactacatttatgatgatccacatccacttaataaatcataaatatattttcccttccatatgattttcttaagaacatcttcctttttctagcttcatttattgtaagaatacagtatataacacaaacaacatataaaatacatgttaatcatctgtttatgttacaggtaaggtttccagtcaacagtaggctattagtagttaattttgggggaagttgaaagttgtatgtggattttcaactgcacaggttattggcgcccataacccccatattgtttgagagacaactgtattcaacatgattcttcctcatctcataaaattaagagaaagttgcttatttcttatgggatccaggctttggattcctttaactatagacggataggtgaagagtttagtcaaaacttacaggaatatgaaatctgcaacaataaccctctcccagccatgactttatactactttataccagcctacatatgataaattacaaactccactatatgtgttctaaagttttcagaaatttaaaaattgatttttacacaggaactatgttatacttaaatttattagagattaatttcacttaacaatcattcagcttgttcatcttaagatttaaatattagaaatgttagtaaagaaaaaaaccaatatgataaagtagcaaaatgcatattacctaaaagtcagtatatgtggattctttccaatggtaatattttgtgtaatgagaagagtttatggaaaatttctttaagttgtgattaaacccaaagtaatatttttattttaaaatgttaatatctagtgtttattaccaaaagaaattatttctttttcttaaagttattaaaaataagtttttttatttcttttcatagtgctaaacaagaatgaatttcaagaaaagtgacaaggcacttagagcacatcaagtggaacattctgcagaatttcttaagaggaaagaggaaatcagctctttggcttctaaaactcaggaagaataaattaggctttttagtaaagcatgtaagtcaaatttaatttcccctacagaggtagcattataataataaaatgcattccaaaccaagggactaataacagcataacaaaaatggccacatttagtaaatgaaatatatgcagtccagtgtgccatgtaggggatttgaagtagtcttggcagggtgaggaaacagacttgggtctccaaagaaatatccacagaaatactgcactgcatggaatgctaaggccatgagcagagacaatagttttccacccaacaaatactgagtacctattatgtgccatttcttctttaggtgccaaaactgaacaaaacaaaagaaatccctctaactccaagtagctatatcctaattaggaagacaatcagataaccaaggaactaaagtgcaaaacgataagcaacttacagaaataaattcagagtgcttagggagtgtgtacaagcattgcttagccattgtagggggattgggataccttttcttgtggaagtgatgtatgaactgagaattgagaaagaagtagaatttatccagaaacgatttgtaattcaatacagttaaaaggcagggaaagagaagagacaaaaaaaaggaaagcaaaattgagtggttaaaaagggacagggttggaaaaaatggcagcatcaggtgtctggaccacagatttctgatggccttcagtcttctttctttggcttcatcttcagagtgagtaggattttgccaacccaaatcaaaagaatgagaagaaatggaggaagagaaagcaaatttgcagctctaactaatagcctttcagatgtattttggctcttaatctactcactggaaacccttaagaggcaaaacgatgcaggaggaatggaaattgagtagttcagaaaacctaggcttttttatttattttactttttcacaccaacactgaaaactacttgctatgtaacacttgacaaattacaatttctttgattgtcatgtattttcacctaaaaaatagggataatatacccccttcccaaggttgttctgagaatcaaatagatgtgagagtgctttgaaaaataagtatgtgttatttagacacaaaccattattatttagcacagaggttcccagatttctcttgcctgattcaaatccatttacatgtgtatcaaatgtagagtcatgctcacctgtctcctccttatagggcctatcagaatctggagtaggatgcagcaggagagaaaaatctacattatattgacaaaaatccatttatataaggctatgatcacagtgaaggagtgctgcttcttccacaaaacgccctgaggtcaagtctgtctatataaataaggtcataaaacagaagtgcactcagatttcaagaacagaaatggtaagtgtaggaaagagggcaagataaatttttctgagtaagcatataatactgcacaaatccactgcagcaattagttgagcctattaatgccacagtacctgatgtagctgcccacagcaatacacctgtatttaatggaatcacagctggaaggcttttgaagctaattataaggcaccttgacaagaggcattttaagccattgaagtatgttttgtgacttctgccaatataacccatacataccttgctagttatgtttgtaaaaagtaggtggtattttgcttgcagaattgggaggcaaatcccagtaattatctttccaagccatccaaagcttcaggttatttttgtaaccatatatttatgatctttcagctcttctgtaattcaaatattttatccaaaatcagtttcataaaaattatatgtagtttgtgattttaaatgctgtgtatccctcatattgaagagtttgttgttttttgtttttttctttttaatttcagccttgattttcttttaagttggtgctcctcaaacctggctttgcatcagaatcgctcagagaattttttaaaatactgattcctaggccctacttctagtgactctgattttgttttgaaactggaaacttgtattttttagaagcatctctagtattttgatgccagattcagaaataattactatcgtcctcacaataagcattccaatgatgtgcaacaagaaaactgttgttctttagaatgatcattcccaattaggcacctttccttccttacgtccagctgttagagaagactatatcttctgcttcttccttataataacagagaaaagctaaatggggcacttgcgtccttaggaaagtttatcaccgaaaactatcataaacctgaaatctctctcaataatcatctgttgtaaggcaaaaaccctcttgaattaaaattgctttaatcaattaggactctggtatttcggtaacaaatctccatggaaaaaagtctctgatttagattagtaaagtgagattctggtgtgaatataagaagtctcaaagttctcccagattccatttgtgcctttatggtcccctggtgagttttatcactgggtagaattcacaaaccaaaaataaaaaaaaaaagaaaaacatttcacacggggaacttaacaagaaaaaacaactaccttatagaaaacagatggctagcgatactaaagccgaaaggctgtcagctgtgtcttcagcctgtttttctatgcttttataaattggcaggaaaaactccttacatttcactaaaaggggcccagcccataaatgatttgctaaagaaatctgaaaatccatgtttttcaatatgaaatatgtaaaatgtttgaaaactgatttttcaatgaggatttttcaagcttctattttgagagatgattctgggacattccttgaattattcagaaatgaagagaaaatggtgtaaataaaataataattttatgtcaaatttccttttttctcatcttttaaaatctctcttttacgtgcaaaagctactaggtactaggtgacatttacttttgtaaatcacctatttgatttcaaaagggacaagttatagtgtatgatttaggaaatcattttcaaattaggaattgaagagcaacttatctgtatcatacatccatttaaacttcatccatgttaagatttaggggaagaggttggattataattcagccatttaccaaatacacatattatgcagctacattaaagactgtgtggtgggaggtttaccgtaatataaagtttatgccctcatgtggcttacacttgtttgaaattgtgctctcttaatggttctgcctgcagcagttataaattatatgagcatatgtgaccttgaagcaaaggaagatgaaataaattaatagttagctaaaaatgtctgtattgtgatattctagaaatctttttggccatagaactaaaatctttttccctccttatattccttcagtttgattcaacaaaaatgcgttttctgtcttctccatgccagacactgccctggattgtggtgatagggcaacggacaaacacattcctgaatacttttatttctgaaagaaacagtcttgtctaatttcacatgagaattttccttcctttagtaatttgtgggaagatggaagtattttgtggttagaacctatgagtatgcttttagactatttactccaaatccttttagtcactgagatattttaagaggtgagtctatgaaatagacttctagaagtaagtgtcaggatttgagttttgatatacagcctctttacaaatttatttactgatttatttaacaatgatttttgagcacctaatatgtgctcaatttaaaagggcatttacttgtaaagacactcatcatatttattcctaatttttgctttaatagctaggctactctccactgaagcagggtatctatgtgttgttcatagctgtaccccttacacctagcaagggatctaggacatagtgggtcttcactgtagccacatgaactaaaagggaaatgaggaaataaaatcagagtattgccaccatatttaaatagccaccttggctctgaaaagatttcaaacagatctagctagcatctagtatctcttctacacagataagtttccattccattttacaaatgaaatattagagtataaaccagtctacaaacctaccttttacacaagtgcctgtgaaaaatttagtttataaagcccaagtcacatcacaaatgcttaatatatttatttttatttattcaacacattattgactaccttctatatcttaggcaccatatcaatgttagaaatataagtgttaacagacagaaaagatttagtccttaaagagcttatactctagtggaaagaaacaggaaataagcaaatattatacttactaaccatacaatatgtctagtagcaagaagtgttaccaaaaattcagcaaggtaaagacaaagagctccaggagaaaagtgaattgagaggagagcggggactgagcttaattttgaataatcagggacaagctcacaaataaagtagaatttgagcagagacctgagggaaataacatagtattttcaaatgacgattcttattggaataaatgtcatctttaagtcctgtcatcataaaaagtggtatcaagttctttcttgggttaccggaaataactttgacagctaagtgaattgtaaagttcataaaatggaacaataagtttctttgcctaggtaatttcccagcaaataaaatgcaaagcatcaaaaaggtttttttcttcttaaactgctcaagccattgtaaaaatttcacgaaaatatgaaattcgctgagaaaatttaacatttgtttaatttcttgggtgaaaaaaatgtcttaatgaattagatagtcttaagagaccacagacaatcaggatatgttattggacaaaaaatttagggtccaaggtttactttgagatgccattggacattgaaaatctctttgagcaaaaacagcaactaggcctggagctcaataacagctctgtctggacccgaaggagggaaaatatgtgataattttttgtgtaattaggcttcaggaaaacacattgatggtaccctaatgaaatatgcattaaaaaactgaattgttgaaaagaacaaatatatcaagtatgattcaattagttttagagttcctctaagagaatttcttcatccatatacataatttttagctaaatttacctctcatacttgttaaaacaaattagaggagaaaaagaaattatacgtgtaaattagtaattatgtatttctcataagaatacctaaatatttcaaacaaggcaattctatgtaatataattgataaaatgtgaatactgaactttgggttaattcagaggctgacagattttgattataaggtatctattaattcatccactgaggttcatattttgattgtcttgtattaaaatgtctgttctttgaaaaaataagtcattgagttgtatggacatgtaattaaacatagtcatggcaaagttctctgacctcaagtggccagaatagccacgttttgcatctatttttatgatacgtaatcatggtctggtttttagagacataagtagaagtttcctaccacatcaacattcctaaataacagtatcattttggtacagacaacttcagaaaatcagagaagaaaaaagggaacttgtttttggaaaggttacaaacctgattttacgtttttcttttaatttctgttaaaacagaggaaatgaactttgtgtatttaagggagctgcatagacttattagtcctggctgcagatattaagtaaaaactatcttaactttataataatttgaatgtacttttatttaagtcaagtatctttaatatctttggaaaagaagaatagtattgaaaaacaatgagtgaaattcaaataaccaaatcacaatgtataagaaaaaaagatgcattcaatgtagtttttaacaattcatctcatttattgtcaaaattaataaaacaggctgggttcagtagcttacgcctgtaatcccagcactttggaaagccgaggtgggtggatcactcaaggtcaggagtttgagaccagcctggccaacatggtgaaaccccgtctctactaaaaatacaaaaattatctgggtgtggtagtgcacacctgttgtcccagctactcgggaggctgaggcaggagaatcgcttgaatccaggaggcagagattgcagcgagctgagatcgcaccactgcactccagcctggataacagagcaagactccatctcaaaaaaaaaattaataaaacaatattaattgagtgttccctggctgagtgttctggaaataacagttggggagatataagcaatttctcagagataaagaagttgaatatagaatgctcttgggcagcagtgtagagattagtttgaattcattaacaggcaaaccaatctctacactactgcccaagtacgactttttttttttttttttttttttttgagaccgagtcttgctctgtcggcaggctggaatgcagtggcgcaatctcggctcgctgcaacctccacctcccgggttcaagtgattctcctgcctcagcctctcgagtagctgggactacaccacctgccaccacgcctggctaattttttgtatttttagtagagacggggtttcaccatgttggccaggatgatctcgatctcttgactgcgtaatccacccaccgcggccccccaacaagtgctgggattacaagcgtgagccaccacacccagcctattcaacttctttatgaaagaaagaacttcttgtggaatacatgccagagggtgttggctgcctttaatcagacatcttgaacatcaactaacagcattgcatttacttggttgatagtgatagggatggcatgaagtcttttcctttgttgagctgcgaaatggaaaaaggaagactgaatcttctgagacaacggaatgaactaagagcgtcaggcagcagggaaagattccatgcagcaagccagttaggtgttcattactctgggcctaatgtaaattgagaagggtccatccttacgacagaggggaagctagaaaaagaagctagagagaccacttcaccaaccaagtgttaatgacagaatcagaggagttcagaagttatgtttcacacaagaaaaagatttttaaagcaccatatcctgctctgaatgactattttagttttccttcaggtgtttatttctgagtgaaggattgggaagacatacatgaaatcgctgccacaccctctgcttgaaaatgaccatgcagtccagggaggacacagccatacagaattgcttgaccctttatgaaagctcttctttcaccaacaaaaaagaaaaaaatactaaaaatgatatgctgattgatttctttggaatcaatacaggttgttagatctgtcatcctcttcatcccactctgagagttattggtatacttgccctccattctgtattaaagccagtcatgcagaaccttatgcattctcaccagccagctggcctttacagagttagttataatctaagcctgaaaattcctctaaggtagttggcaatataaatataaccttttggcaatttgctagactctatttttaaagtacatcattatcagctggatgtggtggctcacacctgtaatcccagcactttgggaggccaaggcaggtggatcacctgaggtcaggagttccagaccagcctagccaaatggcgaaaccccgtctccactaaaaatacaaaaattagccaggtgtggtggcacgtgcctgtaatcccagctactcgggaggctgaggtaggagaatcgcttgaactcggatggcggaggttgcagtgagtcaagattgcgccactgcactccagcctgggaaatagagtgagactccatctcagaaataaattttagaaagtacatcattgtcaacagttttgcataaagcaaattcaaaattgatgaactcatagaataaaaaaatcctacatgaaaatgccttcctggaatttgagggtcagcaaacaacaaaccaagggcaaatttcaggaaaatgaaacaagttatgtcataaatgccattcaaaagagttgcacatacatctcttaagcttggctaaaatcaggaaaatagggtggacaatcagtttttattatttagaaaatgaaatttcttctaatcccaattaatttttcattagtaacaacattagcttctgcatgccttattaaccacatgaaattagtacagactgagaagttatacaaggcattaattttaaagttttgaaaagttatcttgcctttaaggatagtattcatatctccagctcataacgttgggttggctggactacatataacatatgtaataaatcttcaattcaagtcacaacttttcttcttgttatctttctattcctattttccatttcagcttacatcatggctgtagtcaaataataaaaaatgactggcttaatttaaaaccatatacattctaattcaaaacaaccaaattataaaaacagaacctaccacagatgctcatggattactggactattacctcaaccctattagcaacttttttcttcctaacctggatatttaagtaatacataatttataatggagatattttatgagaaaatattgccacacagtcagttgtgagttattaagagtaacacatgggctttgaacgctctatgaatctgcagagtacatatctggtaaaagaaatactgcctaagcttgaaaatgaagtactgcaatgatttctgacaaatcctacttctctgtgtcataaatattggttacaaacagtgaactgaagaacaaaagataatactccacatggcagtttatcattcataatccgtaggctaatgtctttcaattgttttggcttcaagtagttgcaaacactatgcttatatctacacatttaggaaatctccagattaatgaaaaagaacacatattttataagagatattaaaagatcattcagtttaaaaggattttgtttaaattggtagtagctataatagtggtaataggagaggcagcaatagaagcttacattcattgaatacttaatatgtgctatatattgtcctaactgttttatattcttgatctcacttaatcctcaataaacagtatcattcccatgaggcaaccaacagtagctcacagcaactcccatccctcataagtgataggccctggatttgaaacaagagagtgttattgcaggtgtaaacctttcatcagtaaggaggatcagcagagaaagaggtccaccagtcacatttattccctggatgggctatgttcagggaggtgttagaataaaatgattgcgagtgggatgggacttactgagctaggcctgactaaagctctgttttctcagcactgaaagtgcagaaacttaatagttaagtcaccttgtatttatcagattaatttttaatgctaatctatgctacacatgttcataggaaattaatttgtgtataaaaagacaacatattattctgcaaaccagaaagtttccagtgagctaatcagcatcttctaatgaaaaccttactgctatgtacacaaaaatacctgagtacaaatttacatgtatataaatacatatttatatatatgcttatatatgtatatacttatatatatgtaaaagcttcatatgtgtgtattgaggatatagatattttcttttacacaggtgtggttacacaggttaactaggaggtagttatatatacactcacatttggcatctgtatattttttcttttttataaatatatatgtatataaaaatatcatacatgtataacaatggagaaatcttgtgtttgtatgtttacacagacagacataaacactatgaaattttatgatgctaacaataatacaatgatatggagagtggggaaaagagatagtcaaatttccaaacctgatctttctatactttttaatgttatattttataatagttattatattttatcttacatttatttttaatacttggaattagacctaaattcaaccttattcaagtaatcacactgcttttttccattttcttgccacaagtacattgtcttgccaaatatatttagtttggttcagttagtaaaacatggcaagctataaacttgcttcactttcagctacttacaatctgaactttattttcattttaactgctgatggcccaaactttttattgtctgataatattcatcattttgaaaaatagaagccaaatgtcaaataaaatgctgaatctaaattccatctctttagtgtagtagaaatctatattataggttctataattacaattattaatctacagttaacaaatgttttcttcgttcgtgtttattctgaataaaactaactggaccaatctcttcaagcaaaaacacaaacataatacattaaatatagcaatagaatgtgatttatggatcttgagtgaattatcattggtcttttataggaaatgacaagaggtataaaattatcacagaaaatgaagtcctactcttacatgagagatgtcttctgaagttttgaaatctaataataacatatatatcaaggccacgcctaaatccaaattctgtattggctcatgttacttgatgaagtcattttgtacaagtagcaagaaggaagacttatgttctgatcactattgaagaacacaggattagagaaatccaaatttggtgagctgggttgattttgtactgaaattttaagtaatattcttttgatgtagtcacacattgtgtattaaacaaaaaatgatacttttcacttagaggaaaatgctttttcttatcttattaatttgttagccatggatccaggaaatattttcctttctcctctacaatagaaaaaacagcagcacatggactagaacctgagctagcttctaactgtgcagaagacagtgagttgggggcgggggatgggtagatgggctgttgaactggggcttgtgcaatactcatgaaggcttgaaccaccattcagcacaaggtgatgggtgcataaatgatgtgtgcctaggatttctcagacctggcaaattttaaagagaagatagaaatcaatatttgtgtttgacatctctcaattgtttgatgttaatgatgtaattctaatagtttttcaaagcactgtttgagcccaggaaaatatctgtgtgggcctaatccagttgaggactccaggtttaggatatacatatataaaatggagtcttgctcagtcacccaggctggagtgcagtggcatgatgtcggctcactgcaacctctgcctcccaggttcaagcaattctcctgcctcagcctcctgagtagctgggattacaggtgcatgccacaatgcccagctaatttttgtattttttagtagagacagggttgcaccatgttggccaggctgatctcgaactcctgaccttgtgatccaccctcctcggcctcccaaagtgctgggattacaggtgtgagccaatgcacccggcccggtatatttttaaggtattatttccagcctctgtctagctctacccttatcttacttattaatatgtcttgatttgcttctgtttatatatcacatataggaaaaatctgagaagaaatgctcagatttcttctcaggcgattctactgtctctgcttccaaatattaactcatacatgcttaattgaaatatatatagatatttgtatatacaactattagtacacacatatatatttccttgctctgtcagctgacagaacacagaagcaacaactcccaagtagcaatgaacacacctaggtcccagattgtggtttctgatagcattctccaatataaggaacaagagctctttgaataaacagctgattctaggactgggccaataaatatacaaaacgaacctagaacatcttatagtaaccgaaagtaaaaaagtacatacacacaaaaaagcccacatgatggggatatatcaaagggacacagaatacaactgaaagactttccagtggccaaaactgaaacagtttgacaaataaaataagcaaagtagcattcaaatatcaccaaaaatgtaaaataaatatctatgagtccataccgatgtaaatacatacaaaatataaaatagaataggacaaatctcctatgcagaattgcaaatgatttatgtagctaccccaccctttaaaagttgaagagtaagtctccactccttaagtaagaactgtatgtacatagtggcttccttccaaagggtacagaatggaaaagggaggaaacagcaaatttacagtgaagacacaggacaaataccaccccagacaggtgatcaaatttaacaccaggcttggcgcggtggctcacgtctgtaatcccagcactttgggaggccgaggcaggagaatcacttgaacccaggaggcagagtttgcagggagctgagatcacgccattgcactccagcctgggcaacaagagtgaaactccctctcaaaaataaataaattaattaattattaaagtttaatatcagtaataataattcatgttgatagttgagaatggcactttacctcctcccaacacccagaactccagtctaatcatgaaaacaaaaatcatacacatcctaattgagggacatggtacaaaatatcaggccagtactcctgaaaaatcgtcaaaatcctaaaaaacaaggaatgtctggaaactgtcatagccaaaaggagcctaaggagacatgcaactaaatgtaatatgggatcctgtgagggatcctggaacagaaagaggtcattagacaaaaactaagaaaatctaactaaagtatgactctagttaatagtaaaatatcaatattggcttattcgttgtgaatgtaagatgttaagaagagggaaaattgggtctagattatttgagaaccctttgtactatcggtacaattattttgtaaatttaaaacttctaaaattagaaagtatattttaaaagtgaccagatgttggctgggtgcagtggctcacgcctgtaaccccaacactttgggaagccaaggcaggcagatcacgaggtcaggaattcgagactagcctggccaatatggtggcaccccgtctctactaaaaatacaaaaattagctgggcatggtggcgcgcacctgtagtcccagctgctcaggaggctgaggcagaagaatcacttgaatccaggagacagaggttgcagtgagccaagatggcgccgctgcactccagtctgggcgacacagagagactctatctcaaaaaaataaaaaaataaaaaagtgaccagatgttaaatcatgtccaaaatacaattggttagcatttctataattctccagttataaacatcaagaataaaaataagaatcaaagtgtaaaatatgtatttataccaaaataatcacactttaacatatgtacatacatgatacgataccatatagggcagaaaataaaactaatattttccagcaattgtaaacagaaaaaacatgcccagggcctcaatgaagaacacagccctctgattctacattgcctttttccctttatcttgtcttaagcagattagaggactcttctgaatattaatacattttaaacctggaggcacatttggcattatattataaaacaaagatatgtttatagaccagaaatttaaacaaagagacaccactgtgcttcaacaaagcttataataaaaatacagaaaaatctatgtatgtatatgcacatatatatatagaaaggaagaaagagaatagggaagttgatctttattcaaaatgtacaaagctatagttacagctttacatttccttactatttcccttttaggttattatctgtatcccctccccttctttttattaaatcttatttctcattgtagaggcttaatgtatactaagaaaaatagtttctagtatcagaagacatagctctagtaattaccatagagagaacttgagtaagtaatatatttttctaaggctcagttcttccaaattaaaaattagttttaataattcttattgcaagtgaaatggataaattacatgaaaaaagcattttaaactattaagcaccacacagatattacttgttaattaacctagattcaaatattttattctaaaatatactaaaattttcaccttgcccacttaagatttaaaaatacttcaatgataaaatcagcattcttttattaaaaggaactataaaatagccagatgtattccttttaatagagatgtgctttcagtgaggtattctgggaaatgaagcaggactttgacaggcagagatggggctgggcaatatgagctgaggattccccatggtctggtaaggaagccgacttggaagttagctggaaatatagtgtgcagtagaccagttaaaaacattggtgaattaatatgcgtaaggttaccattaataataataataaataccatctagtgtttactttatacaaggcagttttcagatgttatctgataaatgctcacgactattcaaggtagaaattatttgcctattttgccttattacatataaagggattggggttcacaggggcgaaatgatttcacaggcagtgaaaagtcagttttcagagccttatctttgcagatgcattctttctattactgtaaccaaagactatgctgagtatatattaatatatacaattatctgactgggataatttatttatggctccggttaaagatttcctcttaccaaaaaatgtaaaataagttcatatagtcacatgggtcacgtagttaatgcaagttttaaagttagcacgctcatttcccaacttcccccgaattcttgaaatttactaatgctatttcaaaatagcgaaatgcactgttaaatttcttctagattcttaaggtgtattctgacctaaaaaattaagcaaaccgtccttttaataggatcaaggagtttatagagtttaatagtgaagccatctctttttcacttgaagaaatccaattctgcatattttgcttgcatgatttgataacgaaatgtatgtcaaggatgaaagactaaaggttgagcttcatcaaactaaggaaaaatatttaagatgttttatggatagtaattttataaataatgtcaaattcttttctggaatttcctatgcctatggtgagagataatataaatctgatataatcaagaactagatttttccctattatatgtaaatgttaacattgtatagacttgataagttatcattggaatggatacagattattccaaaatatttaaagtttaatctatatgttttcatgttatgattgacaataattttaaacaaaatgtttttaataataaaatacattttagtgcaaaacaagattactcttcgaactaggtatatttaaacatctatacttcccttgaaaatccttgtttttttatttctaaaataaatgcttaacatttatgatatatgtataccatagattatattttccatactgcagccaactagctcaccataattataaattttttatatctgtgcatatcatttaccaatatttatgtgttttgttagactaaaatctaacattatttatacaaatgtactatacatagacttaataattgaatgcacttattaagcactcaataaatggtagcctcaaagtaatgattatcattatattaatgaatgtccactaaagaatataatttaaatgcttattatcttatgcccactcttatataaggtcaaccaaaaaattctctccatattttaccttaattaattcctgttcattctgctttcaataggacagacatccttcagatttctttatactatgattaccctgcaatctatcttaaacatagctatcgaaacttcttcttaaatggcccttcaattgtgtcacctttctcaaacctcagcaattgccctcagtcgcactctggcccaataacaactttgtcctcaccttcagaattgtgtcattttttttttcactctggttattgttcacaccttacaaatctcatcaactgctttttgacctacttgactattctctgggctattcattctcttaaatattatttttatataccaatgaaaaatctacattcttaagtaaatattttccacatcagccatgattgttcgatctctctcctaatgtgtaacaaataaatttctaggtgcttagcctctagcttcatgccacacagagtatgcagtgtcagctacttcataagccaccaagccgccttgacttgcctgcattatctatatcactgtttggagggctgttgtatattgtttgcagtttgtacacttcacaaagactccaactgagggggccagtgggaaatgacattcaatccaagctctccttgtcatactatgaaccctagcttggggctgtatctactggaagaaggaatgccttttattttgctcctgtccacttgcctagggtcacctggaggtggcactgttttctatttcagacagaagtcacccagaggtggcactgttttccatttctgtttctaatgttatttcagacaaaaggtgtataaaggcctactctaaccctgtaactgaggtcaatatttcccactgtaaaattttctgcctaacttaatcccatcctaataaagtctctctcatatcctctattagaatgaggcttctttgatggcattaatgaagtattaattcgacaactaggttctaaatatccattgtgtccattatactatgattacaaaacatatgaacaatctgttattaaacaactcatactctgattagggagctaagcccatgcatgaaacttttaaacaaatatataccttgctttggtgtgaagtcttccaaacaatgaaagagagacgtgtggaggttagaataactagaaaagacttcacaggggaaacaggtcttaaactggactttgaaaaaggagtaagatattactagactgtaggaagaaatgaagacattataataacataaaaaaatcctacaagtggtatatcatacgtattatgtgttcagtctttaaaaaatatatagctgcagaactggaattcttaaagaactagacatggtaatgaagattaatatattgagatcgccagggtagaattttaagttcaatctgtttcccagatctttagaggaggaaaaaaaagaaacaacgtagtgtttgtatttatcatctgcaaaccagatggttatggcaaggggtgtggacattcaaacacattcttccctgcaagaaaccatgttgctgtgatgcaagactcttgggcctctgaaaacagtgaacataaaagtacttaagaattttctgaacaattcaaaaactcaaaagacagacagatgaaagagaaaaaaaaggtacagtttgacacacagtttcagtaaacaagtacatagttgggtatttgcttagttttacctagttaggagagtacaagttttgtttctgagcaagaatcttctcaaaggagaggggagaaaaacaatcagtgcttatttactgtaaattttgaattagagaactggtctgtgtttgtatagtcatgtatgttagcttcataaggacactgtaggttgcagtatccttgttgtacccatacaatgctgaatgagtgagaacaaacaaaaatatatgtgcatacatacatatatatgttatatgtatatattatatttatatatttttcaagactgaaaaaatccatttgccatcttcttgaattaaaaaatacatatattttatatatatacttttatcagagttttttaatcctaatgaactgggaagatgataagtgcttataattccaacaaataatgtgaaacaccagatgcactaaccagtcagcgtgagtagaacatcctgagcagtaagcacagttggggcactaagcaggcctgacttgctaatgtagatgaagaattctccatttggttctgagtgggaacagatgcttcatatcttttagaaaggaaattacattctacagaagaggaactcaacactgccaaattaataagatgagagatttcatcatctcctggaatacattagcatgcaattttcctcttgttccaatgatcctttctgaactagcccttcttagagtttagaacctcatggaagcccgagctgacctagtctacaaccagaattgccttcagagcattgcaaaatactttcttaattcctatatgtatgaaacagtagaagccatgagtgtttccatgtttgtataaaaactttcttacttcagactctgagtaagcgggatgtgagaacacagaaggattcttgcacttagaaagggttagaaacatgacatgggaactatactccaatagaaattttacttaaatgagtaaagtaatgtgaaaaattgcacacgtcaggaattaagaatgatacatttcttgaccatctctttcttcttgtttattttttacatggattcaaggcagcgttcactgaatttcctatttaaatagtaaaatacagtaatgcaaatatactataattccctaaaataatacaactaagcttaaaatataaaatattcacttgcataaccccaaatatctattgaatatctaatttacaattatgtattgctatttggatcacacactaaaactttatgaacacaaaaacctgacctgcaattttcttgctatataatcagtgtctattatattgcctagatcattctgggctctttaaaaactatggccaattaatgagctgaagaagatcttattcagaaggatttttattgggcaagtaccatattttaaagaaaaatacatacttttctaagctacttagagtataggggaagacccatataataggtgaaaccaggctacaaaagtatatgagataaggcataattattattttctgaaaaggaaaaaaaggagaaaatagatagatagtccttaatactgtgatccttctttagaaccaaaaatcttcagttaaattattaaatttccaaaaacttgacatgagtggagtttgccatgtacatgagtgaggtaatgactctcacatctggactcataaagagcaagacagtagaattacattgaaggcaaggaccaaggatttaggaaggttacatgcaatttaactgaaaaggcacctacaactaacatcttgattagaatgatgatatcttcatacattgatcggatgaacaatgaaggaaatgggaaaggtattccagaaagatctgggagaaggtacagttgtgaaattttaccatttagtaagaattgtactgcaaaagaaaagaaaaagttcagtgggaagtgaatgaagatagaataattagggatcaaattatgaaaggcattggttgttaaactaaaaaatatgaaccttacttattctatgggctacagggacactatttaagcaaaattatctaaatagtgtataacaagaaagaaagtgaaaacattggataaagtataaataaggtgaatttatattgtaatcccatcatagacatacagaatgcacattggagtacaagaatacagatgattacagacatcagtttgccaaaattggattttccgagtctaggcagacttgagcaggaattgatgaaggttgtatcatgggtgcccacttctgtctacacagtattcaaaatgattaagcctagcatttggcaagaaaaaaggaatgccatataaaataatttaattttagtaaagggaacttaggaaaatctggccattattaaaaaagaagtaaaaagaaatagtttaaaataaaatgaaccacgggacgtctggagactattttaaaatacatcattagaagcccaagatgaattttttgtcatgaatcataaaaacaagccagatgcattaaaaaatgctttcacagcaaactattacagtaaaagctgccttcataggaagaaacaagcatctaaatcaaattttcccaagtcaaggaagaaagggaagcctctaaaatttgacacatcagacataactggaaattagaccagaaaaagatttgtgaaactatctttgtgaaactatatttgtgaaaaagattgtgaaacaagtaacttcaaagccaacaataagaagacccttaaaaatgtcaaacagaggaaggaaaccaattccggaatccaaagaaatcctaaatataaaattgtattattggggtaatactaaaagaatagttagttcttttctcttttaatgtattcttttgacgatttcaacacctaaactacatattaaattatgtgtgtccaaaatactggatcaaattgccaaaaatgcattgttatatttgacacagataaatacctaagatgctataacatctatacgaaaattatgaaaaaacgtaagggttaaatgttgaacagtaagccaagacatatgacctaccagtaacaaattaagcaaaccagaaaagacaagttgtcaatatgatccccattcataaagacagaattcagcgaagaccctggaaatctaaggtttactttcaaccaggtgatctggtggaatctgttacaaaggagagaataactatcttcttaacacaatacaactcacagaggaatcatggtactgggagggaaaatgatgcttgaatacttgtatgactaggttcatacaaaaactgcttgaagattgaatcaccatgggatttggaaagatgttctaacatgcataaggagctgtcttagagtcaagaaacaagtaaagaccaaaaaaatatttcttcaggtggaaaaattcaaatactgagggcttcctaggactacagtgctataacgtctctagaaaaaacattacccagagaatgttctgggcttacagataatatcagagtgcttctttaccttgcaggccatctacatgccttaactaataccccagggccccagcaaagtcccaagggtaaggaagtaggtggagaaggaggaagaga

SEQ ID NO: 19 - DNA, 160691 bp, Artificial Sequence
  Synthetic BAC sequence
tgagaaaaactatgtttctgaattggtttgaacacaggaaatattttttgtgtacaggacaaagatgtctgaaagacagaaagatgcatataacagcctttccccagcatctctactgtgatccagtagaaaagcttatattcatgaccattctcaacagttacttttctcccacgcccccaagcagtgactctccaatctaaaataaagatacacaagaggttggtctcgttctagttttcctttcctgtcatcaaatgatgtcatctacattgagatgtcttggtttgtgtccttgtgactgaagatataagaaagcttgggaggccgaggcgggcggatcacgaggtcaggacatcaagaccatcctgactaacacggtgaaaccccgtctctactaaaaatacaaaaaattaaccaggcgtagtggcgggcgcctgtagtcccagctactcgggaggctgaggcaggagaatggcgtgaacccgggaggcggagcttgccgtgagccgagattgcgccactgcagtctagcctgggcgagagagggcgaccccgtcgcaaaaaaaaaaaaaaaaaagatgcaagaaacaagaaagcaagtttgccactgtccatgcttacaggattcatgtacacctgggaatatacatatgacatgagttgagtgaaaatttagtaacacaaattagaagaaagagaaagatgaaaattagtttaaaggaggtaatttacttaaggaggaaagttttgcattgaggcataaggaagtgacttccattaattggtgtgaaatggggagaattttatgtgcacaggcatagagacggacatgtttaggtgaaggtgaagaaaattagttcaagtgaccttgattagaattgaaatgtccaccgtagattatagagatagatgaactaactatgaactgatgattagggtgtaaagagatatctccattgccagatatagccttatactgtggacaagcatatttttcctgcagagatttatcaaagacctataaatggtatttgcccctctttcaaatatgacacaaaaattactgcttagatagatccagaaatacattggaaagttttgtggatgaggatctggaaagtatacacataaaagtctaaattagaaatatttatactaatctttagagtaatgcagaaaaaatgaccactttctctggtactcttttgctattctatgtgataaactctttctcttccagtttcctaaaaagttatgtcatgaaaaggctgaatttttctctagaaaaatctgctctgtctttcccaggcagcataaaaattggaaatctcacaagaaagcactctggcttgctaaagaaatttgtgagaaatggaaacagctatagataagtatctaacttttaggaagccattcaaacattgctgaaatactttgtcttttgatatttgcctgaaacttaacttctaggacccagggtgggtggatgagtcgaaggggcatacggtggcatttctttccgtgagtctcttacagtctcctatttaaattgagttaggattacttctggcaaaatcccaacataaaaatcttctaggaagatcagttctgtaaattagacatactagataaatgggcatcaagcagtttttcaaaattatgcagttgttaacttcataaggggaaataaaaatgtatgcatttacattgtatgtattaaaacaaggcagagcatttctatacgttcctaagttatacaaacatatatgtaagagtgaaatatgtaaaaaaacttttacataagcagatgcatacaaactccagatgtgctctttttcttactgtgggttgtgtcttctataagggaaaaagaaatatttatcatttcttttactgctgaggggatgggtgcggctctcatatttcagaaaggggctggaaagtgagggaagccaaactttttcctatttaaggccaaagcaaaggaatctcagtggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaaggtgagtaggtactgatttcaagaaactttatgggatttttgtctttcttctcctcacaaagaggggtgtaaaggggaaaatcagttgcctgattcaagataatttcctctataagctccagattgtgaaacgttgaactgaccatggctgtgctttttacattacttgaaaaataatcgcgttatgtgtgtttttaagagttctgtggttaagataagatgttcttgtactaacttgttttcatgttaaaggcactggaaacttttaaaaatggctttaaaatttttccctcctggattgttaacatcttggaatacttccccaggcagtctggaagttattggtctcttgcaataattttatgttcctctttgtctgctggattctttgtaaggttagaatattgagcattgttttctgaataagaatgcctttcaaatatcatggattaagaacagtctaaaggaagattctacgcattatcagaatcattgaatatatttctgtaaaatggctacaagatacctataaacattcttcaaagggatcaaactgctaaaatattttattattcctgtttttattttgtttcaagaatgattgattaattcatcttttctagtagcttgatattaagggactaatattttccacatattctacgttttaaccacattcgcattaatgaagaaaatattttttaaaatgtttcaacaggaggtttgactttgctgcaaacaaggtaaagatactagtactgtttgacttcagaaagctgttttgctatattttctaataattgcatgtaatgtttttcatattctaatttcccctaaaaacacatttgtctcattatttatgtgaaaatattcttttatttaccatagtcatgaaaatgctgaacaaattggaatacaaacttccatagaaataaatatttaagtgctaaatgtaaagatagctaggagaaattattagacaatttttattgcacataactaaacatggttacatttaaacatatagattttgcaaaggacactgcatgaaaatttggtttttgtttgtaatatcaaatgtatttgttgtcctcatagctaatacatgtaaatgtgtgtatgaggggaggggtagatatacaatgaaatgtcttcagttatattcagcccatggacacaaaagaaaagaaacacccattttccttgttcccttaatttcctctcctccttacccctcctctccttcgctttgccctcctccttatctctctccaccccttttggctcctttagacttctcttcactcatcaccccaccccttcctaggcaagcccatatctactcctctctcctcctctgtcttccctgcctgttactccctccctactccccatgtggcctccttatgcctccatttcttttttttagttctctctctccttgcctcctcaccctttctttcccctgaactctcaatccttcttcctttctcattcctctccccttttcctccctatcctgctcttcccaggagatgctacaactcacagtccttttttaggataccaaatgactactatcccccaccaaccatttattgaaaagactacaaacttaggggttttagctcaaaaaattgcaacatatttgtagttgcctcgtggttgcaagctttttataagcactgtggctatttttcttcccaatccaactttagtgggggggtgtttgccacttacagtaccttgacatcacattaagttctgtttatttccctctttctctttagatgcaaaaaataatcaataagtataaaattttgctgatatgtgtttgtgtgttcttaagctcaaaaagagttgaaagagaactgttcagcctattttttttgtcatgagtaaaagtaaagttgaagtgacttaagacagtacatcttatgttccctgtgggttttacaaggaaattctgctattagataagctttggaaaagttacaggaggtatctgaatatacagcacactgagagctgtcataaagttctggggtggggtttcttatatatgccctcataacttcagagacggcacagctctaatgaacactcacttctagttcactcacaggcattttctggatacaaacaagtcctcaaaaagaattttggtcgtcttacaaatttgtgaacattgtatttaattcatgtgttttaatccaccaatggagaaacatagtctgttttatatttcctgtagattataaacatgccaagttttaagtacaaagatgcgtcacctagtggctgacaagccaggttaccatttacataacgaatgccaatattaatgttatgtagctggctttggtagtttataatgagctttaaaaaattcatatgcgtgaattttaaatgttaacactgctctcctaaggaaattagtatgttacggataaatattgcaaacacatatactgacacgaaaacacaatggtaacaatattcagagtctttttggaaattagcttaaatgttacggccacttaaaaattctacatatgactattgtttaaatacatttttcatgtctctgatgtagtccttatttgacataagtattttattcactgcttaattgttagatagattatagacagctgttactaagtaatactgctccattagggcagaaacagaaactttattttaattaaatgtgtactaatgtttgagtttctatattttgctacagtgataattccagtaaaataaactgtaggcctctagttgttttagaattttaaaactgtaaatggactcagagaatcagtttcttattagacgtcatgagagtatatttttttcattatgctttaagagggaatttgtaacttgctcaggtaacattcaagttttctggtttgtgtttgtccctacaattaaacacactgaactaacaggaaaaggttacatacatttaggaacaattgcacttttaaagggagagaatgcatagttgctcacatatctcagtgtcagtcacctaacatggatcagtgctttatttgagattacaaaactagaaaatgacggagtcaaggctaggaccaatattctgttcagtcttagataattatagaatacacattaaaatcagatatttgaattttcttaattttgtaactatttgtcattgaaaggagatactaaaaaaattatatatcgtcctagaaagtacatgaactaataatgcatttctaaaggtgaaaaaagaataggtatttttctgtttaatattcaattttatagagagtagtacgttaatttttttaaaccccagaagctcaggatcttatcattttaaaagaaattatcaccagttctgtgtgagtaaataaagtattataacactttgtgtttttcatccatgataccttgtatttacttacctgagctttttttctagggaaagaaaaatgctcaggtaataacagagccttgaaaaatttggattttcaaaactacctatttatgtataggcctttagatcatctgatgttgaatactctttaagtgatctaaaggcctacatataaaaaggtatttttattaaattctggaattaaacatttcagcattacaagaaaagaaagcaaatccactggaacaattctgggaaagaaggaaagactgtgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactcaaaaaaaaaaaaaaaaaaaagatcatatagtgtaaaaaaaaactctccagacttttcaaaggggaaactttgcctgtttcatgtcaagatgacaacggaaaaaatgagatagctattcttacataaatcatttgtgaactgcagttgggggagttacattaaccaccagagtttcagtctgtgtctaatgaaaacacagcagaagtggattcctttcagattaactaataaaacccttgtttttttccatgactgaggtcaagcactgctgtttaaaatgtagtcttaatgaacaaaatgaaacgttgaaagaggacgagtcaaaatgcccaaaagatgtaaacatcaaagagaaaagatccagaaattattaaaagttaaacttcccttgaattctagtattaagaaagtactgcttcagtaaaatggcatatatttttctgaaactgtttttctatagtattttgtgtggaggatgacagagactgcatttctcaagtaaattaaaatcacagaaatactctttggagttgcatagcatgttcacaacgttccagtttcattcagtgaaaacttctgatgaacttagatgtatattaacatgaatcatttagtaactatattttctgaaaaacagtgtgttaatgagacatcttaaacatatttttgcattggatgcagaagtcttttctgtctggtactattgttgttagaaccctacttttttgtatatagcaaaatgtatgcagggtttctgagtcacacatttattctgttggtggtctggatgtcatcagggtagctttagagatataacccttcttcataaggtcaagagaaaataaacaggagaatttaactccagatggcatcttcctgttttgaggccagatagaaaaatattttgcaaagaactgttgtccttcaaaatatacctatctagattcagattttaaccttgcagggataaaaaatcatatgggacagagctttggagttggcttctttaatcgtactcagttttgaaatagcagaaagaaaatagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggaggtactatagcactagttttactaacgctggcaaataaaattactctaaggaagaaattaaagtacttagtaacttagtgataaggatggtgaaatgtaaaattttatttataagactatacaatttaaagttgtttgccaaatgtaataagacaagtagaatatattctcttcaatgtttttataatttgacactaagaagattttattatatatgcaattgctggtggttagatatatgatacttaaaattttctaattatctaattatttttatttttaacaggataaaatattaatcaacttaaaggacatttctaaggagattgaattctaaaagattaatcttttagacaattctaaaagattaatcttttagacaattctaaaagattaatcttttagacaattctaaaagattaatcttttagacaattctaaaagattaattgaattctaaaagattaatcaacttaaaggacatttctaaggagattgaaaaagcatatatctataaaatatgaaacaagaaaatatctacaaatgataatttatcaactttttttcctggaggtagcaagaataaataaaatcttattttctatgcaaaacagtgcttttaaattaaaattattcacctagaatgtctacagatactttcttcagagtcctttttgttaagtaatctaacatattttaagatactctgataaatacataagcagcagaaaaaatattttattaaaatttatgttttccaaacaatatcatttaaaaggcaaaccaaacattatttcaattggaaactatatgaatgccaaatacccacatgtacaaaatattcagctttctaaagtaatgaaaataattatgataatttatatatcatatctgtgattcttagattttcagattatacaacatcttttcccagataaggatttagtaagaagagaaaaggaaaaaacattcacttttcattcaagccaaattaattaatttaattaggtgctttagggaataatattattgctccaaaaatagtattaagacaaacataacattcattttttgtccaaacaatatgatttcttcaagtcagcatgatttaacatgaagaatggaaacaaaaaaatcacaaaatagtaagctttatgcacatctaaaaatataaaattatgttatttggctttatttttctctaaaattccaaaatagaaaactaggaaagaagcagctaagagtggtttaagacatgtgttagcttcaatatgttttatattatagatcccagcaaggagatgattgagtttaatacattgcttgtgtgatcacaagtaaatttctttcagaattgtacttcgtagtaaggaacagaaacaccaaatgacatgggagatggaatttaaaattaattataaattggaacagagagatttagtttaaacaactaaaataatggaaataattggaaagtccattacttttcaatagtagaatgaaattatttgccttttatttaatatttttggaaaaaattaacttatttttttaaccgaagctactctgaatgcagatatctaagaaatgaagagaataatatgagatgacttacttctaaatcccattttctattctatttctaaatgttgcaaatggctaactagagcatttttattcctctagaaacaaaacattcttttccttgactttgccatgattttcgcacatattactaggtattaaatgaaggtccatgaaacatcaatctaagagctttaactttcagtagaatatattgctaactatattttgtcatgcatggaataataaaggaagctatacaaaactatttttttcagcaaaggtaactaaggtagaaaaacagagaaagggctaattttcagccacaagtttttacaggaactgacttctcaggagagccaaatttatttcaagtggatgtgaaataagttatggcaataaataaagttgcattaattcttattttttaaacattccaactctcttttttttacttaaaacaatatgactttctaaagtaaaacaaaacatacatgcaccatgttgactgtcatgtgcaggtgagaagagaaaaatattttaagaatatgataatttttaaaattgcactaaaataatctttatattgaggcctccgtgttttaaaaagtactataatatgtttctaataaaatttagaaacaataagctaaataacaacgttaatacttataacattgcatttgacccaattttaacaaactcatttacaattttaataagtcaatattgtgctcatttatttaataattagcagaacaaatggaaagtactgtatttctaatgatgtgaggacacccttaatgagacataaacataggaggatgaatacacaggagggaaaagtatttatgttaatttctaggcagatcaagaacatatagaagatacttaaaataggaaatgtttgagcctagctttaactattatcttcatttgtctttaatatgcctttagtattcaatggctgtttttcataatccacgtgctgtattaagtgtgaaaagatatgcctgatccagaggcaatgagctaaaagaatcatctgtacaatctaacaatgcttttgaggatggatctggagggcttaaaatacacattattaatgggaaaatcttgggctgaaactaatctgtaggaatatttcatataaagttgatttggagaaaatttttaagtggttcattttgagaaaaggaaccaatgtaattacagtgttccatgtaattttactgcacaatcttccaaacccaaattttcggaccttttctgcagactggtgaacttagtacttaaatatgaaacgccagttctgtctagagaacaaaatgagtttaatgcatagactcacctgttattactcttcacaccaatgtgtaaatgactgtttgctcttctattaaatatattttccgtaacaccattcaaataggcctacttcatttccactgagataagcattttggtattcagcttttatattcactaagaattaagaaatgctgttttaaaagcttaggaaatgtatatagaaaatatatcccatgttctcatatatgtgtttcagacataggggaggaattagaataaattttctaaataaacaaattatttgcctacttaaaattgcaattaaaaaatgaagctttccttcgttagctgtaaactacattgagaaattgtaacataaaaaagaatggatttttaaaacttcttgagtagatcaagtgtcttgtacaatatcattaaatttgtatcagaacacataaatggaaatgaggtggggaagcaattgcagtactttctagagtctaggttttgaaattctttttggtgaacatttactaaatcagctaaacatttcaactcatttaaacacaaacctaaattattattaccctagacagagagatgatatagcaacgggacctcgaaaaggtgatcttttgtggctgcatgtagtgcccagatggaaaaatcttaggaccactaaaaggcctcttgaccactaggcggcaaaaactaattttgaactacttgcctactcggtagcaggcctctttcaatagacattttaaatatcttggctttgagaaaataaaaatttcaccatctcacaaaaatataaattactgaacagtacatcatttgttgtttgcaaaaatttttgcagatgcttagaaacttattatttatttactcaattactggcaaactatcatactaattgtcaagaactaaagttgtatttaaccacaatacacagctaatgccttaagaattgagaccaggttttgttttggcaattcctaagctgattcatagttaatagctgctgaaatttcagtaccttgtatataattatgaagcaagtctaaaattttggttgaagcaattttttttaccattttaagccacaaatacagatggttatgattcatattttccctattatttttacttattccttgccaatgtttattttaaaaacatctttttcttttctttttggtgatttggaaatgtctttacatccatatgggatatacaatatattatgtcatatcatgttgagctactaatgccaaatagagctaacagtgacattcaatacacataataagttctgttaaaactttcccaggaaaatctggtagagttttatgctgccaagattagctcagttttcccctgaatttctcaactaggttgataaaatccagaaagtcttcagagttagtgacaaaatcatctctttagtttaatgctcccatctgctgttaaggcaaagaatagcaattgggtagaagagcttattttcaatgttcctttaataaataaatgtttaaatgcttgtgtgatatacattgatgttaattcttactataaatgaaattaaaatatctgctggtcttaaggaaaattgactatggtgtgccaattttatgttaacaagcagatatgatattttaattaatttcttgctacttagcaaattacatagggcaagtataattttctaatgaaaggaagaaattatttgtttcaaaccttttcaactttggctattgttaatagtcctaacagagtaacaaaaatcacctttcagcaaaacctaaggaaacttcacgtcatctaacttgtttttcagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctgtgagtttaaagataaactgtacatcttcaatattcatatttagacacatgaatagctcctatatcataggagcctaaaagggaatgaaagtcatgttcatcaaatagccatgtttgtattacgagtaaaaagtgaccgtttcaatttaaagataaggattggttagaatctgggttactaaataatatgcaaattctgtgtcttgtttaacttgtttcttttccatttattagcctactcgccctcctaatggtcaaggacctcaaggccccaagggagatccagtaagtaaacattcttcagtagaataaaattaatactaatgataattctagtaagagtttgctttttctagatttgagctttcatcatacattctcttcattaccacatatttgaataatggcaccaaacaacagactgagaatccataattgtacgtgtaaagatttcaatttcccaaacttcatattatgtcttcacccccatgatcagtttaaagaaaatgtgtaggtcaatatacaaaggaatacattatacttaaattattcacaagattttgattaaaaagtatgtgttataaagaaaatatattacttatattgtttcctaatattataaagtagagaaacaacaatctgataatgattgtgaatcaccaggatttttcactatttaatttatttttatctcttttttagggccctcctggtattcctgggagaaatggtgaccctggtattccaggacaaccagggtcccctggttctcctggcccccctggaatctgtgaatcatgccctactggtcctcaggtataacaattacggtacttaaaaaattccctcataaaactatctagttcatcttctttctttactcgatattacgtctcactattatgagttctttgtatctgttctctgattcagtgtatttaataaatccttatttagtgcttctatgtattaggcactattctaagtactttataagtattcatttttcctcataatgctaatgtcattgctactatatccttggaaaatttgctaatttctcagcagatatatagcatacacattatgtttaagaagtgaactatgaacttaacaaaaaaaattaacctaaataatttagttagtactgtatccatactttattctcctactaataccaatgtcaaagcctctaaaagtttagacaaaaagaagttgaagaactgttagtattcctattgaacaggattatttctgcctatgaaactgctcttgctaatacttcagagcacaccttgcttctcctgaagcatggcagccaaataaatctgcaggtaaaacaaccaaacaaataaatatgacaaaatttctgttgcatggaattaggtgaaacgagaaaatatattacacaaatttttgtgaggttaaaaagtgcatttcaaaaagcaattcaacaagaaccaaagtatattgtctaagttattcttattctagtaaccaaacagaacctaactctagacctggaacttagaatttaaaaaaagcttcaaagaaatctaataagcatatgagcctttctactattttttggtttattttctatggagatgtttatttttgagtgaatcttttagtcatattaaccagaatccaggggatatgaattttacttgtatcattaagtgtttgaaaaataatttgacttcatttttttgctcaaaatgagaaggtgtattatatgatctcgagactcttttggcctcaaacagcctatgatcctatgtttgtaatgatgtagctactgcttagaaataatagcttaagtaagcgcataataggaaaaattggggggaactaacattgaacacagtggaaagatttgtgcatcccacaagaaaatgcttctgtaggatatctaacgtctaaatctacagaaagacacgataaacaagataattagtgaatacataccacatcttttggcacacaaaaacctatcagtagacagtagatgttgcatgcacttctaaatgctttttaaaagaattatgaactgtctgttaaaatgatcatatctatttgtctccttgccacagaactattctccccagtatgattcatatgatgtcaagtctggagtagcagtaggaggactcgcaggctatcctggaccagctgtacgtacaaatgtttctcagcattttggagctttattatctttctggtttgtaaaatcttgaatggttgctcttctaggaattcagtatttttatggaattgtacaaaatagcttacccctactaaggttggaaaagaaaatggtagcattatcatgttctttctatcttattcatattattaaacctatttttaatcacatataaatttttactaaaaaaaaaaaccaaagtcaacacttattaacatctcagaaaagtgtttataagagaaaatggaaatatacaaactattgttttataaatttactatcagtatttagaaacagcatgttacaaaactgaagcatactgttttcagcttgctgaaggttttctagtttaatctgtatttctgaacaatgataaatcaattgtcctatgtatgatgattcttgcatgatcatataaatctctatgtcaattaactctgtgatagatatatcaacataattatgggacttttgggttgatttacattattattttagatacttgattataggatttctagtgtgccaataaatgtttttctgcactgagtttggctgccaagcgagaaattgcttcttcaccagtgcaatataaccctaacattgcagggattttcatagcattatgtactagtttttccagatttttaattcccttccttaagagttcaggacaacattttataacatttattaataatttatatagaatctgtgagaatttcattacagtaatgtttgcttgctaagatcttcattatagatctcatgaatagttatcaaaaagttatcaaaagatgagatatagttgttcatagttttaacaatgcgagtgtcattgctttgaagcatggataaagtgtattttgcattcatttattttgtttttcattcaaattcacattccagggccccccaggccctcccggtccccctggtacatctggtcatcctggttcccctgtaagtatagccattggtggtgttttcttcctcatttttagaaaaatcaaattaatatatattctgctataattcagccattccagcatgcataatcccagttaactagagaaatcataaccaagaaactgattaaggcttcaaagatggaattccatatttaattcctttccaccaacagttattagcaattgaaatcttggtaaaattaaaccacattaatttgcatgtaatatgacttttagttcaaaaccattcagttttgatggattgcaatgaatggaatgaaatacattaacttcattctgatctaaaaataatttggtctcaatatttataaactggagtaaaatttgctgattacattcacaatcctgatttcttactgtcaagatgtaaatgaattatatgaagattttgttactttaaaattatttacatattctactcactagggatctccaggataccaaggaccccctggtgaacctgggcaagctggtccttcagtaagtaacaattaaatttatatttagtaagtcgataattccatatggaacctacctttgttttctaaaacaagtataggtctttacagaatgaagattaaatttacccttaagtttgtaaataacgaatagcattttattgagtcttttggactctttcaattgttagctatcttagagacactagttaataaaggaattccctcatcattagccatcaaaatagtccacttcccagagctgataaaaattctgtatatattaaatatagatttcatttttctgtaaacactcagttcactcatatctaatctactgataaatatagttatatatttacatatgtaaatatacatatacatatatcttagacagtagaaataaacataatcttagagagtcctttagaaggatatgctctgtaaataagcaagtaaaatagtttaaatacaacatttcatgacatttagaaatacctttatatttagatatatttaatattcctaaacgtgtagaaatgcatttggatttataaatacacatacgtaatatatgatgcttttaatttttattaacagtaagttgatataatagaggtataatattaactcagtaagtatcattttcattatcagaaacattaaaagtattttctaaaaggaggttccttccaggaatacatacactgtgtaataataaattgtaacagaaaaatttacaaatctattcattttttatttccttattttcagggccctccaggacctcctggtgctataggtccatctggtcctgctggaaaagatgtaagtttttaaaacttaaataagaatacagcaaaatttaacttggtgtattctaaacagtatatgctttatgtcagaatcccagaagaaaaaaaaatgttattcaaaatattgttgtcttaacaacattttagttaatactaatttttgagtagctatacagtatttgcgtttctatatatatcatttgttgaattccaaaataaaatccttaaagtgctttttgactgcggagaagactcatccattgaatatattatttaactggaggagaaataggtgtctctgcctgcctcttttaatgatgaaattgataccactatttaatgaacttgagaagttatagataccttcaattcaatggcattccttctttccctcttaatctccaatggcaaattcttttcactggcttatgttatttcagtgattagaagcacctgcattatctctttataagcttatatcaaagtgggaaaggtcttcctcatgccttctaccaagaaagctgatctcaactatacattttgtggaaccattttaatgagtcctttgtgagaaaaatgcaaagtaaccattttgcttattggctacaatgtattttctcatacatgagcacctacgtattctttatttctctacctagggagaatcaggtagacccggacgacctggagagcgaggattgcctggacctccagtgagtcttcagcatctaataaattaattggaataatcttagcttgaaaactattatgtaattcaatggaattaaacttaaaaacagaaagtgttttactactagattgtgattctatttgaaggttcattaatattttttcattcattatttttagggtatcaaaggtccagctgggatacctggattccctggtatgaaaggacacagagtaagtagagtttctaagttgtttacaaggtattccactgggctatgtttacttgcctaaccaattttactggacaattatgtgccaaaaaatatgattctgacaattaattaatttgatatttttaagtctactaagtttgtttgttgaccaaactagtcattttttgcaaaataaaggagttgatttctagtgtataaagtactcttgaaaaatatcgttttcttactaccactatcagaaaaataaaaacattttgtgaattatgttttttattgacttaatatgatttatagattgagttgaacaactttattctatgcaaaatatttcgtacattcaaccaactgtgcctacaacctatcaactgaattataataaaatctatgaaactcatgtttgctactctatagttaaggcaactttcttatcagactaaattgcactttctagttttcatgttttcctgttgtaaaatcagtatgaaatatcttcaacccctttaaacaagttttaaattatttaagctaattttgcaagtagtgttatgaagaccaattagaaaaataccatgtaaactttatcaatcattctagattattaacagattttaataattttgctggttttatacatttcctagggcttcgatggacgaaatggagaaaagggtgaaacaggtgctcctggattaaaggtaaatcacaacaaaaatcatattttcataagtaaattcattaaatattaaagctacatataagattcatattgtgagccttaacttgttttctgaaatttacctgaattttacctattaggtgtgaataatggtaaccaattcagatattctattaacgcttccatgaaaaatgacaacttgaagagtctagattagaaatagttgagcatcttagtataacttatcaattacttcactttagtctttaagtttttaaatacagaaattgagatttctggtaaataaaatactaacagaaaattaatattgttaaaatgtatatctttttctaggctctataaacttttccataatattctgtatttaaaaatatataatattttcttcctcttttgtaaaatagtaacatattttatatgtatctagggtgaaaatggtcttccaggcgaaaatggagctcctggacccatggtaattatgtttcttatgtataattttcagttttattattaacctcattgttacctaaaactggctttgctcccaccccaactgttcttacacatgtcaagattagagtaaaaccatatttcaattttactctgtagggtccaagaggggctcctggtgagcgaggacggccaggacttcctggggctgcagtgagtatagctgctaacatcacacaattacaacccaaagtgacagatttttacagcctcagtaaagtttcaggctgtaaaaatatgttaggaaaaagaccttcctacaaaattatactcaatgatactgtgataaagttttggctatagttaaaaggaaatgaataattgttttacaattattatctctattgagaatttttgtgttaacttttcatatgtcatttgagccattatatctgcattcagtcctgaaaacacagactccaatccttctacatttgattgttgctgtatatatcagaattgtaataattgactttaaaatacataattattaagcagattttaatgtacttgaagaaaactcaactcacttgagtcagaattttggtcaaaatattactcatgaccagccattcagaattaaaaggatatttgatgtaaacttctctttttagggtgctcggggtaatgacggtgctcgaggcagtgatggtcaaccagtaagtaactttctatctcttatgtgttgtagggtaatgagaagttatggattgtggattatttaatattttatatatgtatatactcttaggtatatatatatgcatatgtatatctctaatatacacattagcatctctgttgaccatttttacaatttaaaaagtgaaaaaatattgtagccccaatacttaatattgtatatacactcctgtgattaaaactgacactgagcccataaacaaaatctaggttctgacactcattctgcttgatcaactgctaacatttgaatggtgctcccaatgttagttaatatcctatgtaagacatggcactttaaagagtcctacaaaatggataaaatagatgttacctccattttgtagactggagtacaaaagcccagggaaaagtagcctgcactaagtcacagaattcatggcaaagtagggagaaaccaagaatttctaactttagatttcactcttttcttattttaccacattgtttctctacataatatccataaaatatgaatatcatttttatctgcataaatatcttctttactttatatgtgctcacttatttactagtatgtcagctttcatttagttgaaaaagagctcttgaaattgtatttaattttttcagggccctcctggtcctcctggaactgccggattccctggatcccctggtgctaaggtaaacatgtgtttctatagaagggtataaaaatatcttggaggcaagagaaaagcattagattgcttcttgcaactgatttttttaatcagtcaaatggatagcttttatctatacatgtctttaaagccctattcttgattctaaaagaggtgttgtccctagtattcaactatcttgatatttcttctgctaccttctttttttccccagactctttctaggaaactgataatgcaatcacacacacatagttacatttttctctgcctttacgattaatgattccttgctttacctgcagtatagagtcccactactccaacttttgggagatgtgtttaaacaggactgaagggtgaagtggctaagtgagtagaagtggtaagagaaactgactacacaaggttttaccattagggtgaagttggacctgcagggtctcctggttcaaatggtgcccctggacaaagaggagaacctggacctcagggacacgctggtgctcaaggtcctcctgtaagtatcatagttgagagggagtaagcatagtttcatgcttactccatgaaagcatagtttcatgcttactccatgaaagcatgtgcttcaatatggctatcagtgaaaattactttgaaaaaattgttgcttagtgctctaaaatgatcctcctgtgacacatactgatttgattagtagtaaaaatgatagtttttgactgttgcactattccagaattcatgattttttatgtttatataaaagaatagaggatagactagttttctgatgctttcaagaatgtgccccaagctaatcaccaatcataaaaattcagagaagaaccaaattcaaaatctcttctatttatgtatcatttaataatttatacgaagtacatattatctctaatttatttagataatgatgattcttttgaccacatttcatatgttgtgttatagttggaggattcacttaatctctacaaagcataacactcatcgatacatttattttcacacaaacaacttcaaatatatacgaactatttgcattactattaatacattatctgttttttgtatacttagggccctcctgggattaatggtagtcctggtggtaaaggcgaaatggtaagctgtccccactcctcagccttatctcatccacacattactggcttcttttgcattttgcatgacaatagatttgtgatatttaagtgagatattcataaaagaacattcaagttcggctaatatagtgtctttggtttgttcttagggtcccgctggcattcctggagctcctggactgatgggagcccggggtcctccaggaccagccggtgctaatggtgctcctggactgcgaggtggtgcagtaagttgccttgttttttctctgttgactgaaaggtatagtttaattccatcaacaaaaaattaatagcaaaattttgctcctgttcagttgaatttatattgacttcactcttgtcttataacttataactgaattatgtgttactggtgatgatttgttagtcgaatcctccctgtgtttcaaccaagactttgttatactttagggtgagcctggtaagaatggtgccaaaggagagcccggaccacgtggtgaacgcgtaagttttactgcaacagatctggttatttcttgaaaaaatgcaacataattagaaagtaaacaggtaaaaactttgaactaaattcagtcataatttctttattttaccatcttttttttttttcagggtgaggctggtattccaggtgttccaggagctaaaggcgaagatggcaaggatggatcacctggagaacctggtgcaaatgggcttccaggagctgcaggagaaagggtacgttttccatggggcatctaaaagaaaagcagcatcactgtcatctaaataaaactaccttcagggtgagacagccaatttttcttaagttgagtgttcagtgaaaatattgtttaaagcattctatgacataaaaatatttgccactcaagaattatgaaaaagaattgaaatcctttggactgaaatacttgtctttcattattttcagggtgcccctgggttccgaggacctgctggaccaaatggcatcccaggagaaaaggtagataactttagtttctatgttcctaaatgctagcaccacaaatgggcagttcttgtatacaatttctcattcatgaaaacctaaatatctgaagaatatatattagagttaagaaaaattcctaatataatgcatcctctgttcaacaactttcctggctttgtaactaaagccacttacttaccctctatgagaatcctttacttatctgttaattggaaagcatttatctgagcatcgttgcaagagtacagtaaactaaaatgcctgaaaagtctttgaaaactctaaggttacatcaaatatgatttcatagcattaagatatttgattttagctgcacataattatatttttaagcacagtgaatactgttttattaagcatgtgatgttcacaaagttgctttaaaattttttcaatatggcaatccaagctaagataactgattttatgtataaatgtttcagcaacacacgaaccctttttaaaagttcaaatgacgtcctctctttgtaaccaaaatattgttgctatctaggttagtgaaggctattttaatttttttaaaatttctttcactacttagggtcctgctggagagcgtggtgctccaggccctgcagggcccagaggagctgctggagaacctggcagagatggcgtccctggaggtccaggaatgagggtacagagaaacatttgtttgaatgacactttaatttagacagaagaaaggcaagacaaatgaagacagatcaaaagcaacttaaatcaatcagattacatattttgtaaggcaccaaacaaaacaaaattcttttaagtaaacttaagccgagatagttcaaggagaagagaagatagaacacttgccttagatactttatagacaggaaaaaagatgtgcaaatctgaggcttcacatgtaagtgaaaatatcaaaatcatacaaatagtgtatgtagtaattttttattatttcattttaaatcacctaacaactgacttctttacttcagggcatgcccggaagtccaggaggaccaggaagtgatgggaaaccagggcctcccgtatgtacatttttaaaatctcattttaaaaggccagttaaaatggaatgtatatgttggcctatccttgagtgtgtgtgtgtgtgtgtgtgtatatatatatatgtatatgtatatctatatatatacacacacacacacacacacacatactatatatatagcatgctttaatcttctctttatcaaacctttattaatgtaattttttcttattagggaagtcaaggagaaagtggtcgaccaggtcctcctgggccatctggtccccgaggtcagcctggtgtcatgggcttccccggtcctaaaggaaatgatgtgagttccttcattaatttcttcaataaatatttgactggaaggcttttattttccatatggagtaaagaaatggtcaaaactcagtctcctcttcaaagcatggaggagtatatgaaaatcaaattgcatgtaggaagggagctaaatatataattggttatggttgtatgtgtgtgtatggagcaggcagataaaaaatatgaaacaggctgggtgcgctggctcacgcctgtaatcccagcactctgggaggccaaggcaggcagatcacctgaggtcaggagttctaggccagccttgccaacatggtgaaaccctgtctccactaaaaatacaaaaattagccaggcatggtggcatgtgcctgtaatcctagctacccaggaggctgaggcaagagaatcactagaacccggggggcagaggctacagtgagccaagattgcgccactgcactccagcctgggcgacagagcaagactcagtctcaaaaatatgtatgtgtgtgtgtgtatatatatatatgagacatatatatatgagacatatatatatgagacatatatatatgagacatatatatatgagacatatatatatgagacaataatatgattagttattgccctttgaggattagtaaataccgaccacttcttctttagggtgctcctggtaagaatggagaacgaggtggccctggaggacctggccctcaggtacgtagctttcctcaatttatttctagccttctaatagatgcgttcatctccaaccttctgacttctctctgtaatctgtattatttctacttccctaactgttcttgtttttagggtcctcctggaaagaatggtgaaactggacctcagggacccccagggcctactgtaagttcactcatataaaattggagatgaaaatagggtggaggtggggcaggaagaatgcttcaaaaattacataatctctgacaccatgttgttacagtttaccaaagcaatgatgaaacttgctgacctagttatctagctaaatgctagcattgagtttagagtgtacatgtgtgctttgggtccaggtcctcccttttcttcacatcactacttttataattaagcaacaggcctgttgaaatggatactgtagactaaatataaaaggatgtttacaacagagtgtatcattatacttttctaggggcctggtggtgacaaaggagacacaggaccccctggtccacaaggattacaagtaagaacttgttatttaaatgtcacggcatatctgactgtcaaatttttttgtgtccctaatagattataatttatctgaagcttaacttgtgattctgtctttcatctggaaataaaattttaggcaatgttaataggtaggcatatcttccatgtccgttccagagcacattaataagttatttaaaagaattaatgaaactcaaataattctatttggttacacttatttttattataacataaatccatatagccaagtctatcctgccatgctggtcaatacatttttacgtgtagcaattgaaagaacagagagagatgaaaatgggtttgtaaaatatgattatcacgtatgtgtcactggattttgagtggcacaacgtttctacccctacaagaccactggaacttttttttaatatcttgcagaaacatgtgtacatatgagaagcttttctataagccatgtttgaggtaattacctaatacaaatatgattctttctagggcttgcctggtacaggtggtcctccaggagaaaatggaaaacctggggaaccagtaagttacgtttcattattcaaaactcagaaacaaaaagaatacacactgtttgtttgtcaactattaacttcttaattttcttatgccatgatatttgagatttaacatttagttttgaaatattatcaaaacaaagacaaattatttaaaagataactattatatagagtttgaattttaccataaaatagagagttcatagtttcaagatttgaaaaattatacagtatgccaacatgacaaatgtgtattttgcttatatttacatatttgcttatatttacatatttgcttatatttacataaaatgcactctgatatgggcctaatcatataatgccaatctcccagggtccaaagggtgatgccggtgcacctggagctccaggaggcaaggtagtatttcaatttattctctaccttcttcagcaggttatagagcaattgattagtagtatatttttagtatatcaagccaaaatactctttctttaaaagagcatcattgcaaatgtttggtaagtacacttagagaaactcaagacactttcaatacattaaatttgctttaatctggaaggtccaattctctgacattcataatcactacagaatcaaatacgggcttaaaatttcaaacggaaaaatattgccaatatgttgattctatgtaggaaaactgttttggtaaaaagaactttaaaatgttgctcttgtgaataaaataataagtatttcaatgacagctcacacttaaccagactaagtatccaagttttattttagacactcttttaagcttctagttcccacccagctgttcaactatttttaagtatacaaatttctagattgttcacaatataataacctagtggcctgattcaaaatgatgcaagttaaggtgctttgtttttagctttgggttgtctaatatggttatttacatatttttgtcacagggtgatgctggtgcccctggtgaacgtggacctcctggattggcaggggccccaggacttagaggtggagctggtccccctggtcccgaaggaggaaaggtaactccacagcattccattcacctaggtttaaaaaatgcatttgatttccttctgatcatttattatttctcacttattttcagggtgctgctggtcctcctgggccacctggtgctgctggtactcctggtctgcaaggaatgcctggagaaagaggaggtcttggaagtcctggtccaaagggtgacaaggtgttgacttgttttctcttaattgttcaataaatcagtcattgtaggttttaaaaaaagcaacactcctggaaagtaatcgactgtattttcaaaattaatgttatcattttatagtaagtgaaatttaagatggattcctaaagcaacaatgaattagaacacccaatatatatccctacaaatcctgagagttactcctcttcttggctgattttcactgaagatactttgaatctgatgacattggcttttatttgacagggtgaaccaggcggtccaggtgctgatggtgtcccagggaaagatggcccaagggtgagtattcccagtgaggagaagcaggccttatctatatgtcatatgggacagtcctgcacttcaactttaattttttccaaaaactactcaagagaaattagatattttaccacctaaagacccgaatgacttgatttataatgaaatttgtggtctatatctatggctacttgatagatctacagtgactaaagaatgaaaaagcctcaagagtacgataaaggtcacaaactagcatttgtgagtcactaaaatctgagataatcactgaaatttaggataatcaatgctgctcattaagaaactaaaagtcatcaaaattcaatatagtaagtactcctcattaatagacttaatatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatggtgattgcacatttgagtatcttgattgaggtggtagtcaggcacatctacacatgggataaaattctatagagctacatatacacacacataaatgagtgtgtgtatcactggtgaaatctgaacatgctctatggatggtatcaatgtcaatttcctagttttgatattatattatagttgtgtaagatgttaacattaggggacgctgggagaaaagtgcacagaatttccctgtatattcctttgcagcatcctatgaatctataattcaaactaaaagtcaaaaacaaaacaaaaaacatctcctaaatatgattataattaagtcttttaataaatttatataatagttgccttaaagaaattcataaatgcttcgcttttgacagactaagtagataagccgtcattcaggtaaaaagagtgctcaatacttcagttttgtaatataagtaaaactactatttgaaaatttcaagttgaaaaatttaatatgtacaatgagactttgagaaaacatttaaattatcaagcaattgaataaagaaatgtactttaatttaaaaagacattactgtaagatcttacatgacatcctatttatcttctacaatggagataaagataaatgaatcaataaactattgctgaatcctattttctcccagagttatccccaaagaggcttgtgtttactgagctctgcagtatttacacattgagagaaaagcatagcattcaagccataaaaatttttaaaaagtatgttatctagtttattaggtatctatgtctatatactttctgtttgattaatgcaaaaaacgatatttgtatcttcaaaattaaaaaatatttttatttcctctagggtcctactggtcctattggtcctcctggcccagctggccagcctggagataaggtaacccttaatactacctggatataaaaagaaaatgtctctctcttttggatgcaagacagtgacatggcttctctttttccagggtgaaggtggtgcccccggacttccaggtatagctggacctcgtggtagccctgtaagtgttaaagacattctcaacatactttttaaccccatacagacagtagctacttatgcttccctttttggcagttttgccctcagttccctgagcctcaatttggagatattatcttcaaaaaccatataaggaaccatatagcatgcaagggaatgttaaatttcttaaatctaacattcacaggagaccattttaaatcaggatttctttcctaaataactttggaaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcttgcaaataatatcacagtaggaggcagaaggaatcaatggttctggtattttccactcctaattttattgagaagtggcaaagtcttcagaagtttattggctactctgcacatttcctgcttaaaggaaagaaaagataagatgataagatgacatttcctgcctaaaggagatgacgcacacttcactgtgactaaggaggatatttttctcttcagggtgagagaggtgaaactggccctccaggacctgctggtttccctggtgctcctgtaagtgtgaatatttatacatacatgtcccatagcccaggatctctatcttgctgaaaaattacaaaagtatagtcaagtttggtttctagtctcattttagctgctcattccctataggattattgtacccctattttgttttactttacccctattgtcgctctttgaaagatggaaataaaaacacctgtcctgcttttatgactgggtaatgaactaaagcagtatcatggatttaaaagcactctgaatttttgtaaattcttccattataagatggtactaattaaaattttctcttaaatccggtctttctcaaaaaaatttactggtgctgattttcaaatgtttaatccttagagacacttcctccctccctaatggcaaataatgcacagtttatgctttcttggtcatgttctttgatcatgaaaatattttgattggcttcattttgtcatgtcttcagaaagccttgtttttaaattttatttcaactccttccatctgaagaattctatattctgaagagaaataataataagccaattgtatcataaagagtgtcagctgagagattgctgttgttgttgcatgtagggacagaatggtgaacctggtggtaaaggagaaagaggggctccgggtgagaaaggtgaaggaggccctcctggagttgcaggaccccctggaggttctggacctgctgtaagttccttcctctttctctgtctatctatctatcatctatctatctattgattatctgtctatctctccctctctctctccctctcccccctctgtaagtcctaagtgttctaatggaaaaacatggaggtttatcagtaatttaatattttatactgagatagcatgtcatagtgtcaagaatataatctttatatgaatatagtccaagtatgaatctcagcaccagcaatctaaaagttattttaacctcttcatagagttcctggttttcaaaggcttaatgcttttcccaaattttgattttggtgctattcttacataatttccttccatttcatatagggtcctcctggtccccaaggtgtcaaaggtgaacgtggcagtcctggtggacctgtaagtattgatcctcttaactattattgaaaagcattaattgatatcaacctgtataaaagctgcatttgagacactagttccataaagagaatgtaaaaattgtaatcgctcattcatacatgagttatatgtaaattccaaggggaaacacaaaccataaatgactttcaggtacaatgcagatcatgccacacattatactttttgtttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagtaaaaaaagaaagaaaaaatgcactttttattataaatattcaaatttcaaacaattatttgtagggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccagtaagtaacttcatttttttaaattgattctactattttgatttttatcacaaatcgattagagaaaaacactgtcacataaagatgagctaagtcttcattatctgtattagggagctccaggcccacttgggattgctgggatcactggagcacggggtcttgcaggaccaccaggcatgccaggtcctaggggaagccctggccctcagggtgtcaaggtgagtatagtcattttccactacactcttccttcctttggtagccttcagagatcacttaaccatatcaaggatgaaaagtttttctgtcactggagtaaattagccaggagataatttttttttatttttagatttttaaaagcataaattttaataaatggctccagaacacaaaacagggcatatcatagacaaaccttgaatataaacacaaataaattaatatgatgaaaacaatattgccatctcaaacacctcttttaggaaacttgtgaatattcttcaatttgttgactgtcagttttgaagggggaaatagtgttagcttatagatcttggaaagtctttcattaatgctagttatccatccattcaagtcatcttgcactcctgactctctttcactagtattatattcctataacattctagtgcttagcatctaaaacattcgtttggtaaacaggataataaaattgcatttttattagggctcgtattatggcactttaagtacttctttcaacaaaatgttatgtaatattgtcataaaattaatatttcatatttaagtgtgttcaattgatatgatatttctggtaagtgtatattcttcagatagagacaaataacctaattttaaggatcaccatacacctctagtttcatgatggctcattattgtttttccctatactaatcatgtttatgtattcatctcagattacaatgtacagtattctgaattagataatcaatgtaactattcagccctttgccatccagagtcactgagcaagttagaaaatgcaagaagcttgctcccccatattttttcccatagcaggcatagttttaattttaaaattcaatgaagattaaataaaataagttttttacctgaaaataaagatatctgataacaccattttaattgatttcttaagttgaaacaaaatgtttttcattcctttgtatacagggtgaaagtgggaaaccaggagctaacggtctcagtggagaacgtggtccccctggaccccagggtcttcctggtctggctggtacagctggtgaacctggaagagatgtgagtagcagtttttattcaaccagccaggtagaatttgataatttatttcagcaaaggtgaaattgagctttaatgtctaagagtgtaaatatggccacatagcaaagttcttctatctctaataacagaaattctttcattacaatttaggatagacttaaaagctcttgttcattagtatttacccaatgaataatcatttgtggagaaaatattatctctaactaaattaggaaaaaagttagtggggagaaccacaattgacatgttttctgagtgaaaatattctacggttatctatggttagtcttttattatttttaaagaatttaaaattaatattatttataattaacaaatcataattgtatacatttataaggtacaatgtgatgttttaatatatgtatacaatgtggaatgattaaagcaaactaattaaactgtagatttccactaacagtttagatcactatttcttaaacttttatttattagaggtctgtaaagactctttttggatatcatttttctaatcacctctcctccatgaatacactaactatctgtctggacattgtgaccctttgaagggccacactgctttgtaatatctaagatttcttacccccaagaaccaattttaacccccttgagaattatattgccctgctgagaatgcatggatgaaatggcatttggaaggtttcaagaaattttatttcctttctcattttttaatcagggaaaccctggatcagatggtcttccaggccgagatggatctcctggtggcaaggtataataaacacatgtgcaattgatttgtgttatcaaaataagtgatcatcatgtttattttgtacctatgaatttgttcacagggtgatcgtggtgaaaatggctctcctggtgcccctggcgctcctggtcatccaggcccacctggtcctgtcggtccagctggaaagagtggtgacagaggagaaagtgtgagttcccaaaagcagcatctgtcttgtttgtctatttccttcaataaagacatttgtaggtagaaggtagaatgtcagatctgccaaccaaaatatccactgtcatttgttttacagttttaatgctagttgttccttagacaaatgtgtgaataagtcaataccagaagtacttggcagtagtcaataaagaattcattactgaaacccgaaatcatattaatcagaccaactatctatatgctgggtaaatgcaaggccaagttaacagggctcttgcccaacttttctgtctagatcccctgagaaagctataaacagggctttagcactttgaaggcaaaaacaatattaacttccaataattgcatgcatactataattctattataatgaaattatttacttttgaaaacgaaattgtgtcaacacataaaactagttccgtgtatgtcttctcaattgaatgttttcatcttagggccctgctggccctgctggtgctcccggtcctgctggttcccgaggtgctcctgtaagttttgtcattttttggttttattttgttttgttctttttttaactcattctacagtgtaggaaatattttattttccagcgtgttcaggaaaaaagaatgaatatatatatatatatatatatatatatatatatatatatatatttgttctatctatagatagatgatagatagatagatagatagatagatagatagatagatagatagatagaacaaatataaactttcctttaatgacaatgatatggaaagcagttcaggatctaaaagttctttggagccaaggatagaaacatcagttgttagggatccatgcaatgatcagtccaaaatgaaaacaaccacagaaacaaatctcatttcctatctgaagtgtctgttgatgggggattttttagctgatagaaagccataaaatagatttaattattataaattctattttatttttccaatatgtatgtgtgtatatgacttcaattcaaaatatgtttctaaagggtcctcaaggcccacgtggtgacaaaggtgaaacaggtgaacgtggagctgctggcatcaaaggacatcgaggattccctggtaatccaggtgccccaggttctccagtaagtgcattcattttgttggaaaatcccttcaatgtatacaaattttagagattaagagaagaaagctttccatctctaaaaatatgtactagaagagatgagaaatggatttgaaggctaatttgaaacaacaatcagcatgacacaatgggaagattaaagaaagaaaaaaaatttcatcatgatccccatgtttcttgatctgatcttgaatgtacagtttcccagtgctttttaaggccttcactcctatgtacacttcctttctttccagggccctgctggtcagcagggtgcaatcggcagtccaggacctgcaggccccagagtaagtagcacagaaagatattacaggtccacatgtttcagatgtctgcatttcagaaagatattctggcattgtgatgtcatgatactttcttagggacctgttggacccagtggacctcctggcaaagatggaaccagtggacatccaggtcccattggaccaccagggcctcgaggtaacagaggtgaaagaggatctgaggtaagacatcacttatacgtatgtgtatttaatttgctacaatcttccaattttcagaaacacagcgcattatgtttaaattgaaatagagagacgcaatgcatccactcaatttagaaactgaacaatgactttaagacattctccatcacattaaaaatgtttctaccacactataacaggagaaaaatacctttttaaaaatttgatcaggtatccatcgtatcagaataatgacatctgcccaattaaccaaataaaccctgtccacattgctatcccactagagatctcagaattacaacattcataattatctgcgtttatgtagtgcattttacttctcaaacagcttccatggttactattttgttaatgatactatcattcctaatactttctattccatgcctttgggtaaatgaaataaaaacaattatcccaacaaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctcaatgatccatgttttactcattctagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggtatgtttggtagtctttcatcttcatggcaataggattacagagaaagctgcttagattagaatgggaacgaaaaaacatctactttcaatggaaagctgaaatagtactttaagaaagttaactgaattgaaactgcttgatataaaagagtaaactttgcagatgtaaaatataacataacttcagatcatgccaaatacagaaaaatataaagacatttttgtagaagttgtagtataaattgtaagttatttgagtataaagtaacatatctttttttctcaggattaaatatacataatttgatgcagacaattataatctgattattgtaatatttacttattgcaatgaatctaattattaaaattttcaaattaaacaagtgaaaaatttcagaatactgtataaaattaaatagaatattgtaatagtttaaggttttgcatatattgggttaaatatttctgaaaagcaaaattatttcaagttttcaaatatcttgacatggaacactgcctttgctaggagtcatttctagaaattacttaaaataggagacaagcatcaatcatagggatttcagctttagaactattggaacaaatctaggttagacaaccagcttatattattaagcaagattacatataataatcatctttttttaaaggagagacttttgcaaatattatacagcaatcaaaaggtcttagcttagtgtatcatccttattagaaaccaagatgttgcattttatttcagtgctttctgtagtcatagctaactcttttacctcagcaatttcaatcaaaaagcttctctatcattctatacataaaatgcagacacattagcagtcaacattatgaatgcctttacaggtaaacaaacaaaatcactttattactggattttataaccaattcccattcttttttgtgactattcaggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattctcctgttttttgtcacttttcaaagatttaaaaaatgcacgtctacattaaggaactccagtaatcttgaaaaagtatattgaattctaactctatagattaataatgcaataatttttaagaatataaaataatataacatatattcagagtagagataatgctcaatgaggaatcctgcagatttttagatcatatttgcaggaacccctgtgggacatactggacactgagggcattctgtttgaaagggtcaatccttggaaatggtaacacagtaaatcaaggtattcccaaactgggaataataagggaggaagatgttgatagtttatcagaaagtaattgtaatacgggtctattgaaatatattaatattaagaaaaattgacaagtaccacatgatctcacttctatgtggaatctaaaagagttgaattcattgatgaagaatagaatggtggtttccaagggcagaaggtggggtggggttgggagattttagtctatggatacaaaattgcagtaagatagaagttataagctcaagagatctattgtgaaacgtggtgaccacagtcaataacaatgtattatatttttgaaaattgcgaagagagtaagtattctcaccacaagaaatgatgagaacctgagatactgcatatatatgcatatgtatctctgtcttcctacatatacatatatatacacatacatatatgtatacacacacacacaaatatatatatatatatatatatatatatatatatatgtatagagagagagagacagaactcaaatcaatagtatgaattaataaattagatacttggagttttattttagaccaagaaagatatctggaacacaatgttctgcctcctgtatttgtaacttaatgtatcacagagagtagttcatttcattatatatagctctaacttattgtgtgttattgatcccaatactcagtttaatgaacacacgagttaaaattacttgtttgcctatttgtttatttatttgctaccaagtatctaaagccctatctcattgcagggaagttacagttagatgagtcttggttgaggttagaggccatagacagttgctttcctaacctgtcttgagttagggtgtaggcaagtggccatgtgacctgagcttggcaaatcagagacacacacctgaaggtctcaatctggggataattgtattcacttcatattactgctgtagcaagttaccataaatttagtgacttaaaaccacacagatttcttgtcttacacttctgaacatcaaaagtctaaactgagtcttactggactcaaatgcaagtgtcaaacaaggttgtcttcctttctagagacactagggagaaactgtgtgttcccttttccagcttctagaggctgcccagcttccttggttcatgagccagttccaacatcaaagccagaaatatttggtcaagtctttctcacgttgtctcattctgacattggctcttctgtcttcctatttcacttttaaggaaccaaatgattgcactgggcccaaatggatactccaagctactctccccatttcaaggtcagttggtaagcaaccttaatgcctgctgcaaccttaattgctccttgccttgccaaaaaatgtaatatatttactggctctggggattagggtatgaacatatttgagggagcattattccacctaccaacaatagtgatgcaaagaagtaaaaagaattaaaaatccagtttggtggtgatcacagctatagttggggcagcaaccgccagatatcaaaagaagcatggccaacagtgccagaaatggcatccagtgtcttgtgtttatgatggctttgccaggttgcttttagggtatgattttgaagatggctctgaatgtcagcattcacttcattttttgttgattttatgcacctggattctatagctttctctgaattcctctgaatttcagataaaaatccataaattacatttttacttcagtgagctaaagttggtttagattgtttacaactaagcctgactaggccagcaattggtaacagcagggctggcaggaagcagaaatgcaagcaaatggaaagactctgagatcaaatgtttgtactagttaggggtaaaaatagaaaatccagcttgtatccgggaatgagaatttggaagtccatggaaataggattaatcatttatgattacattgagtgatttgcactttaaagacaaggcttaaggagataagtggcctctactacacaacagtatgtttgaatttcatgagaaattgcaggactgcatgtgaatgtggctgctgtgaatggtgatgaacagaaagagaatgacaagttcaaatccctaacttcttgatttaagacacagaagaaaatctatgccctttccctgactatgctaaaataaaagcatactatctttctggaaaaaaagaaaaaaaattcatatttttgccaaaggtttgagatactaaaaaccaaatacaaatcttaattctgcagatcaccagacttcaacataaatctaaatggattttccaattctctatttgattctctataattgggaaacagcaagaccctggaaatttaaatggggtttatggaagaattctctttaaacattccagtttcacattaagtttctttagacatctgaaatgggatctgcattccttgcctggtaattgttcccccattctgaaaatgcaagctgactacaagaaaaagccaattctcttcagacctcattctcaccactgcttattgtctccagatttgtaactgaagtcagatcccagaatgcctcagggggtagcaatttaaaggtcaatctcaggaggaggtttacacataaaaagaatggaaggatttaactaatttatattgtttaaaatctgagaaacgtgtgtaggagtggattttgagatactagacaaaaaagaacagtgaaatttggataaaatgtatcaatatatgaatgtaacaaagagttataggaacattataattattaacatggttgaactgaactcaggcctcagaggttgcccaaactgaatgaatttgagacattacaaactttctgacaggtggagaatgtaattcagaaacttaagaagatagaaatattggaatgaatttatcatatgtgatacaaccattcaccttctgagtatattctcaaggtggaccagtacggttttgagaaacacgtggtggcctgcatgccggcacctttgaataatctccttgtgtgtctgtagtctgaagaaggaagtagaaaaaaatctagctgaaataggcttcttgattcaatggagatgacaggatccgagcttgcagaggacaaagggcaactctagactgccggaaacaaagtgagaatgatattgtacaagatagcaggactgtcatggtagaaaaaataaaatggcataattcagaagtaatgttgtcggtggctgattgataatgagaatgatgagatgtctgggacagtcacatttatgtcttttataaacaataatgacaaatatatttagttcaggtaaaagagacctcagatcagcaaccacacaggcctcaagactttcttcaattcccagactataagatggttaataaacctagtctccttaaaggaagcataagttcagtgctttggaggaaatctcctgcaatagaatcacaactgataagcacttaccatgggccaagcattgttctagtcactttaaacttattaatttgtgtattactcacttgtggcatctcatctatttccataatgctagtcatcaattaaattaaagataattcacaaattgacttctggctttgtggaactaaagacccatatattctatggactaattgaaattcccatcaaagttttgaatatctgtaatgtagcaagtaatataaagcttttaaagagatcattccaggaagagagaagagcaatagcatgaggagaggaatgttctggatgtgtccaaggaaaaacaaagtgaatatggttgtgacaaaatcagtatctgggggaggagtacaagagaaagccataggaaaagaggagacaaatcatgtggagacctataagaagggtgaccataggtgcagctttgccttggaaagtaatagtttatgcctatgttcccaatgtctaataagatttagtattgtagaactcagaaatatcctgatcggatgacattatatggtcaccctaattttatctggccactgaggatattggctgttgcctcagttagatgagaagccactgtgataatggatgacacaatctggcttgcagttttagagtatttctgtgactgctgtttagagacgactgactgtgtgttaagagcagaaaccatgagaacagtcatgagtccattgcaatagtctaagccaaggatgacagtcgtctccaccagggtggtaatagtagaagagatgaaaagtagtcatgttctggatacattttgaatacagagccaacaggaactgctgacaatttggatgtatggtttaagagaaagagagatatcaagcatgaatccaaggcttttggtccaagtagctggaagaatagagttgcagctaagatggggaagactaaggtaaaaaatttgaggaactcagtactttgaagctgggcatgttacattttggatgcttatcgctcttttaagcagacttgctggaaatcagaggagaggtccaggctagagaaataaatttaagagtttcagcgtatggcttttacatcctcagaaatagaagagatcaggccaggcatggtggcttatgcctgtaattccagcactttgggaggccaaggtgagaggatcacctgaggccaggagttcgagaccagcctgaccaacatggtgaaacctcgtttctactaaaaatacaaaaaattagccacagtggcacgcgcctgtaatctcagccacttgggaggctgaggcaagagaatcacttgaacccaagaggtggagtttgcagtgagccgggatcatgccattgcatccagcttgggcaacaagagcaaaattacgcctcaaaaaaaaaaaaaaaggaagaaaagtagagaagatcatgaaataatagagtgtagaaagaagaaaatatgaatgcctgggatactttaatattcacaaattggagaactgaagaggaagcaacaaaggagagagagaaagaatgaaaggaaaccatgaaagtgtagtgacttaggtgccaggtgaaaaagtttaaatttcagaattgtggcattaagggaagaaatgaatttagagtcaatgtattccaagaccactaattatagatttttaaaagcaaggtcaattgcggttatatgagtttttctgtctataaatggcagatagtgatgcaatgcaatcctttatatcatagttacgttatctcgttattatctctttcatgatggaggattaaatacaactttcttcaccctcaaactgacattttaacaaagattattttacttccttgactaaaataaaatgtattttataaagattgaggatgaagttaatgcagccattataacataattagaacatgcaggaaactaagaagaaaaatagagtatacgtgttccagatcagtggctatttccttcaagtcttctaagcatattctaacataattgggataatactatttatgcaatattgtatgctgcttattttacttaacataatattactttatccataaaaatgtatttttaaatttttggtcaaattaggagaaatatagaggaaactgttcttacaggatgatggctccaaagttagaaatcacatcaaagggaactttcttttatctagtgtatactaaaatcctatttttctgggttctgtcttagaggaatatgcctatttttaaaagtgagtctgaaactatgaaaaaatattttcttttcatacataattcttcactgagtcataactcactaagctagcttgatacagtattggtgaaaacattctgtacaacacagcatacttgaaagatctccccaaatctccatattctctagtctgccccattgaaggttttcagaaatcttgcaaataatcacttgttgagtcaatgccataaacaaaaagactatcatctatggctaacattttttattaaacaagtttttatctgatattttgctcatcctttttcttttcattgctttaatcttcctgaaaaacatctttacctttaaaactcctgaatgttttcactaaaatgcattgaattactttgcatttttggacaatatctgctatgatatttattaacagaaatcaggttgccctttgaggtccataaaatttagaaataggagttatgatatttcacgccagtttagtgattttgtgggatatactttccattatctttaaaatgagataccccataatggagtaggaaaagaagcaaaagttaagctctgtctttggttgagttccctgaaaacagactgtaaggcagctaatgatgagcagaagatttactggggagtcatcttgggagatacatctgtaaggaaatgagaaacgtaggtttagacagagggggaagctgaccccatgcaattgatggaggtttcaggggactctgcaggaaactctggaactgaggtggcccttcagagttgctataattcacagtaagagggatgggtctttttattcctgaatcagacagtcattgactgtgggctgaaatttggaaggggtggaggttacatttgtaaagcagtcttcgtgactgagggcaattctatgtgagagacactgctgtgaactctcagtaacaactattttcagtggctgctatcagctgctatcaatgttttggctttgaaaagggcatacatgtggattaccaaattataagctcctcctatatgttcagtactcttctaaacactatagggaaatatatcacatgattgtccgtctttaggtgtgtgttgtctagggtagataggttgaacccaaatgaagttgcacaaaagcattcaagacaagcaattaagtgctaaattgtgctgagctaactataagagataaagatagtagatgagaaaaataattggtcaatgatgattatattttcaggactgtcttctttaaaaagataaaatgtattgtacaataaaaaagagtgttatttgagtaaacattggagaaaaggaaaaccactttggactaataaacaaaagaagagaacaaatagaagaatgattatcctatgtccatagcacagtgaagaacccaggctacctaaatccattcattttaattcagccacagtattgagcaattactaaatgcaaggctcagaaccaagtgcccaagattattcaaggagaaaaagagatcatgaaatttagtaaaagtacgatgacacaagcatgtcacaagacttaacataataatttgaattagagaaatacaaggtactagtgatggcagcagctgtagccatcatgcaggctgcagcaaggaggcacagggaggcacagctggggctgcacactccatggagctggtgggaaccctgacccttctgagttggtgcaggagctccccaggtgccactgcagctgcccaaactgcagctgcagacccaggtctcccactctgtggagcaggcaggagccctgccctcctgggtgggagtatagtcaccaaagctgtggctgtggatctgagcctccctgtgctcttcgagggggcatgagcttctcaggtgcagctgcagctgccctcccaggcccaggacctggacatctctgtagcctgcatacttgaggtcccgggaagttccccatcgctcatccccgtaggcttgagggtatctgctctggctgcttggcctctgtcctctgctgccgcagctctgatctcaccccgggttgcagctgagccctggggtcatgaataacagtgggacacagagtcctgggcagaagttggtgggtccctggtaaggccccaccttcaggctagagagggcctaaaggttacgggccaggctgcctgtcccatggaccagagtggggacttgtggtgcctctcccaggccacccatggccatccatgaccaatcggcaggcacttcctcccctgtgaggtccataaaagccctgggctcagccagagcagggcacaggatggagaggacagagagaaaacaggacaaccaactgcagagaggaactacccccctctgctgagaacttcagagacctgcagagacgtctgaatgatctgcagagagaagctaccctctccagggcttcttctctgcagagaactgaacactccacagatgacttgcctgcggagagaagttacccaccgtgggtctcatctgagctgctgtaatgctcaataaagctcatcttcgtcttgttcacacttcacttgtctgtgtacctcgttcttcctggatgcacaacaagaactcaggccgaggcaccatggccacaggggtttccagccagaaaattgacaccccgaagatcccgtaacatgagaatggcacaaggaatgaacagtcatgtccacttggaggctctcaagacaggctacatgaagcagatgacatgtgggaccaactttaaataatataatgtttttcaggtagcaagagaaaggaagaccacagaaaatactgtaaggaaagaggtgcagagttgggaggcatacttggcaatttaaattatcccagtttcagagggagcatgggtgtcaagcagtggtgttgtgagagacgaggctggaaatacagtctagacatgaggccttagaatagcaaggtgatgactttttattttgtctgcttctcaatctagagtcataaaaaggtattaaatattgaaaggctgttgcttgaggagagcacaaaatcaagggaaacatggggagccatggccagatttacaggcaatgaagagatacccattgtgggaagaaggaggcagattggatctccattttaggaaagatgaggatgagacaaaacaattttagcagggaatcagaacaccttttcttcaaagactagactgaagaaagagtcacagagtgtagacatacttgctgggaaaattaggttaaggagggaaatggggtcaggctgaaggagaatatcaatagtcaggcaagagacgtttccatttaataaggactgagtggaaatttacacaacctcaggcttactcgcagctttctacgtggcagttaaacgtggcagtgattcatttggaagggtggttgaacatgataaaatgtgtgactgattggagaatactaggtcagaggcagctaagtctatttggaaattatccttctgcagatggtggatgaaatcatctggctccaagatgaaatcatcagggagcaaaacttccaaaggaaaggggaaaagaacagcatggtgtgtacgtggtgagaaggaggatgtggaggaaacgtcaccaagggtctgattcgggatactgtagcttttaatcgtttttgaaaaggaggattcaattttgagggctcaggttgtgattaattcagggctatgaggagagagaggaaactgaacagaaggagggcttcattagtgctattgataaaaatgctttgggactgattttcaaattttgtcttgaatttaaaccacctggagactgtcctcagcagagtcagcaaaagcacagctttgaaagaggcgatcactttctgtaagaacccaacaaagcacagcattatgcaaggaaacgtcaaatgtctctgggaggggcttgtactttagcttcctttgagtctttagggctacaattctgactacagatgttttcaatttatgttgtttttttttttttctcattaaattggctaacaattgtgatcattctgtatctccagccgcctttcattataggatctctcataacagtttcaactgctgggaaaattgttcacattaccagtacagttctacctttctctatttattaccacttgaatctgcatttgtacttcacatatatgcagacaaattttctgccatatcaatggcatttaaccataactgcttatatgcatatgcttttggtatgcactctttaaaatgaggtgaatcatattctttgattaaaattaaatgcatctgtgaggtgaaggcaggaagatcacttgaggccaggagtttgagatcagcctggccaacatggtgaaaccctgtctctactaaaaatacaaaaattagctgggcatggtggtgcacacctgtaatcccagctactcaggaggctgacacaggagacttacttgaacccaggacccagaggtggcagtgaggcaagatcacaccactgctgtttaacctgggcaacagagcaagactctgtctcaaaagaagatatacaaatgaccgagaaacataggaaaaaatgctcaccatcactaatgattaaagaaatgcaaatcaaaaccacaatgcaataccatctaactcatgcaagaaatggccataatcaaaaaatcaaaaaataatagatgttggcgtggacatgatcaggaacacttctacactgctggagggaatgtaaactagtacaaccactggtggaatacagtgtggagattccttaaaggactaaaagtagaattaccatttgattcaccaatcccactacttggtatctacctagaggaaaagaagtcattacaccaaatagatacttacatgcgcatgtttatagtggcacaatttgcaattacaaaaatgtggaaacaacccaaatgcccatcaatcaacacagtttctttattcactcgttgatatatatatatatatatatatatatatatatatatatatatatgagatatatatatgatggaatactactcagctataaaaaggaatgaattaatggcattcacagcaatgtggatgagttggagactattattctaagagaagtaactcatgaatggaaaaccacacattgtatgttcttactcataagtgagagctaagctatgaggatgcaaaggcatagcaatgacacagtggacgttggggaatcgggggaaagagtggaaagggagtgagctataaaagactacaaattgggtgcagtgtatactgctcgggtgctgggtgcaccaaaatctcagcaatcaccactaaagaagttactcatgtaactaaacaccatctgttccccaataacctatggaaatacaaaatttaaaaaaaaaagaaaaagaaaatcaaaataaatgcaatcttcagggcattttttatcctgtaagatagtcacatatgaacgaaatatcatttgaggtttttgttgatagcatcaaaataaaatccagcagagaattatgagcaaatttttataggattttgctaaatttttacagttttatctctagagctccttattatgtctcactaatgcttttgtctagttcaattttcaaatagaattttcattttctttcatatttcattctgttggttttattgagtttagtcattaaagtataaaaatgagaataagagatgcattatagcattagacatggcttcaagctctcttttctgacttcacagttacctctaacatccgaggtttagaattctatgactaaaaagtaatattcctataatatatattcctccttcactcttttcctcttgaacatcagcattctccagtcgtctgttccgggctcactagtctccacttttgtgaatgattgcactcacactgaaatctcaaacaattactggatgtgatggctcatctatccttatgtataaccctgtctatctcaagctagatgccccatggacatagaacacatgtcctcaaggctgccccctttgctagtccccatctcagtacatgccagcaccttccttccagctacctaagccagaaatttggaaataatcttaaaatcttggttcctcatcctcactctttcatcagattgcgttgatgctttttcttaaatatctctcaaatcatctctctccatgtgcagtgacatgaactgctctttcctgctttttttatacattgttcgactaatctttctcttttcagtcttactcacattaaaaattcttccttcagtattgctgccaaggtgatctttctaacatgcaaatcacaacgtgtcttacttgccaaaacacttcaatattttgcagtgaaacttctattggtattttgggtggttcagattttgttctaagggattggcctacatacaagaatttcaacatcctgggctcatctacaaaatgcctaaaatattccccaatctttattacaaccactaacacccccctcacacatttccaagggtactctagagggtatggttacacacccagctaagaaccacagatactttccttaaaacaccttcaaaataattttcaatctctttatttctacacacaagtccctttatgaaacctcaacctgcttctctaacttcatctcccactaaccccttgtgtgcaatctattacagaaactgcccactaggggctccccaggcaagaccatgacttttaggaactccatgccttgatctatgttgttctttgtgtcttaccttccctcactgctcaagacgctgtctttaaccctcaagacactgtctttctttaaccctcaagactcattaagaaagagtgtattccagctactcttccttgcttcctctcctctccaaattccagcctagcttgaatttggctaggtcccatgcttcccatgtacaaacctaattaacattagttatcaccatgtatttattcagcttagttggtatgttggtctgttttacccactaaatagtataaacagcatataaagcatggagtgatttcctgtaccatgtgctgggtaataattttacattccaaagcaaaaataccagtatctgacatgaaatccacatgaaaagcatgtacccacaatagattcttagtctgtagtgtaaataatctggcaccattgtgaaattgtttttgtcatgttaatttttaagttctattctcttatatttattatatttacatttctggagctgttttgtcttttgttgttttttgttttacaaataatgttttaagttacttgtcatcaggtaaaatcaacagcccagaggacatcctagtgtgtactactctatcctcaacctctggctcacttttgggcctactaccttctcacatttatgggaactgtgaataaaccaattagagaaaatgactttaactattctttccactttccaggggaaaaaacagggggaaaaagtgtatgtgactgtttttctgcatcttctttgacacttaatagtatcaggtattttaatgtttgtccaattctgatagaattcaatatcttattgtttctgttgcatttttatttctaatgatattaaatatcttccacatttatcagtttttatattgtggcttttgtaaattacctgtataggactatgcatattttggaggtttttacagaaactgtattaaaccatttctgtaatatatattacataaattttcccaatttgaacatgctttgaagcatactactgacagttttataatatagttttctttttttttatggtaggatctcactgtcttgccagggctagccttgaactcctggactcaagtgatcctcccacctcagactactgaacagctgggacaacaagtgattagcattgtgcctggttataatacagatttaagatgtattatagaatctgatctttcatcattttattatttatatatttttttcatttccattccaggattattcaactactcaataatttttatgcaaacatatttagaggttttaaaaactgaacaacctgctcctgaatgactactgggtgcataacgaaatgaaggcagaaataaagatgttctttgaaaccaacgagaacaaagacacaacataccagaatctctgggacgcattcaaagcagtgtgtagagggaaatttataccactaaatgcccacaagagaaagcaggaaagatccaaaattgacaccctaacatcacaattaaaagaactagaaaagcaagagcaaacacgttcaaaagctagcagaaggcaagaaataactaaaatcagagcagaactcaaggaaatagagacacaaaaaacccttcaaaaaattaatgagtccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctcttaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacacaaatcaataaatgtagtccagcatataaacagagccaaagacaaaaaccacatgattatctcaatagatgcagaaaaaacctttgacaaaactcaacaacccttcatgctaaaaactctccataaattaggtattgatgggacgtatttcaaaataataagagctatctatgacaaacccacagccaatatcatactgaatgggcaaaaactggaagcattccctttgaaaactggcacaagacagggatgccctctctcaccacacctattcaacatagtgttggaagttctggccagggcaattaggcaggagaaggaaataaggggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccatcaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatacctacaactgtctgatctttgacaaacctgagaaaagcaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcatcatcactgccatcagagaaatgcaaatcaaaaccactatgagataccatctcacaccagttagaatggcaatcattaaaaagtcaggaaacaacaggtgctggagaggatgtggagaaataggaacactttaacactgttggtgggactataaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgtggtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaataaaaaaaaaaataaaaataaaaattaaattagttcatttgggaactgttttggtataagaattaaagaaagaaacatgctttcaaatgataaatagttataaatttactttaatagcatttactggaaaaatgggaatttttttctatattaattataatacaggtacatagattcatttctaaatattttttgttccctatgactggtagctttttattatttttaaatatttacttgggccagggcccacctttattcaccacttctgttttggaggggattttctaatcacttttctagcaaattttttattccaatgagctttagaatagttttgtcaagttttctgtttttatgatcttatagggattttcagtgggagtatttattaatttaggaaaaaaattacatttttcaaatattgagcttccctatgttaaggtaggtttagccctaattttaatttacatgtctcagtcaagtgttatggattttttcaatcacgttctgtaaatttcttgtcacgtttaggtatacgttgtatgttgctattgttactggataataatcccttcttcaattgtgtttctgtccagtagtactaatagaaacagtaacataatataatggtaataatgatgtatgcttcacactagtacagaaatcaagtatgattactctctgaatgtatttttccagttacacatagtatacaatttttcatcattcaatgaatgtatgttgagcatgcacaaatactaagaaaatttttagatcctgtgtaaacaatccatgcctttgtaacaaatacaattaatagaaaagactgacacctaccaaataatcacaccctttataaaacattctaatttgtgctataaatataaatatttataagaagaaatacagcgtgccaagaaaatttaacagggactatcttacctgagttgtggtgaggagtgaggagcctagtaaagattttgtgaggatgaggcattgagaagagttctgaaaggtaaatacaagtaaactgggcaaagagaatacacatacaaatggttttcagcaggacagggaatctagaagcttttagaaaatggacaaaatcccatgtgagtggagcacagagtaacggagatagtggtgtaaggaagcctgggaagaaggcaggagtcaggtcatgccagtacctcatagtttgaagatttttgtctttatcctagaagttaccactgaagctttttataataagatgagtgcgtgtgtgttgtgttagctagggtggcgggggggagtgggaggtgacatattcagatttttatttcaaattgatttctctggctgtagtgagaagaatggatcagaagagggaaagagtgcatgcctgaaaacctgtcagaggctattgaaaaagctcaggcgagacataatattcatgtggacaaggataacggcagtggagatcaagagaaggatatgaccttagggaatatttagggggcagaattagaaatatttaagaaggacagtactctggcatggtctgagagagagagagagaggtgacaaaaatgactctcgggtttctggcctgcctaaatggatggataatgacgctgctgtctttttttaaatttctgttaattttgagaattttcatttgtattttttaaataaatcaacaataaatgtatgccaccatcctccccaaatgtagattatttcactttttatagtgtagaatttgaggtgtctatgggacatgaaagtaaagaaatccactgacaggtctaatatataggcaagaaatttgagagctttggaatggtctgggcaggcttttattggtagcattcccaaaatccaaataagaactgttatttctatagttggaaattgttagtgtttgtgacttaatagtattaccacatatttctgattcatctatatgaacttatataatcttatagtttggacttggaagtcaaacaaaactcacacatgtatttaggcatataaatactcaaatttaagatatacaggtcaaaatataaccagtttaggggaaaatgatgttgtaaactaaatattgagaatgaaactgaaaacaattaggctaaattcatatgtgatacactttgagacatatgttttattattacagtttattcagtcatgaaaaatctattgcttgccctttttatcaataatactactctgacatttttaagggcagaggcagtgataattggtgtcatgttgcctttgtgggtaatgttgtagatagattttcatttataagccagtacatacatgatagaaggtatccgttgtatcttttaaacaaatggcaaacaaagtataccaccacatctccttttcactattggaaatgaaatagatctaatatggtcaaaggaatttcacaaaacaaaaaccactgacatgacaaaagcgtgcatttaatttgatgctttgcagagatacatgaccaaagttgtatgcatggcttgtcttttgggatggtcccagctgtttattttaaaagaaaaaaattaaaatagagccaacaaatgcaattaagaaaaaaaaagtattgagacacaaggggacctacatgttctggtctaagaagcatgcaagtattacaaagcattccagatacagtatgacagaggaacagtgaacaagcattggaacgatgctctttctttcagaaacgggaagtctaacagttatgttttcacaatggtagtgattaaaccatctttatttttaaggaattttataggaagaattttagcaccatcattaaaggaaaaataataatacctttttagccctgcctatctccagtcttggaataataacagaagcatagcacctttcagtatctaaaatataaacaagaatagtaagtccatcccagcttctagagatgaggtagctcatgctaagaaatgttgggtcatttttcctatgaaagttcaaaggccaaatggtctaattccaatcatcacatttgattagagtcagctccacaactcagtttctagatctttttcttcattataggcttcaggatgatgagattgtacatgtggaagagtctcaatttagagtccttggacatatgtttgtaaagttctatatgtcaattattttgcattcaatatcttcttaaataagaaagtgtaaatgtattaaatggtatatactagtgtgacttctatcaatattgatagattgatcaagaggagaaagatatctttaaatttgaatgagaaagatgtctaaacttatagtcttttacaaaaatttaagaagtcgaagtaaattcactttgttctccaaaatgccactgaatatatactatttaaaaattctatttaagacagtgagaaacgtttttttttttttaagattctccttaaagagtctctattatagttacacaatatcaagacatgcatgtaggtctcgatcacaagttaaacattttaaactcatttttaattgacaatcttggaatgagaggtcacaaaagggcactaatttctatttttcaactgcagccaagcaaaataaacatgtgttgtggctctatataccccactctttaagctacctgccaggaagaagaatttcctcataaatactaagcaactttttcattacactgaaataaattgaagaaaacggagatttatttattcaatcagtttactttctgcaaaggtggtcattgtcattggtcatcttaaacctaaactgttgtattgaaaaatatttaaaatcaattaaaacttgaggattgtaagtaaaataaatattctgaaggataaggaggccaggcacttaagaccatatatacaatgctgatgcaggatcagccattacttcaagagtctcaggatcaacttcaaacagtcaaagttcttgtgaatggcggtggtcattgatggtggtgctcattgtcgatgtgtcttggcttactttacacaaaacaaactggcccaatttcaacgccgaattcctggtctgtgccgccaacatccacaggagcaagatctatgatgggcaagcgtgccacattctgtgttctatattcaaagacagtcttgcccacatttccattccgcttctgaaattaaatgatgcaatgggttaaatgtacatacaattttttccaagtatgttagacagcaaccttcccagacacttttataatgtaaaggcaatgatttttagagtactacttaaaaaaaaggaatgaaaacataaagtgaaatattagtgtacttatgtaacagaatttctttcatgctttaagtaaatttcctttgttcttctgcagcttcccaaatggtcactagcaacataaattatgaaagcttttttgtttttcacaaatgaaactataattcaccatttagtattattttcgttttatatctcaatatgcaagcggggagacttacttacaaattggtggaaaaaataaagtatcttggattaattacgcattttagaaataaggaattttaagcatgggactgagattcagtaagttaaataacttggaaaagaaccaaagaaagtctgcagaagaactggatcagatcttagggatccagttctttctttactatatggattcaaacctctatcatgcttcatgtgctaacacacacacatttaccctaaggaatgactataaacaaactgctattatgctcatatacaaggtaaaattgcccccagttctagtgctgtaatagtatttttaacaaaaataattttttttcctcaaccagatcaatgtagatcaaaaagtacttacagagcaagtgtcttgaagaacgatataccggaatctaatatttccctctgctttgatatctaagtcatttgcccctttgagaaccacagcttttttgaggttcttagcttgatcgtccatgtatcctacactgtttttacagatgtaagtgatgttctgggaggcttcttttgataaaaggcgcaaaaaagtcatctgagtaatggctgtattaggtgattggtggtctccataagcgaactagaaaaacaaagagtctttgtcatacacaagactgaagggtttcataatgccttacacatgtatagataaatatataaattgatttcagataaatcaattttgaagagtattactttaattcttgtcataaagtaagctattctagctgtacatctaaacatatcttaaaatgtctatgaatactcaaaagaacctctgtccttattaacccaaagggtaatgaaaccaataataacaataattcacgagaacaagcataagtatttttaaatctgcttcactcatgtatcaaaaataactcatttttattgctaattataataaaaattagaattaactagtagtataaaatcttttgaccccaactattacacaattgtaggaaatacatattaaaagttttccatgtgctaacaaaaataatcaaaaaaatttttctagagactctttcctactcaccttctactttagctttggtttcagcactcccatttgggggttttattttacatattatattagctaaattatatttcaactatttatatttaaaatttaaaattttgtgctcattaaataatgacagatactagcttatcttgtatacacccataatgttctcataatgtttattctgaacgtgatttctaggaaaaggtcagaagcagaagtgagaagaaaatttcaattaggctgccataaagagatgcagaatgaaatattcacattgcaacaggcagtggaaaggccagacagttgtctgaacaccagaccatgatagaaacagggtagactgggactcagaaaaatatcaattgacttcataacattacaaaaatgccttaagtttaaataatattaaaaattttacaaaatgattcaattatttagacattattatagtagttatctaatattaatttaccatctatcccatagtacaagagaccctaaactaagaattttatatccacatggaaactatggaataaatattatcacccttactttaaactggcaaaactgagtctccaaaaagttcagagactttataaggccccaaagtcagtacaagatccccgtgaggtaaccaggtctgctgaagctgaatatacagaaataactgtttatcaactatggcactatagtttatcacttctggtacactccatagtccatgtcacatacattagaggaacttacagtaaaaataattacttttctatatttcatccatgagaaaatttttaattcaaaatttatgttaacttcactcatagcaaaaccttgtttatgcaatggtattacaattgtaactaatgagactatatcacttcaaaataaacatggtaaaataagcctggtttaaaaaaatagcaaagtcctaaataaatcaaaaatatgtaataagtagtaaaaagtaaagaatacaattttaagtaaacatattaaattacctgagaccctctgttcatatcaagaccataccaaacaggtttattgtcaggagatttactggcccaccaggttttacgtggtacactggatgggtttgctgaaatacatgtttctcctgtttccatgttgcagtaaactttgattgcatcttcaacagatccttggttaggatcaatccagtattcacctatttttcaaaatagaaattttactaaataaagacaatctcaatcatgactataagtctccaaaagaattaacagagggtttgaaaatatacactcactgattaaggattcttttaagtgagagtgccccttacgaaaaaagtaaccggtatgcattgggggcctttctacattctagtcgctattgtaaggcactttgccaaaccatgtacttaaggctcaaaacatccatatgaaggaaatatcattacccccattttatagatgagaaaaccataccgaaaagagaaaatctatagtaagcggctttaccaaaatagatgtgtttccaatattttaaagcaaattagaatgagtgtaacaaaataatgtaaataatgtaataaaataatgtaacatcaaaactatgagtaaagtgaataaataagttgaattacaattagaatgctatgaatcatttcattagatctttttaaaattactcttctcatatataagagactcttaaaataggaaataccaaggcagtgcctggtggtaggcatacagtcaaatacacaatttaatatgcatttgcatacatgggtgtgtgtatacatatatttgtgtgtatattatataaatagtatgtgagaattgcattttaaatgaaagtgtcggaatgtaatgtatagagttaataaaattgccctttcttcaatgataataattttagctattcctgtcaatgtcatttcaaagttaacttaaattcttaggctctttgtagctcatttgtctcctgtgacttaggatccctcttctctaggtcatattggattaattaaaatgacagaataaggtaaactttaagcctggtacatgcaactagggcagaacaactatttgattccaaaatgtcttggaacctcataataatataatcctgccagcagagattccaaaagtatgactcatagaacattaaactacatgaaaggaattacatatttaaatgtgggaaatatatgcttgatgatccagcaatatgttaacattaagacacttataggtcatgcaagtaaataaatattttgaacaatacttaagcaagcattttccacatttccacgaaatgcttttattccacaaaaatatcaatattttaagatttctggatgaaaatggaactaccatcatgaaactggattattaataggatatatcatctattatagtacattttttttaaagttaacatttattttaaatacaaggggtacctgtgcagatttgttacatggggatattgtatgatgctgaggtttggggtacagatcctgtcacccaggtagtgagcatagtatccaataggtaatttctcaacccttgctcccatccacaccctcccccctgtagtagcctgcagtgtttatggtttcatatttatgtccatgtgtgctcattagctcttacttataaatgagaacatatgatatttggttttctgttcctgtattaatttgcttaggattatggtttcccgctgcatccatgttgctgcaaaggacatgatttcattcttttttatggccacataatgttccatcatatatatgtaccacattttctttatccaatctaccattgatgggcatctgggtcaatttcatgtctttgctactgtgaatagcacagtgatgaatacatgaattcatgggtctttttggtagaacgatttattttcctttgggatataccaaatcacaggattgctgggtcaaatggtagctctgctttaagttctttgagaaatctccagctgctttccacagtggctgaactaatttacattcccaccaataagtgtataagcattcccttttctccaaagccttgtcagtatctgttttgtgacttttttatttttttgagacacagtctcgctctgtcgcccaggcagtggcgcgatctcaactcactgcaagctccggctcctgggttcatgccactctcctgcctcagcctcccgagtagctggaactacaggcacccgccaccacgcctgactaattttctgtatttttagtagagacggggtttcaccatgttagccaggatggtcttgatctcctgacctcatgattagcccacctcggcctcccaaagtgctgggattacaggcgtgagacaccgcacctggcctgttttgtgactttttaatgacagccatactgactcgtgtgagatggtatctcactatggctttgattttcatttctctaataattagtgatgctgagcatttttttcatgttttcacaaaattgactgtttccaccattaaattataagctccatgatatgtttactatttttatctcaaatctatcactaagtagaaagtcagtaacatattttggaatgcagttgagaataaacaatcagaaacaacgggttttgctcaaatgggctgctgtctactcaccactctgctttgcggaatggcaaagctttaggtcatcacacgtgcgggctgggtgctttttcgagccatcggggctgcgcatggtttcaatctgactactgagtgacttcagggtagcatgaacccctgggtccgttttgtttttgtcatcaggagccgcctgatcttcagtaaactcaggaagtggatctggcatgctttcatcatagtgccccatgatatccccaagagcagctgtaaggtggccagggggacccggagggccaggtgggccaggctcaccaggagggccctaattaaaaagagattggaaagacatttaacacattgtttttgttttacttaactggtagaacttggttcatagggagttccaatgagacactccaatttgacagtaaagggagatctatgactcgcgcccttttgtaactagatgggggtggtctaacaggctgtaacattcaaggatgagaaatgatgctcaatcatttttcaggaaacatatcttcaagtcagcatccaagataaataaagatcaaagcacaaaatatttgctcaggtgtttaccttgaagatacaacatattttatgttaatagcatgcagatatgtatgttcatttgcaaactattttcgtcaaggtacaaccaaaatgttttaaaattatttttggatgaagctgaacaaagcatgcaggggaatagtggctgctggttctataagattacatgtcaataacaagaaaatacccacaggaaacacccacaagagaattatactcctacttctaaaagagagggagagaaacacaggaagtccttttatgtgcattaattcctgtacagataaaaattctctgtcctaagaaaaactgaagaaatagtattggtttttagagacagggtcttgctactatgttgcccaagttggattcaaactgctgggctcaagcaatcctcccaccttcacctcctgaatagctagaattacaggtgtgtgccaaggtgcccagtattcctagccttagcctttgaattgacataaataaagagccctcctgccttttttttttttttttgccaaataagacacactgaaatgagagggagataagcacaaaaagtggcagagactacgaaatggatcctctctattaattcccttctgcacttccccaaggaagaactcagcaacttgaaagaaccaggtgacaacctgaagagacacatagtccacatctcatgtagagagcaagatctgggagcaagaactctccagaaggctggagttctactattggctctgccacttgttatatggctccagacaagttgcttttaccttcagtgccaatgtttcctcactctcaaagggctgttacataatttttttttcttcctgtctctaaggtcatatactgagttcatgcgttcctttatactaattttaagagaaaagaaaagacttttttctaatatatcaaggcccactgaatcacaaagtcaatcaacagccacataagctgaaggtattccaattttctagctgtttcctattcacaattagagaaataaatgagtagaaaacatatctcttgtccataggaaatataagactatttgatccacataagaagtaaatatctggcttaacagtattgctatgaagggcaaaggaaaagtaaggaagagaaggtaaagaccaatgaggaagaaacaccagagagagaagcataagctcatatacaaacacgcacatgagtacacctgtgcatggaagatgtatgaagatgtttcccagacctgagaagcaaggatctaactaacatagtatacagctttgtatcatcctcaagtcaacactactgaaactttttacaaaaagttttaatcaaagtcctccctgaatgttttcaatggagaaaaacttcaatttcatactcttcattgtccagcatttctatggagttttcatgaagtaataactatacctcacagacatttaaaatattgcccttgagagcaaatcaacattttcataactttaattataaatacaattataacttgttctttgctcttgttagtatcacattatgttaatgtctgggtaggttggactctgattttatgtgctctaacttatctgtattaaaatacttgaaatagttacttatactcttgtgtgacttctacgtttgttttcggggtcccttaagtctcttgtcaatcgggctgcacagacatttcttggacggaatctgagctattgaataaatagcatttcttgcatgtaaacctttgtgactttacctcaggtcctgcttctcctacactgcctcgtacacctggaggtccaattggcccaagtggcccagggtttccttctttacctgaaggaccaactgggcctggaggaccctgcaagaaacaaagactgtagtttagattctatgaaggaaaaattttacaatgcctttctctaatcaaagaactattttacatatggagctgtaacagtgatttctaagattcattttcttactgattaataaatgaacttctggtactttgtaacatttatgatttcatcacataagaattttccatcatccatgcatggtaaaagacaaatatgagtttacatctttaatggactaatcacctacttttattggtagtaactttcattaaacctcacatattgtaaacttagaaattcaattaacttgaaataagaaaatgacagaagttggagtgtttaagtgaaatttctgtgcttatgcctcagaatgccatcatgtactattattctgaattttatgtatgctttgtttacactgtattcagatataccaagattctttaaattattttttctaattttttctacaaaatattttctattttcctaaataattatgtccaccaattgtcttatgccatcaatgacttattacaagcaacattaatactaatggagaatttctaaaagcttcaaatattggcttcattttattatttacttccaaattagctttatgtaaactacttctgaggaactatcactattacttaaaagacaaaatatatttagcttcaaaatctgtctccacttcatagtaaatgctattacatcatctcaaaaagtgaaagttgaatagaaatttaaattaacacaatgtaacaaaatgaactaacagaggaatatatccaaaccctaggtaataaattttattgcgggcccatgaggtaatatatcatatttcaagatatttctacttaaaattaattgctaaatagcttgtctcatatgtgtgttgccaacctcagagaagatgagccaactccagcttcaataccaggaaaacgatactcaagcattagcagtacatcaacaaaggcattattatttacacctgcaacttactactttttgttacttactcttgggccaaatggtccagggattccagcacttccttgttcaccatttggaccctaagtaggaatacaataaaaaatgttgccaaaatatttggatcctgcattgtgccattctcaaaaatgtgctatcattgactttagcagcatgaactactttgataaagtcaccaatctctgcaatgtctacatgagttgaccaatgttaaagacacctgtaggagtaacagtgcatatagcttttgctttatttcttccctacaaaattatagcttattattggcaattatcacttgttattcatcaagatattctttgaactgaaaataagatacaaacatatccacctattttacagacagataaatgttcgtgtcaagatacccgtgtattttcaactacagggcagaataatacttaaaggaataacttacaggagggccaggaagaccctgaagaccagtaaagcctctgtggcccttctgacctctgtcacctcggtctccatgatcacctttgtcaccacgaggtccttggggtccctagaaatagagatatggcatgaaaattacttgctacatattattgttgagactaaaatttactaaaattttactttttataattgtatttactacaattttgaacttggtattttatatggattaatatatttacttatctaaaaatagtattagacctagaaatttctgtttatttttcccaaagaatggtaggtgatcactgaaaaaagatataataagaatacttttctgaagatttattttttaaatgtttatcttacattcatactaaaattagatatttttgtttgatctagcctatctgaaatgttttttaaagattatgcttcacatatttagttgatattattatataaaaatattgctaccatatatagattcttttaaattaaaacatttcatacttgccgtgtgtaacaatgaaatgattttaaatttacatatgcaaataaactagctggctatgacagctgcaactatattaagaaattggcaaaaacttgcttgaacaaattaaacagaaatatcatctttaagccactttcctctaaagaacaaagcaactctaagttatcccatatctgcaatatctgtaaccaaatccagtgatcttgatgctaagcttgatctacggctacaaagaaagccgtagttagggatcttattttgagatagaagctatacccagagaagaggtgaaaattatctgatcaatctcagatgttttgttattgttggtggtggtgttggttttgttttgttttaagtcctgggaaattaaaaacagctccagggaacgagtggttcacagtaaactgacaagtggcatagagtcatctactatagaaccggattctgttgcttttagtgttttcccaaaagataactgaatccctatttatctgactttggaagatgactgcagtcatcaaatcaattggctctcaggttaatttttcccttattgttttgattttgaatttatatttcctaattatcatacagtataggaacccatttataataaaaagaagatgatttcagtagcttttgcatattttatataacaatataaatttaaatactatcaaaatcagcctgaagtttttcataatgttcgaaaggttcttttatttgggggatgacccaaagtttcataattaaaactaaactaaatcagaaggcacctatttgaattattaactacaatgtatttattcatagaaaacaaaattacaatgtttctataactgctcaaaacactgttcacttgacatgctatgcaactataaaatatttgccagtcaagctcaaattaaagaggagaattatttaataatatggccatgattttcaaagtataattgttctttttgagaacagacattgatttacctgatgggcatgaaaagcatatgacctattagattacacatgagatgattcattcatggtaagacatctatataataatgttaacctgaaagtcactgattgcaaatagcacaaagatcagaacatagaaagaaaaatctagttgaaaatgaaacataatatttgaatagtgcttttcaagtttacagagagctttcaaatccattttcctatgtagtttttagaatagctcagagagaaatgcactataattcctattattttaggagaaacctgtgactttaaaaacctccatgattattgatataattcatggttaaattcagaagaattgtgttaaaattataaaaataaactcgtattactttaaaaaataagagtaaacttataatttttaattaatatttttgttcaagcttgaggaatttcatatttttcagttatgaatcttaaattatacttctttgggagtatattttatataagaaaacattttttaaaaaacaaaaaaagagaacttacaggtaatccacgtttcccagctcgaccaggtggtcctataggaccccgagaaccctaaaagaaatttacaacaaaaaaaattggcatgtaaaaaagatattcacatattacatagatacaggatgtcaacaatacgtttatagttggatgcatatatatatatgtgtgtgtgtgtgtgtgtgtgtgcatactcttatgattaattaattgaaatcaggcaaatgtccatgtgtagataagactgtggtcactataacttcaatgacacttttacggtcaattttattcattgacttcattgaataagtatcaccttagttgaatacagtaagacattattcattgacatttaacatgatgcatacttattacattttcaaactacagcattttcagatgatggaagtcaaagcatcagtatcttctattccctcttagaaatgaaattttgcctttcagactaagaaacatatagtagttcataattagctgtttaccattcattatttagagtccttaacgaagtgcacatgtatgactatgtgtgtgtgcctatatgcagcttataacatagcatatgggtgtgcaaaactgtcagtgtgaaattgactccctccttaccggatctcctctttgtcctgcatctcctggagcacccacagggccaggagttccaggggcaccctgagagcctggcagacctgcaggcccagggtctccacgatcaccctaacaagaataaccatgatattattttttaacatttattctaaaacaacaatattccatatgttcatgttattcttatagtattaataatgggaaaaaataccctttaaaacttatttttacttattattttaactattttacttatatttattaattaataaatcaaattgaaaagaataaagttatttcttcctaatttcaagtctcatcctttccctcacctactccctattgctcgcacgtcaagatcattggagtataggagtgatcacctccagaatttaacatgttttctagagcaccaatctttaagctggaatattggtatacttggaatacacaaagactttccaaagactgtgaaaacaaagaaaattttaaggaaaccaccttctagattttcctctccttatgtattctttcagaaaactatattttgattatccttccttacttcccctaaataatccaccttctctcattttgtaaaagaaaagcagaaatcataccatctgcaatcttattatgatgcaatgtcccaaggaataaatacctctaggcactgaactaagggacttttccagaatgcatagtttacttgagtataaagctacgaaggatttggaaaataaagaggctcctttttattttatccagatgacacaattatgacaaggctccaaatattacttgtctccttaagaagtcagaggtgagataagcgttatatgaacatgtctaaacataaatatttgacttgaaaaattgagtcagactgtattttctgacaaaaaattgtcttatttgactgataaatttatcaacctagataaactttggcaattaggttatagaacagacacataatacattgaataagctgaattggcaacttcaaggttttgaaaaaaaaaaaaaaatacttgcccgggcacagtggctcacaaagtgggctgtaatcccagcactttgggaggccaaggcggccggatcatgaggtcaagagatcgagaccatcctggccaacgtggtgaaacccagtctctattaaaaatacaaaaattagctgggtgtggtggcacatgcctgcagtcccagctactggggaggctgaggcaggagaatcacttgaacccaggaggtagaggttgcagcgagacgagatcgtgtcactgcactccagcctggcaacagagcaagactctgtctcaaaaaaaaaaaaaaaaatacttaaagcacttgtacatttagaatttaccaggaatcacctcctttgcaactatttaaacttgtgattttaaaagggcgatggcaacttaaaataagtagagagatttaccgattttcataattacttcagcaaaacctttgaagatggttgcactatatagtatatattgacaaaggaaaaagcccaagttgccaagagaatttgcagtctgtggattatagtagatgagcgggacttagcccaagcttcctccaaatcctttcttccccttttttttcaatatgaggttgagtgtctatcctgtagtggagtgtttaaacatgtcatttaatatacaaatgcccaatggcatatgtattaattatatttaaagcatttgaaaatggaggttcagaaaatctgcttaagattacacagctaattacttagggaaacaatattccaaatcaagtctgactggctccaaagcccattctgctacatgatgagctttaattacatcataacagactttggagtggggagtgattttgccttcagtggcccatctcagcagcatgagatgactgtgcaactgccagaagggactggggcttcagagaaagttggggacatgttcagttcagcacattctaatttaaaacacatcatggaatatacagtgtttaaaaagccacatggcttatattctcatacggcattcactttagatggtgaatggaaaaatttagacattacacagcactattttggctttcatgcttttgttaatgagtttaaaatttagaacacttcatatatatcctcatccaaagcctttatgttaaaccaaagatggcttcaattttatcttcctgctctgaaaaaataccatcttaatttgttgcatattcaaatatcatttcatttacaagatataaaaattatggctttacagaaacagttgttattcagaaaaatcagaagtgtattggaactatcaggaaaaatgacagtttttagtgtaaattaaaaagatttcagatttgcatgactttagattttataataagtgaaatggctcttacacgttctccaacagcaccatcccgtcctggggtaccatcattgccagctggaccctataaagaataatggtttgaaaaactacttaactgagtaatgaaaaaaatcctcattccaattgtcaaaaaatgacagcatgttttacacctgtgttttataaactgtcagttagcatttatgcaaatgtcagcagaagaacggtttctacctctttttcattattttgaattactgtaaaattaacatattcttacttaatccatattcttcatttatatttcttattttgaaaaacaaaaaacccacaaatattttgaaatagataacaattacattcttgccactttatgttttgcttgtattaacaatgaaaggcttttcttacatttacttcttaagattattcaaatatccttaaagttttgaaataaaataactgtttcaatattaaactactttaagaaatagtcttccttttctattttattgtgatttttttcataaatatgtctttgctatttgatcaaaaattgttccaaaggctattgattctttctttcaataaaatgttacattaactgtttgatgattcactccttaaaatcctgaacagaggatattccagcctttaacttctcaaattgcctatcaaaaactgatttcctcccaaaagtgcctaaaggaacatgatatccattatgttactttatagtgatatttaagtaaaatgatctctactaactttgcccttttcacaagctggaatagctatattaatcctatcaccaaaaaacttggcaattttgataaatatgtcattacaaaatgaaataataacaagggaaagatgaatggatgtgtcctttcaccctcaaaacagtttggcaacagcttaaatgaactaaaatacttagctccagactagatgaaggtcagtgcaaagacaccgatcctattaccttttctttatgtcatcacttagccaactctctagggaagtagagtacatcaaataacattactaagaaactttcttaaggtcaaatatgcaataaaattctaaatcaattgctaaatgaaaaaaattgtttccatgacaccagataacaagagaagagttattttcactgtagtactcacttctggtccaggttcccctacaggaccattggagcctgggggccccacaggtccaggtggacctttatctcctgttgcaccagttggtcctacttttcctggtgttccctgaaatagaagtataaatgtcaaacacttgtgaagaaattgaagaacgctagttcccataaaggctaagttttcaaaatggtgcctctgggctccttctataataataattttgcattatcttacaacactcatgtaatcataatgctttcttagaggcctgcccacctcctatcagactcctcttgacgtatctaagggaccaaaaaccaaccatctgttgccaccagcacaggtgtgcattttgggttctaatcatgtgtaccataggtgattctagctgcccttctggaatttgcatcactttcatcctttttccccgctctgctttgtctgttcattttatttctatattctgatactttgatctcactcttgagagattttactttcacattcttggctcacttctgataacaataagacatcccttagctcctactttgttggtttcatatttcaacccacatgtctcccagttctaagatcccatacatctctctgtctacattccatatgaaaacatcattaatttttttcaagcactgtaatcttttagcaataaaatttagtctcttcaaagctaactttgaatcaaacttttatccatactccagggaatataaaatcctaaagcaccctccagggaacaggagattaccttcagatccttcttcagcattccccctacattcacctcaaatattactttagctcaactatgtcttccctttgatggtttactgtaaaatatggtatttttgttaagcatgtttacttaaaaagacactacctattcaccagaagattatccccctcctctagctccgggatctttttaatctttgaagaaggatttaaaggtcaccaaaaatccatatccttatttgcctacttttctagtctcagggttaaacaaatatatattttcaaagactttgtaaggtagttaagaatttgacatttaagatcaaaagatttttaagagactcaaaaattaatgtccctacaatactgtttaaatctattcatcaagcaaaaaaaataaaatcaattctctaaacaatttgtattgcacatatgagataaaatattgaccgatgcagctactcaccgctgggcctggtaggccgggcatgcctctctctccacgttgcccaggcatgccaacaattcctctctgcccggtcgttccagctggaccaggggggccatctggaccctaatgttgaggacaaactaaaatcagaaactatccagggtaaaactgtacccaaggaatttacaataagttgggtacagctttacaggtttttcagtatgaaaaagaagttctctgtttctcaaaatcatactgcatatgagtagtcataaattgtaatccgcacagaacctctaacattatttaaaggtgaaaacagctcatccgttggaaagaaactgaagattaatgtgaatactgactcaataaaagaggtaacttcagagaaatattttttcttctttataaaaagacaaaaagaaagtttaacaataaggaaaaaagagttatctaaacacaatatttaaaggcatttgcatataaaatataatatacatatatttttaaagttattcatacacaatgaacatttaacaaataatttttttgggtttagtttttagataccatatctattactgctatttttaaaatctatatatatacacgtttttcctaaagccttatagatttaatgcactttaaaaattttaggaatgtgcccagcataatatttaagcatttttgtgacactgatcattatgggtttctatttgtaaatatctcagttgaaggtggtctggaacggatacgccaaacttacaggttgcccatcttctcctgggtcccctttgtctcctgggccaccaggggggccagctggtcctcgatctcccacacgcccatgagagccagggtccccacgaagacctggaggtccctccttcccgggttcccctaggggtcccgcaggtcctggagctccctagtataacaaagaaagaaacaccaaggagggcaaaatggaaggcaagtaagagtgattgacataacgctgtctgcctcagatgcagatgtccaagcctcgcaggttcattttacctgttagataatcagtcattctataggatttaaacaaaacaaaacaaaagaaaacacagctgtagattcattccccagggggaaaactaaatatcatttgcagtcaattccctttgaataatttttaaagagtggtgcaactaacttgaattttcaaacttatttaaagctccactccaatgatgaatatataatactttattctgagataattatttattcttatgatttgatcttataatgaatgacatttattaaagaaagtttcatagttgcatcttaactgaagagaatgattattagcacataatactgtaagtattcagtatttaaacggaataataataaaacattggggctaaaaagaacttgcaaattagctcctccaagaaatactagattattaaggatgatttgctttgctgaaataccagcatgcattattggaataagagttgttaaataagaaaacataccattaagaaattaaataaaataataaatttaactcaaatgtatacgtgtgtgtgtaattatttcattatcagtgacttgtctcactaagttgacttacagcagggcctggaggtccaactctgcccgcagaaccaggaaatcctgtagcaccctagaaccagaatatcatataagcaatttttaaggtaatataaattagttacatgtattttcctgggattttttttcacaggaagactgaagcctttagatttcctttcatgttgtaagcaatatttttttttcttcgtacgaatcccatattttggggaattaatctagattaactggtaggaagggcactattttcctttttccatgcaggtagtactagaatcacattgatattttatacaatcaaattaaataaagtgctttcacattgtttatttactcttttatataggtagtatgttacttacattacaggtgaggcacctgggtctccaagattacaaacttgattttaacccaaatctccatctgagttaagtgccctttgcactatagtacagttgatacaggtaataatttgttatttcagtctcagatgaaaattatcttttacatgaccaggaagcactaggtaactagaattagctgtgcatactttgcagagcatcaaataaacttacaggcggaccttgggttcctcgaccaccttttagtccaggaacaccattaggaccctgaatagaaacaaacaaaagagcactatagtgaagcaaaagaggctgaatgtacactccaaacatggggcacttgactcaagttatgcctttttcttgttaacttacatgagggccaggggatcctgctaaaccttgtggtccaggagaaccagcatctcccttctgtcctggctctccaggttcaccttttactccaggctgtccgtcaggaccctataaaaaattatacaaacaagcaattgattataagacttatagacaaattactttagagtaattattactaatgtatcaattaatcatatattgtgaaacagtgctttataatcagtattaaagcatactaaaggaaaaaaagtactctgatgagatctttcaaaacagcctaaaaaataagctatcccactgcatttttattttaacaaataattatagaagctcaactagcacaaacaagttttgtgccagtctataaaaaaatgtattgaaaatgagaatattgtctagaaaactgtaaattttccagaatacgacttcaaaacatatgacaatgatcattaaacttattataacaagataagtgtttatttgtaaattagggatatttgaaaattatacctggggtccggcaaaaccaacagctccagttggcccattttcacctcgagaaccctaggaggagacaaagattactgtagctttcacacattatcctaaacaggaacagtattttaaaatatgatcatataaatctgatagttagacatgtaaatatagaaaaattacacatattgcttaaggaaggtccttaaggattatataaagatataggtcatagaacaaaattcccaaggtcagaagtctcaaaggagcctccaaattagttagtaaacaagctgcctaactacacttaatagattgtatagcagataatttttaagtttaattagaaaagcaaaagctaaaaaccaggaagttatacataacctaaaaccaataagcattgttttatataaatataaaaacaaaatgattaattgttttattgctcaatctcacactaaagaacaccaaaatactgtcacttacaggattgccccgggagccaggagggccaactaaacctcgaggaccaggttcaccctagaaagcagattttagatggttactgtccaaaacagtagctaaacataattttaggacattggtcactgtgtaggaggagatagtggaaaagaactctgaaatgatcttgctcagataccatatgttataaaatgaaaagatttatgaaagagcctgctattcaggactcataattttgagtgtacaaattaacaacttgtgacttaccttttctccagtaggacctgccggacctggagggcccaaaggacctggaagaccctgtcaattaacagaacataggcatattgaggtaaaaaatgcacagaaatcttcatgcttagcaaatcaacaaacaaaaaagaaacgactattttgttataatttggctgcctttgcaaatcattatctataataaatgatataatctatatattttcaagagttttctgtctagtttaataccatttccaccatattttctccacacagtgttttaatctctttcatgcaacctaattcatgcatacataaaactgttttcaggcattagcactacattaatgctaagctacaaaaatgtttctatttcttagcataattagctttgctaatatttattcggacatttgaccacaaattgaaaagaggctttccttcttttgcatataatattatattcttaaattataatagcaaaatatcacttttttacttttaaaaattgaaattgtgttaaggcattttaggtgttttttcctttttttttttttttttttttggcacagggtctccactctacattgcccagaatggagtgcagtagccattcacagatgtgatcacagcacatgcatctttgaacgcttgccctggatcacgtgatcctcccatctcagactccagagtaactgagactacaggcacaagccactatgcctgacttagttttcttcattttttttttttttgagacggagtctcgctctgtcgcctaggctggagtgcagtggcaccatctcggctcactgcaagctccgcctcccgggtttgcgccattctcctacctcagcctcccaagtagctgggattgcaagcgtctgtcaccaccacacccggctaattttttgtatttttagtagagacggggtttcaccatagccagggtggtcttgatctcctgccctcatgatccgcccacctcagcctcccaaagtgctgggattacaggcgtgagccatcgcgcccagccagttttcttcattcttttgagatgaaaaggaaaagtagctaaagtttacagcctaaaaccccagctactttgagatttatgggcataggagagctaacacttagaggacagtacagctaacacatggggacacaacctgagtcttcttgacaggtaatcacaaacttgaaactgtgggaatattgaagtcctctttaaaacaagttctctatcttataactgtgtcttgcctcttcatatgcagcccaaatattctttcatcgtttaatttctgtatgtacaactaaagaaacttaaggaacaaaaatgactttaattttatagatttgacaagaacataagaaatctgtgttcttatagtctctggatctacaatggaatgatatcattccaataatttatgtaatatacttctttaaaggatttgatgaaatataaatatcacttcattacttatgtttatagattttttatacagagaaaacatgttattcattttttccctactatgagattgcagtaagtgctttgctctgcttctttcctgcaacaatgtagtgtcctcattaaaaataaagcagtcattgcttacatcctggtcctatcacattgcaatttcaaagttagttcataggcacaattgatatgtattttagattttcccttaaaacaaactgccaatgcatcgttcctataaatagtactgcactacttatgcattccaggacatccatgatgtaaaatattaaaaatatgccagatttacttgactatttttgaaatattaaattaaatattagatttaactaaaaggcaaggtgtatcttttgtgcataatttgttaaaagaagtggtgcatccttaattaaatttgcataaaaaggactaattacccttaagatgaaaattttctactacatttcactatatttccttaatctaaagctattataaccaatgtattaacaatgactcaatgtgcagaaccaaatagcagttctcttttattatgttacaactgtaattgccagggcacacatgacaactaacagcaaaccatgtcatactgaaacagaaatcattagtcaaatatcaggtactattccagaaaatgatggatgtttaagccattgtgactagccactcttacatgaggaaatcatttatgtctgaaaatatattgtccttcgagtctgattgtccttggaattgtaaatgcattctaatttcaaagacctaacgcttgttaaatgtcaatttctgacatgacattaaacaatgctttgcagttgaccatccttctggacattctgcttgttcaaactgtttattaatgataacattaatgacgattcactgtgcagtaaatttctcaccccaacatccaatatactgagaaacatttatcacaactttggtgactccacaaagctctacttgtctatgctggaatgaagtattggccagctcactagattagcattttaacagaaataaaccttgtgtatgaaataaaaagatgatagagaaagataaagagggcccccatccccttaaggcacttatctcataggcacaataaatatgtttttatttaagtttcatttaattcagggtaagcaaaatgaataaaccgtggttgaatcacagcagatctcacatgccattattctccaactcctgactaccaaggaaacatgactgactttattttggaaggttcagggaaactcatatgatactgtaatgttggttcctagcccagctagaaaaggaatactttcacttactcttgcaccatcatttccagctgtgccttcagcacctttttctcctatgccaccctgggaaaacacacaaaatacaattgattcatttaattgtctctttcccacacttgtgtgtaagtttcatgagagtgaaggctaattgtcattttcctagtcgtatccaggtgagcctgggatggtgcctcacactgtgcattttctcagtaaatgtttattagaagaatgaaaaatgaatgactagtgactcaggatggtagaaataaaagcctgctcaagaaatcatttcattttcagcagaaagtctgaataaatgaactgaaaaaaaaaaaaaaaaaaaaaggacttactctgtcacccttggggccaggagttcctgcaattcctctttctcccggcataccttgaagacctggtgggcctgtatctccaggggtcccagatggacctggactgccctaaaatgaaccaacattaagtgaccataccaataatattaagattaaactaatgaaattgctttttagtgggtcaaaagtagttgtcagcaatttcatgtagttcaacttagtgcttatatttttcatctgagaaagttgtctctgagtgagttgatattttgaaattaaaaaaaccagattttgtttttgattgctgctttatatttttaacttttctcttaagaggcaattgaacgctatttcaaataaaaaggatagagttgcctttttttccctctgttggcaacataatggaatatattaagaaagaaagacattacatttagagaaatatttcattctctctttaatgaaactgatatttgatattaacctggttttcaggctaatatagtgtctaaattgtagtagactgcatcaatcactctaaaccctgaaaataataaggggtctcatgtcacatgaccatgaaaaattctacttcaattgtttatactgaagttggccacattattttctaccaatcactaaatggcacacatttctgccttatgatgcattatattttcagattttaaaagttccatattttcacatatgtagtaagcagaattgtgaaacctgagacaaggaaaatggagcatattattagaaaagcctcctaataaattatgtaattttctatttctttcctctgtttattcatagaagccactaataaaatgtacataaacattagaaatgtgtttgtatatggaagtctatcaccatgtgcactaaactacaatccccatcaaagaagagagtcttctttttagctgacactttagttgcaaggaaaaagcctagtaagcgctcattaaatatttgtggaagaagaaaatgatataatcaaattatctttcaaaaacaagacaaatgcattctcacaccatcatgcgtttattaagcagtaattttaaagcattttaaaacactgagatcactatgacacttacttttgggccatcaggaccatgtcctccagccattcccttctcaccagggagtccagttatcccaggttctcctctttccccaggatttcctcgttctccctagcacaaaattgggatgtcaaataatctcaatacttgatctaaaaataggtcaaaatgtttctgagaaatggcttctactgcggaaaaattcagaaatgagacattactaaatctcaattttctaatttagtgataagaaataaatttgaagtaaggatatgctagtttcatagcacaaaatatttctcataaaattaatttttatccagtcaaagaatttataggttaaaataaatcccagtttaagattttaaaagacaccttttaaaactgaagccagtgggaaacaacattaatcatgaagattaaaatacttactctaggtcctaacgggccaactgctccgggatctccaggaacaccctataaacacattttttttttttaatggaacaagagctttgagtttaggcatttatcagaaaactttccagttcatacacctagtttctattaatgtgccattagaaggctgcataagccaacaatttaaagaaagaaaagtacgtatatttttataaatgagggaatattacatgttttagatgaaaacatttttccaaaaaactttgtattatacctgaatgtttgatttttggcaatgagaacatgcaaagtactatttcacaaagatagagcattagttttttagaggcaacaaaatacatgctaaatgtctttttttaaactaatggaagatgaaaaagtttaaataaagaaaagttatataaaaagggctaaagagttggtcttttaaatagaaccaatccaattctactcaattaagtaaatctttcttgagcctataatatggacaaagcactctactaggtattgtgcattcaaaccagtgcagtcatgtctaaattaaaagtttgtttgttcttacataaaagaaagtttgtcaatttgaaatttctttctttgataaagataactttatcaaataggcctccaatcttattctccgaaatggactgtcctcactgtggcctgatctccctaatcttatcatattactccttccttaaaaacccttcttttttcttttctggttttttttttttttttttttttttttgagacgttgtctcgctctatcacccaggctggagtacaatggtggcatgatcttggctcactgcaacctccacctcctggattaaagtgattctcctgcctcagcctcccaagtagctgggaatacaggcatgtgccaccatgcccaggtaatttttgtatttttagtacagacggttggccaggctggtctcgaactcctgatgccaagtgattcacctgcctcagtctcccaaagtgctgggattacaggtgtgagccactgtgcccagcctaaaaactcttccttagcttcccattactctaatgatgaagaacaaattagaatcaaattaaagccctccataatcaggcccctgagtcaccctgcagccccctttctattttccccaaattacattacccactctgatttgtaagcttgtctcatttcctggaggtttttcctatcttccctccttcatcattatcatcattcatctctcagatctcataaaagatattactttgtctggaaaacctttcctaaaacccccaagtcttatttaggtgcatcttttttgtttccataaacatagtacctcccttattatagcatttagagcatgctattattgtaattgtcctatactctctgaatcctactatactgtaaggacagcaaggtccaaatccattttgttcagctggttcaggccagtgctttgtagaggcaagcacacagagtgttcagcaaatatttattaaatgattaaatgaacaaatgaatcattcaaagaaaaataaataaatctatgagccaggaaaacgacagaataaaattgttagtatttgtccataactgtttatataaagtggttaagaacacatcttgggaagcagatgacctgggttcaaatctattaactgtgtgactttgggaaagttatctaacatctgtatgccccattttcctcatctacaaaatggagataatgatagtacctagtacatagggctgctttgagaactcaaagagataatgtatgtaaaggaaagcacaacagagcctcacacataaaaagtgataattgagccagcaatgtatagtgttgccattattattatttaaacacttacttgatcacctggttttccaccttctccaggaggccctggaggaccaggaagcccctaaaacaaaagtaagaaaataaaattgtgaatctgtgtaagtttaacaggctaccagtgttaacagtttaccttttacaattcatggggtctccaagactatattttcaatgaaaatatattgttcagacattttaagtaaaaaatattgttcagaagcattaaaaaaagactaccaataaaacacaacagctagtcaatttataggattgtattttcatctgcacaccacttagcaaaaaaagagataatgtaacaggagcttcttcatatttatagagtttttatggctctgtgaacaatattttagactgctagaatattatttaaagtcagtccagaaagttttttttacaaattatgatcttcctcctattaaataatgtacatactgatatatgtagataaattatgaaactttgttcaataaaaaattctagtcactgtgccgataaaacaaaatcagccttaaaatggtttcataaactttgttgagctatcagaaacattttattcctgatatctttttattacttttttgttattttttatttgttttgttcataatttgcaggtttgatcagtttttttagaagcccattcctttactttgaacaaaaatgttcgattttatccaaatgtctatactatctactaaaagagggatgactttttgaaaattgtagaatttcaaatcttctgaccatatctttttttttaaaaaaaaaaagcattttagttaatggaagatgaaatggaaaaccgaattagtgcatacctgaaaacctgtggggcctggaggtccttgttctcctctttcaccagctagaccctaagttgtgaaggagaaaataattgtgaatataaccagatctttgtctgcttcctctctacgtgaaccactagaagtactgatatttatttgtatttcttccaatcacatgtttttctctttagccaggtaataaactagtattaatagtaaccaaatggtattgtttgaagtctctggaggtgagaaaatatcttctaaagccagtaactgataacatgtatttattttttgatccaaacttaaatgtctggagccaattgtaaacttatggggaaattggattgaatataggaaaacccattacttttgtatatgtaatctaaaaacataatatttttattatagtttatttctgaatgtcttaagaattatttatcaagacttcaaaaacagaatgactaaagaaagcaaagctaacattttagaaagatttaaactgccccacccccccaaaaaaatatgccaaaatatttcggataaacacttcatttgaaagtcctaaaatgaaaatagacctcaaagaataagtattattccttttatgtcctaaaaaataccttaaataattttttttttttttttggagatggagtcttgctctgccacccaggctggagtgcaacggtgtaattttggttcactacaacctccgcctcccgggttcaagtgattctcctacctcagcctcctgaatagctaggattacaggcacatgccaccatgccaggctaatttttgtatttttaatagagacagggtttcaccatgttggccaggctggtcttgaactcctgacctcaggtaatccacctaccctggcctccctaagtgctgggattacaggcgtgagccaccatgcccggccttacataaatttttataagatgcattattgagagaaggtaaataattgagtatctaaatattttaaataaaatattttataaaatatttgttacacactgttttcttcagttgatatagtccttaactgtgacatataaaaacctttgcagtcagagttttacagaagtttaaagtaaaaagatcaatcattatatttaaaaaggcagaagacattatctcacagaaatcaaaagagaaggtataacagaaattcttcattcccatacattcttattcactttccctgaaacttacccataagtcttgaacaaacatcatcgaaaaaatgcaatgtgtgtatatatatattctcacacacacacacacaaaaatcacataccggcgggcccacaggaccagaaggaccaacttcaccatcttttccaggagctccctagtatcacacacagatatttgtgaggtgagtctatgataatttaaatagtacctacattatttttctttagcagaaaatgtatatttaccctctgcccaggaactccagcatttcctgcttctccaggtttcccagggtcaccctaaagaataaatgaaacttttgtataattccttcaatttgtcaaaaacatacctcctccaaatgaggatcatgatgaggtggccaacatattatacactgtactcacactgctacctttggggcctggaaggcccatgctcccgggctgccctctgattcctatggagcctggaggacctggacggccatcttcccctggcgcaccctatagaattgacaggagccatgtaagtttcatgtaagttgtttctaaacatagcatcacccaaagtgtcacctttgcttactatcatgttacataaattttaaattatcttgcattttcatgttaaagaatcaggacagttgaatgggttttttaaaaaacactgaagtattttaagtaactagaagagagattttattcttattctagatatgagcttcctcatgatgtctcctgacagtcatattaataggggaaatctttcttctttcatttactctggtttgtggtaatgaaaattcaggacttctatttcacattgcagaacaagggaagatcttagaatatataagttgtcaaaattcatacctacttatctcttaaacatataaaattagaaggatataaaaatgagaacattgctaatagacaaatttcaccaacattaaaaactatatcattttaacattttcactgatgtcaggcagggaagcaattcaatctcaaatatttatcttagtaaaaatttgatctacatttttgtcaacttgaaaatagatcctaagaatatgcttccagaagttggtacaaatatgtcaatatgaccagcatccatataatcaaaaacattaacctaaataaatatcatttaagttgcatgtctgttgaaaaatattagtggttgtggacttctgtttaaattacttaccaaaggtccaagttttccttcaggaccttgaacaccaggatttcctgtcaaaccctgaaaataaaaaaccaactgtcagtttgttgctgatatgcagttgaagtaaagattcttaagagtaaaaatagtgttgcatttttgtcaactgaatagaatgacatttctgtaaatcaaataaatttttaagtgatgtattgttaaaatttttcagaatttctctgccaaaattactttatttgctatattgctataaaagtatatttacaaatatttataaattctttacttgctaacaagttataaaatttgacaaacaggatttttttctcatgccaagtgataaagctattaatacatactgctttgagagagactagaagttaccgtgttttctatatatgataaaaataacaaaccagtattttttaaaataatgaattggatcaaaaccataaaaacaaagaaatgttctaaactgtaaaaacaaactaaatttaaaaacaaacaaaaacccgaccaatgcatgctcaggagcacttctcccctttgatgtagcaaacacttgctatattcttacccgagcacctggaagcccaggttcccctggacgtcctggatccccctggcttcctttgggtcctgaagaacctacaggaccccgttctccttgagcaccctgtaccgaggcaaagcagatgcatgaagaaaaagagtatagaaaaacaaaagcaagcagaagtaaaattatcgttttacaaatcaaggcactaatataacatacaaatcaaggcactgatataacgtataaaattttgtcaccacattccgccaactagcatccttcccccctatgcctcttaatacaggaattacacaagagaggattggggttaggcctggtatttgtatccatctcctttctggatctgagcccatgcaggccatagctagatcaccgtgctgaaaaatggcatcttctggagcaccccccacgtaagtatcaacattgacagggcaacctcacctttggcccaggtaaaccatcagagcctggaaaaccacgattgccaggagcaccctacaaatgaccaaaatgtgattcttaattgttgttgatatttttgcaatatgtaatgaataggtgatttttatttttagcactataaagttttaggagccatcatcaagccaacatggctatagatatgcatgagaaaaatctgactcgatggaaaaactttaaaattttgaagaatatataagtactgagccaaataattcctcaaatcaagaaatattctgcactttgggaggccaaggcaggcagatcacctgaggtcaggagttcaagaccagcctggccaacgtggtgaaaacctgtctctactaaaaatacaaaaattagctgggtatagtggcaagtgcctgtatcccagctactcaaaaggctgaggcacaagaatttcttgaaccttggacgcagaggttgcagtgagccaagatggtgccactgcactccagcctggacaacacagcaagactatgtcagaaaaaaaaaaggaagaaaggaaggaaggaagcaaggaaatattctaacgattcatagtaaaattaaacagagaaaactgatatctagagatgagaggcataggtaccatctatagcaattaaaatgtcaacaatgacatgcattagtgacatttttgtgaaacgctttgcattctccaaagctctagataaatgtgagattactgttcttcttttcagacctgtctcactgtgctccagtcacagctacctcttctggtctttaaaatcaccaggtcctttctgccctcccagctttgcatttgctttttcctctgctaagaatgttcttccttccaagttttctactggcttatcatcatcttcaggtctcagctaaaatgctatcttctcagaggatcctctttcctaaccacctaatctaacattacaacactgacatatatgtgtagttactctccaatgtgtcatgtctttacttagtgtgtgtatggcattttttaaagtgtgtacatatatttttatttacccattgacttgtttattgtttacctctccactaaaataaacaactatttactagtctccacatgaggactaggaccatagccttcttgttcactgatataattccaagcacagatggctcaaattggcatagactagtgatttaaccaatattagttgaatgtatgaataatgattagtcagttggctctttctatttgcacataactgtactgaactgtgcagggaacctgcaagcatttctcttaactgttctagttttccttactgttctcagacttacacacataattccctcacaactgtaagaatgtgttgtattatttaaatttaccctttctcccactggccctggaggaccaactgttcctgggtcacctctgggacctcttttgccttcttcaccgggtgggcctatcggaccctgaataccatgtggcccctgttaaaaacagaaggacagttaccagaaagacccatccaaccagtgaattatagttggaagcctaatttaacgaagtcagtcacaaattttaaagtatatggaacaatgagatattttcatctcaagctattataattctcattattattttaaacccttgagcattttgagctgtacacttccagacaatactatgttctacttatcattaaaacaatgaaaccttactggttccccttttgggccagcttctcctttgaaacctggaactcctggatcaccctgaaaaaaatatattgatatttgtaagaaccaggacatttagctagtccaatctgctcaaattagttacaataaataggctttaaaaattctctccagctgagtcggttttgcatcagtagtataatataatcatttttaaatgaatgcatgtgaatatgttaatatgtgtaaatttttataaaattcagtataatttggaagccatttaatttatagtggtctttaagagatttatttttaaaatcatgttttttatcatgtgtagtagaataaatagaattattgagttattattcaaatttgaaaattaaaattggaactatcaatgacaatttctatagataaatacatttaggctgtattttaggatgtgaacttgtttacccagaatcaaaataattttatatttatgccgtatttattgagaatttagcaacttcaaatagggcatttcactcttggaatgttagagggttttctgtaggtgtgtctttaaataccaactgaaatttaagttgtaagaactggattgcaaaattcagaacttggtaaaatcaaatgtgacactagcaacactaatgatttaataaatctgtcaccagcactttaagagaatttatcagcatgaccacattacttggaacagaattgtaaatatttatttaaatatttatttttatacatcaagctaaaagctattaagcacaacttctcaatgtgtttatttgttatgggttcatcaaaatattttttctaataaataatttctgtaaaatatgaaaacattcaatctgacattcaatctgattaatatatttgaatcactctttaacaataactctgaagaaatagttgttgaaccctagcctaattgtcattataaattcctattgaagctccatattcctcacactggcttgcataatattttcataatatttattattcaattattcataaaattctatgaggtgaaccataaagttataaccttattattttaaataaaagaacactaaaatttaacatactgcaataatgttccacttagaatttaaacatctaagttgtacctcaacatttagctttcacttcacaaagactcccatcttcccacatttggataagtcacgttatctatgtttcattgcatcacatgacatgttattactcttggccctcgtagttagattacactaaaggatgatagttctttcaaaggtcattaccggttggcctcgaattccctgaggaccagtgctaccctgaggtcctggagatccaggaggccctgctgagccaggaggaccagaggtacctggagagccctattaaacagcaagagtgatgtggtaagtagagacacaggtagcagtctggggccaatgtctaaagaatcatgcccatttgagcttcacatgccataaatgcagtactcaccgttgggcctttggcaccaggagtaccatcagttcctattgcaccctaaaaggtacattaaaagtatgtaatgaaatattaagcaatatatagatacaaatgtgctagtatacagatgtccagccatcttcaaaaaggaagtagaagcattttttaaaaatcaaccaccattatatcataaaaattacttttttgactacttctcctttacataaaataggtaaaacttacagagttgacaagggaaatatattttttcacagttgtaagcactcattcagaattcagagaatatattaaattttatatttcaaaatagctagaaaaagaggacttaaaatgttcccaacacatagaagtgatatatgctcaatgggatggatatcttaaataccctgacttgattattacacatcttaggcatataacagaacattacaggtaccccctaaatatgtacaaatattatgtatcaattaaaaaaataggttgaatttgttctgatgttacaagaaatgtccagctttctgggctggttcttaaatatgctagaaacttacaggaagacctggagagccaactggacctgggggcccagtttcacctctctgcccctgaggaccttcagggcctcgcgcccctgtaggacctgcttctccctaaaagggtgcaaagggaaatgttaatttaagaaaaatacgagagtggcattgtacaaagttgaccgcttatttggaattttacatttgaaacccaaatactgaaagaggccaaagaggattacaagagatgcgtgcccaaccaagcttaaggagcgcactcactttcccacttccttcttaagggatgacgctggtggcctcttcactaggaatattctccatatccaatctccagttgaagaagccctacaccagggttagcttaagttccctctcctctgaacctccacaaaatctgagatttttcttcccacacctatcagaatttacacttattacatattaaacagtttagataatctaagttcataaagaaaaactagaaacagccctacacctcaggcacactgagtctactcaaagaataagatagtcttaaatatcttttatttaagatatttatcaaagaatagatattcttaaatccacatggtttacttttagtatgttcttacataaatactcaggttattcaagcccatttctgtataaacagtgtatacattcggactctttaacacaaatcaaatgaaggagaaaaactgaccaacccactgtgcttaaagaggttgtttctgttcaatgtaaagctagatatttcaagtctaaaaatttactacaaaattaaagcttcatgcaatcatcagaggataaatcatattattttccaatatttataaaacaacctaatatcagctaaaatgtgctgcaagattagacaatagttttccaaatctgtgaaactcactgtaaaaagtctatataaaatttcataccatcattacagaacaataaattgtttccttgctatataagcaatataacaaatcatatttcagaatataagatttgagttgtaaaaactcagttccaccgaccttcaagaaagcatttatcagtaaagtgaaaaacatctgggctacaactttatttaagtctaatcaacttaatttttggcagcattataagcaaaataccatctatttttaaaccaaagaaacaatacttctttgataagaattaaaagatactttttaaagtgcaacattaagagcagagtgaagtggttaaggtaacttaatagctccctttatttcaagccaagatagtgagtccagctggcaaataaaaatgcctagttgagttttcattcatataaacaacaataacttttagcataagtttttcccatgcaatatttgaggcatacttatactaaacatgtattctttgctcatctgaaattcaaacttaacttggtttctgtattttatctggcttattatgtacctatgtggatctaatcctaaagaggcctggaaaactaaaattctaagccttaggaatctcatcagtatcagtaaagcatattgaatctctgtttcacttcattgaaatgcaaagaactggatttggaaatttattctttagtcagagagcagagaccatggcagaactttgtaggaaaagcaggatcctgtccaaaaacaaagatccaggaattttatggtggagagaagcaagaaggaaaacacagaaaatttctaacagaaacagttttgctagatatttgagttttattgagcagttttcagtagccaacaaccagtaccacaaacacccaggaggagagagaagtaaccagagtgaatggttgtgtaaactatgattgctagtgaagttaaagtaaaccccatgaaagttgtagtataaacctctttctgctaattcatagatttgtgagtatttccttaaccagaactcaatttggggacggagggtctcacaaaaagagggaagggattttgcatgttttgataggggtatatagagagtctgggccagagtctgtggtagtgacattattaggacttcagggagcagatcagattcagaggagaacccaacaagatcccacccacttgagttcacattgagttctcagtgaatgcagggaaaggaattaaggcactattttaaagcagcggcatccccatagcacagtgtttgaatatgtcattagagagagcctacagaataatttgacttggtgattctcacattttcaaggaatatctgaaatgtcagctacagacatttttcttctggtttgtttctaagtttaaatccaatttgagtagcacaactaataagaagcacgaacttacattgagggtgtcctctgcataaggccctatgtgatgagtttacatagatggtgtcacataatcctcaacaaaattccatgagaaaacaaagtttagaggggccaggtgactgtccgtgaccgcagtcatttttgtacagcataatcttgtgcataatctcttcaggattaagaatgtctttgcaaagggaaacatggcatcaggggaaatcagatgtgttatattgcttacaatttgaaagaggtgttctgaattaattcaccagtttatctaatgtaatcctaatgtccttctactgtcatccttgaatttatcccaaagtactgagagaaagaaccaattgtgattcactacaaatattaagtcatcccacagaatactttaatccattcccacatgaagagccaaatattctccgtgcccactcctttaatggcttcatagaattggattgtggagctgggggagtgcagagtgataacaaatgttaggtgaaaatgttagatgccttttgacagcatctaatttattttaacctcctaacctcctattgtttggaacattctgctgtttattacttccaggtactctattcaagaatagagaatagagttcctattcagtttaaagctcctattccttatagttgttttgactggctggcattagagtcctaacacatcaggttctttgatattataagggtacaattataagtaattctcctttaattatatttatacagttaattttattttttaatgtatctttttccatgtaataatgaaaaatgagcatactctaggctctttccttagttaaaagtaactttcacacttttcaattaattaaatgtcattcttcactttgggactcatgtaatcatgtagcgttaaatactgtatattaacattaacatcttaccttcattccaggatttcctggaaaaccagaagagcctggtatcccaagaggaccctattaaaagaaaccagaaaagtaatcagacatgtattcaattagtatctaattaggtcattttttagagtttggcgtcattttgtattagacacataagaataacctgcctttcactttaaaattacaaagataataggctaatttcattataagtaccttcaacatcaatctaaagtaatactaaaagacatatccaaggtattaaacataattggattactcaaatagcatataggattaagtcaatcacaaacataaagtgtttcaaacaattgcctcttgagagatgtactttctttgtgttaatcaaataatatagtttttagaaagttatattttatatcaaaatctagtacttcattctataaaaatgatgcttaagaaccatctggaggccaggcacggtggctcatgcctgtaatcccagcactttgggaggccaaggcaggcagatcacctgaggtcaggagttcgagaccagcctggccaacgtggtgaaacccagtctctactaaaaatacaaaaattagctgggtgtagtggctggcgcctataatcccagctacttgggaggctgaggcaggagaattgctggaacctgggaggtggaggttgtagtgagctgagatcacgccattgcactccaacctgcagtcagactccatctccaaaaaaaaaaaaaaaaaaaaaccatctggatattttagagaggtttttcaggcaataagtggatatttatggatatttatattaccctacatttgggaaggcatgcatagaatttaaaccattgattaaaagactaaatttaaaagaagtgagtataaaaggaattctagtacagattactctaactctaaggattgtactttagtctcatcagttttcaattaatagaagccctttcaaaatgtacatattttttcatcctatgttttgtttcctacttatgagaaacaagggagaaaagatccttggggcaaatgatttcaatttctataattatactttacttttggctaatagctttaaatttattttattttatgatcgttcagtcttggcccacgttgatcatgaatatttcctacaatactttctctctttccctcataatattttcttttcttggtgttttgttagcataatttaccttgtagagcttgactcagtttttcctgttgcagcaaaataaaattgttccatggactatttatttaggagcattttcagtaacaactttgtgctcaattactacattaaaaaatggctatagaaaacattttataaatatatttgtgctattacaaaacaccacttcttggtttcctgcaacagctatccacattgatgaccctgtgaaatcatctgtagagctttaaaaaatactgatttctgagtctacctctagagattacatttaaattggattggacatcaatatttttaagtttccaggtaattctagtgtatagccaaagttgagaaccactaatttcatgatgaacagataaagtttactacatgatgcctacaatataagtatgtacattttactagcaaccagtgttaataatatatgaaataatttattctagatatcattacatcttccttttaaaagtcagggcaccactattaaagtcacataatttgatgggaaaagcacatgtataataagttgctctaaagttcagaaaataactttatgtcttgaagctctttttaaaaattaaattagttttgttttgcttgtagagatataatttaagtgtccttgactgaataatagtagagaccttgatccatagcactgttacaattaaaatctacttcagttccacacatctcttaggatcctttgtacctctgggtaacacagcagttaatgggcagcaattgaggctattcacaagggagaactattgcaagtaatggaattttaaaaaggtaatatgcttgaaatgtgtcaaatttaaaatatttgcctttgtttataatttacatttgattctatgtttataatttacagatgattctttagtcttagccatcttcatttcatcatccacattacctggagatgatctttctggtcataaagttcctatgtttaaaatctctgaatgatctcacactaattattacagaaaagagctcaaaaaccctttaaatgggtaagtaagtatagccctttatgatctagatctagttataagtattcagattttcatcttcaagcgtgaattaaaggttcatagttacagaggattacctatgaaatagtgcaagatggtctgaagcaaaatacaatagccttgtccataccaagcacaaaaaagcacaatgtacaaaatattggtacacactgagacctcatcatttctcattccatgttacatttttactcccacagctgtatttattgcctgtatgttaaaaatttccaaaactacatttgaaattcaaatttctatcctgagctccactcttgcatatctaatcacgaaattgaattcatttattcccattctaaactcaaacccacaaacggtatgctgttcctctttctttatttccaatttcagataaattacatcatccatcaaacactttaaaccagaaatctactgggccatgcccatgagagttcttagctcattgacatgcagtcggcctctgttactaccataataactttagttcacatctttgtaatttctttctggaattatgccagtggtattcaaactcattctttattcttagccatcttcatttcatgttcaacattaccagcagattatcctctggtcataatgttcttatgtttaaaatccctgaatgatcgcacattaactactatagaaaagagctcaaaaaccatttaacatggtaagtataacccttcatgatatagctctcgcctctcaatccaattttaccttcctagaattttctgagcccactgtgttttgtcatctatctatcctatggacaatgctatattcttgcccattttatatattaaatacttatctttcaggacttggcttgaaagttgttcccataactgaagttgtatactgtattatggagttaacaattatgttatacaacaatattaatatctctctcttccttaatagaacagttttgaagaagtactatgtgtccatcaactttttattccaagtgtctggcatgtggtgagtgctctgtaaatgtttttgaatgtacaaatggaagaatgcatgaataaattaatgaattaatatgaaaataatataactcaccattggtccaggttttccaggcataccatgtgcacctcgttgtccctaattaagagaaaaagagacaagacaggataagattacattttagactatattttctcttatttgccttataaaaaatttccatattgcaaattgaagaataaatattaaagttaactgacaataaccctcactcagttaatagcaatataaatacatttacacaagctgatatggtagtcataaatgcatctatccttatagcaataagcaataaaatcaagattgagaaaatgaaactgattaaaatgattcttttactttaatgtatcatcttctaacatatgaactcagagacaatgaaaatttgaacacctcagtattcttaatagccagattaactcagagaagcaatgtccagaaaataaaatacacaagagagataaattaagttatagtgaattctgtaggtttcacccagagctcccttaagtactgaagtattcatcctgccagctggaaatataacctgctgatggctcactattgatacattccctaggaattgccctcagctaaagggaattagctctctcaagactgtgctctttccttggtcaatgcagggatacaaagcattggcccttatttgacacaagtctgcaagagccatctcagctccatagttcccctgaaattgactgagatctctgttgcaattgcaacacaattcaatttctccctctgaaaaaccctgcttttattcattccttccttcaaaaatacagtttctaagagcactcaccaataaatttcctgtactgtatacaagtcacttttttgaggctgtttcctaggaaacctgacctaagaccctaagaccattaatgtcagagtggttacaagaaagcaaactctaaagtgggatttgtaagctggatttcccactggtcagctggtgacagttggagtatgaatcacccttggcatgccgcgatggcacaatggaaaatattgtcaccaatggtgaacagagatattttaagggaatgggctagtaatgcaatatctcgggcatttgagaagaattaagaaaataacaattataaagctgatggaattgcatgggtcttgtatagtgcatctattggagaaagacactaaaaggctgatggtgataaatcaccaaagtaagactccttggcagcattttattttaattctcatctgcaaccagagagaagaaaaagctgaatatcaggccaagcacagggcttaatgcaagactatgagagctcttgggatggctgaattctcaaacctagaaagtctgttatgtcacagtcagggtcctggattgggaggagtcggattctgagatttggcaataggatatgtgggtcaacacactgaagaacttcagctgggcccggtgactcatgcctgtaattccagcactttgggaggctgagacaggaggattgcttgaagccaggagttttagacaagcttgggcaacaatgtgagaccctgtctctacaaaaaaaattagccaggaacggtggcatgcacctgtagtcccagctatttgggtgagagtatcgcttgagcccaggagttcaaggctacagtgagctatgattgtgccactgccctgtagcctgggcaacagagtaagaccctgtcctcaaaatttaaaggaaaaaaaagaaatttaaaatctcaggtccatctaaagtcacttggcctagagaagtggcccattccccccattaatagttggtagttctctcttgttgaagatgatacctaagcctctaatttggaagacaacttaagcctcacttctggacaccacaccaataactaacactactcctgattttttaaaaagatatcatacaccaaagcacctataagacctaaacatcgggtagaggcgggatctgagaaagaatgtatgggtcttggtcctgaagatactgtatcaaaaaaacagaatacaaagttggaaaattttaatgatgtggatacactgtctcgtgatattgcaatttaataccctggtaagaaccctgagaaatagtgctgacatgggagacagttcttagaaatgtgggaagagcaatagccaatgctggggcagaaatgtcagacctcccttggcagacagtagaagaaagcacagagaagtaagcatactatattgatagacgatgttagcctagataagccaatagctgactatattctataatattctctatatccccttaggacactctgcttactaaagtgataaagaatggcctggtgagagggtcttacactttccaaatcagggccctgaatttggtattgttgagtagctctgaggtggttgtcctctatgggctggaggtaatagcagagacagtgtaaacccgctattgctaatagtaatggggatgatcggatcttgaaataatagaggaaaggtggcagtccttaactatctaaagcaaggtaggtccaaagtaatgaactataagtctgaaatattagtcagcatagcctgatcttcagagaattgcgaaaagaataattagaatatgcctcctatacaggttcaagttacataaatagtctgcaagagtatttctcaatctgtataattaaaatgaatcaaggacaggtgatcaggaggctcacatctttcaaagagtgcactcagagtaaccaccttttaggagtatgaggaacataaaatgcttggaagaattcttggcatataataagctcttgataaatgtttcctattattgtaatttcattagtatatccaagtttgtgtttttctatggactatattccatgctgttatatgtattcattattttcttaatttttgtattaaagtagatgacaaatgtactgtggctatatgttaacattaaagcaaagggaaggttgttcaagaattctctgtactttcttttcaacttttctgtaaacctgactttattccaaaagaaaaagaaaaaaaaaaaaggtgaccagtactattactttcatttaaaaggcaagttcagtaaaccaaatctgaaaatgaattgaaatacacatctcagcagtataagtaaaagcagatatacttacaggagcaccctgtggcccaagtctccctctctctcctggcattcccctcggaccctatagacgatagagaagaaatgtctcttgaagcacctaatttgaaatgtagagtagtctgactaccccactcaatccaattgagattcaagataattggccaccaagcagtagtatttccaggggcaatgttgggtttgaaaaactatccccatgtggagataaataacctatcacctcttacataaatagatttcacttaacctggctttaatgggctaaatctgcgataatcttgatttgatcactgagtatagaaaaagaataagggcattcaaccgttaagagaaacagtgaaatgtgggaaaccttttctgttagaagggctcaactctcctgtgcttgtctatcagctggtaatcaagattattttactagccaacatatgttgtccatttatttttatttttcatttaaaaattctcttgttgtaatctaaaaggcaaggaaatataaccttagaaatttaagaaacaagaaaacgagcacataccagaggacccatggcacccattggaccagtggggccagcttcaccctaaaaaaaaatgagaatacattacagtatgagaagcctacaaccgatacatcactttgttctgtgtgtgtaattttaaaagcatattttcaaagaggacatatgaaagatgtacttttgatataggatctcagaatgttgttttattacctcttctcaaaatgcaatagtagtgtagttttaaagaaatacatctaaaataatattggggacttaagattgacggaaactatcatacctagccacagtaactagtctcaggaaaggacttatctggctatgtctgatacgtctcaagtaaaactttacaaagctaaaattgattgtaacactatcttaagatctattctaggagacttagaaataaaaaaaattttaaagccaaatgattttccacattaggtcatgatgctttccactagaaattcctttatacttccttgatgttttttctccctgtagaaatacaaataaattttgagaagaaacaatgaggagaaggtcttggtattaaaggggtactcaataatgggactaatgaactatctaaacctttcagatattttttaaaaagaaaaatgaatgattgtattttaaaagatagattcatagtgccatcttcatatgaagacaacactcatcctacactggcagacacccagtgctatggaggctattcttggaggcatatcaagtcatgtcatggtaaagccattgccactcatctttgaaaaattatgtttatttacctaaccatttgtttgtagccctctctcctgctgaattaaggtggttctgaaaaatgtgtaaacatttgaagcaaaactaagatgccaaagtgaggttacagtgagataattataagattaccttggaaccaggtgctccaacttcacctttagggccttcaagacctttgtgtccctgagaataaaaatgtaaatttgtatttgtatcctgtttttttcaatcctcaaaggcataagaaccaaaaataagcttgcagaaattgccttataaaaatgaatatcaaatttaaagttgttgctcaaaatactttcaaattctcaaacttttctgaaagcttattcaaggaaaattagagttttcacctttaaataacattttcagcttgcagtgttctcacccttcaaacacttgtgacttcatagaaatttaatctgtagctacaaataaaaaccttacagtggctttagaggaaacacataactacagagttcatattgttataaaatatcatttgtattcaaggtgaatgttcaaaatacttaataatgagtatagcagcagacatcttaatcaaaatctcaactactcaaaacagaggccagtgtatattgattgaatatcactatttgatattatgatagttagatagatgatagattctacatatgtaaacaatatataatagttacatcgtaattatcttcagtaataaggaaggcattctattgctttccaagtctaggtagactgggtcccttctgtgacctagtactctctatctctaccatgtcacctattacactatacaggaattgcctaccttttcatccgtatcccccattagcctgaagcttcaggctagagatttttctcattcatcactgtaccctcttttgtagcatagtgtccagtacatagtaagaattcaaaatatatttctttatcaaatcaaattaaactcaaaggaaatgtattaaaaaattgtgatttcagtaaccacagatgaatactgcaaccatagacagttaaggacaattgacaaattgacttgtaaagattttgaaggtaaatctccccagagcctgttcactaaaccacagtatctgagaggattacaatagattgaacttactcggtgacccttcagacctggaagaccaggagccccaggaaatccacgagctccctgggaggaaaacatagatagggcattttacagtcattaataaggatgcaaaattccttaatatatcattttttcccaaaaaatagctagtacacagttttccagcaacatattaagaagaacaaaaaaaagcagtatacttttatctgtcaaaatatatctgggtgatcaaaattagcaaagtaaatatgctattagaaatggaaacatgacttatacaaggatacaaagtaatgccaggtattgagttcatgacattttgaatttttcacatgatatcactgtgttataattagtagtgaaaacaaaacaagaacataagcatgaatcaatatgtccaacatgagaattgactataccaaggtagaaaaaaaatattcaggagagaaattcaagataaaatatccttttccttctttattgtgctttatttatggtacacgattaaatgtctttgtagcaaaccaatgtctttattttctatgaatttctgaatattggcagcagaatatgatgggaagaacagtattataatgtggtcaggaatttttaaaataaattgtttagaaaaaaactttgtggatttatgattatttaaaaaactaaatgaataaacaaaatatccaacagaaaagaaagtcaagaaatatgagaatgcttggtttcttgactaaataattacttaatttctgcaaattctatgtagctttcacctaaacacattaaataaaaaacaatagaaataccatagaaaatcaaatccagtggcacaactattttgaaatgatgcttgaaactttttccttatactgtcttaaaagatactaagctaatgacttaattatttacttattattatggcctatattaatttgattttgcattgaattgccattaccactgccgccagtatattgagcaccttgatagcattgattgatgtgatcacttattgattattattcttaatttatgtatagctggcacttagccttatgtttggttaatggacattcaatgaataatcactggataaacaactaaataaagaaatggtttgatatttcttactctcatagcactttaacctttcctaaggaatttctcttggcctagcatgatcttatacagataaaaaatccttctgctctgcaaatcataggtttcattcactatttctaaatggttgaataagcaactcaatggatgaaattcatataacaaaatcaaagcaataattcgtctgtgacctcttgaaagaaaattatttctttagtgttttagagggttatcacagtaggggtaaaacaaatcatgctctctgaacaaatgaagtcccattaattcttctgtttacacaaccccgctcaagaattctttcacatcaagaactccctttaagtgttcaacttaatgcctcattttacagagatttgtctcctctccatccttagcaggcaacttagtgcagacccgtctaagcctataggggaattgctgagctatgttatttcaaataattagttaacttcagtttttatggtctgcaagagaaattctcatgtgattacatatccctaatgtaacaagaaaatgaaccagatgtcctaatgctcataaaaattctcattctgctgacccaggactgtcattacagtgcaatcacacattgcactgagcttgcacagtgcatctgtggtgtgctggcagggcacccttcctccccatggagggcccacactgtgagcatgagcaagagtgcagcaggacatgggaagttcaaacctggatgggttgaaaaggacatctgtgctaatgactaaacctcatgtctctgtctgcatttatttcccaggctgatcgaggaggaaagaaagcagggagttgggaaattggtttatatttgcaaccaaataatcctttgagccttgcaaatttcccttaaaagataagggagcattcatttgtttaaaacatttcctagcattgaacctcatcaattttcagaaagtaaacagaaagtaatgtggtactgttgattgtactgagtggcagaaacataaggaaattataggaaatataataaatgggagagtgaatgtttaggggctgttgagcaggagaaacccaagaagtaggaatgtttgaagaggacttttgcttgcttatcatactctaattttccccatggccagcgtaacacattctagaagagggcctagcaaagcaatttgagtgacaagagacaggtgggttcagagaacggcaaaggggccaggtcttggattctggtggagtagttgccaggagtctattcttttagggagccaaaggggaagaaaacagctatgttaggagagctggaaatcagtgtaaattgtcatgattttaggacccagaacattaatcaagaatttcagccaaaattagggtttggggagcagccaaagaagcatcccatccataatttactgtctctagttgataaaaaacaaggcaacaagcttttcttcaagctattatttagacatatgtgacaatataaagtaaaaatattaaaaagattttaaagagctaaaataggattgaagtgtgaattgtaaacaggtcaagctggtaactcattttatgaaaaaaaaaaaactatttttttctgaattttctgaggatttgaaactcagtttggagagcattcatgttatgttcaatatacttctctagctccagaaggcttatttatggtgccaatgcaaagcagacaactggagttaacaatcactctggcaaaacgtcctgtgacattttacatttttacggaaacaaacaatgctgtttgtctccatttacttagtgcctgatacatgtgcatacagagaattgtgatttaattcaatgttctttatttttcaaagtttgcctttatgttgagtataaacttaccggagatcctgcaaatcccacttcaccaggatttccatttctgccaggttcaccctttatggaaaaaaatgtaggagattgggaaggcaaaagtgattaaaaggttcttctctgaaactaaatgataaataaattactaataaaacagtcttctttagaaagctaatgtacaattctctaaacagtgcaaaaaataaagtaaaaataggctctattccttatattcctgatagtactccattctatcaagttagtctgtggctttcattaatttacccagaagaataaattgttgaaaattttcttggtctgatgtagctcactattttatgaacatcaaaatttatacacataaacatacatgtatgctataggatatatactatagaattctatatgatcacatgacactgaattaaagtattgcttcttaaaatactactttccatttctttcctgtggttaaaaagaaaagactatcagaaatatgtgctctatgtccaaattcaatgtaacctgtttaaataaatcttatgactcataaagagaaaatatttattaatacttggtttagtatcatatagaaattaatggcctacccataatttgatcctcaactttggtacaactaagaatctagaaatgtaagtctgctattgcacactgttctctgattacatgttcttaatgttaaaatctggagttgggtcttaactttaattaaaaatccaattgaagaaatcattttttcatcattggggagccatattggcactatactactaacacgttttaaaaattccttttaaataagacctcataatgatgtattgccatcagagcaacatattttttctttcaggtaatttcagtggttccactaggaaaagttgttgctactgtgacaacaagcctagcatctaatggagaaatcttaacaaaaacccagggaattcaggaagagacagtagtacctaataacataatactacgcaaattaagagcccttttagatatttgtaaaattccattctgagtgctcctgtttacattgaatttaatgcaagctaaaagggtggggaaatgtaatggaaattaatacagaacattcttgttaacattttaaccccttcgcctcttcaaaacctgaatggaaaatgaggaaaggtagcttacatcttccccaggtttaccaggagggccctctggtccacgtgaaccaatcggaccctaataacagaacaaaacaaaaggaaaaaaagaatatttacctttacttgccagtaatacaattcaaaacattattgagacaaatgaaatgtcaaactattattgaaacaaatgaaaatgataaatattgttgagacagagaaaatagttttattaaagttttgaattttatgttgcatccccagatcatgtgctcaacaagaagtataattgcacaaaagcaaatcgctcagcactgtctaatgatcataatctttgaatgtaaatattctttgaatttttaaatttaaatttaaataaataaatttaaatagtctttgaatttaaatattctgctatgagaaacatatagcttaagaacagttcatagaacaggactcccaaactggattgttatttcttcctacattagggaggacctgggaagataaataactcaatatttgacatcattataatggtggacccaaatgtaactgggtctacatgcttacttgacatttaccattggtccaggatcaccaggttcaccaggaggtcctgtaggtcctgcaccaccctacagttgaaaacaaagtatatatacaaaccaaggaaaaatagaatattaaaccctgtactctgtcaatatacagtgtaattgtttagacagttggctctgccatcttccagctgtgtgactttgggcaagttacttaatctgtctgtaactgtttcctaatgtgtaaaatcagaataatattggtacttactttattaggctgttatggctgctgaagtaattaatgtatgttaagaacctagaatagtgctggcacagtgtgtgagtgctccatcaatggtagttctcctcatcaacatcatcatcatcaccatcatcaaccacattttctagtcactgatagcttgaagtaaaactccacacacatgacaatgacaatgtggtaaccttgactgaactaaaggttattttcattctttcttttaaaatattatttcctgatgcctgttaaattgctataataaataaaaatagttctacatcactattttactggcatctgataggcattttaaaagcatattgtattatattcttcctaaagatcccatggaacaaacatcttgattcttatttctaataatactacacggggattgcctcctatgatctgatttcatagcttcagagttggcatataaccaattgtgaacattttcatgacataacataatgaatttcttacttcagatgcaaagtcatgtaattttgttatcgaaggtcagtcacataaagaaatcagatgataaaaatttatcccaataaactttgcaaagacatgtggcatatatttctaaataaaaactatttaatatatcctgtttgaagtgagcattacaatataaaattttaaaaccagccaaaagcagtcatgtcacagagaccttatgtaatatatgtgtgtgtgtatgtttttcttacagcatgtaattaattataaagagacttacttgctgtccttgtaaaccctgtggtccccttgggccaacaggacccttaaaaacaaatgaggagaaacgttgcaaagtactcatgacaattaggtcaaatatttcaaaaatgttgaatcatctctagaatctggaaaagtgaagttttgacaaagggggatgatgacattctccatctgtactcatttggaaggcagctaaattcaaggagattaaagcttggacaacatttgggatgattttatacataacttcagtgttataaagagaaatgagccatatgtctgtacacacccaatgtctttagaacaagaacacttgcatgtttaatggatggttctgttaagtaagaacatccgaataaagaaaaatcttggctgacataagttagttctcaaacttcctatttaattcttcagattcacagcagataattcttataacttaaataagttgaattaaaggtttatgaaacatcaacaataatgactagattatattaaatgtgagttgaaaacgatttggggcactgagtttcctgggtgatttctttctttcacaacatagattgaaactatccacacaggctttcctcatttaaacatgaaatcgttccactgaggcataacaaaaggaagaaaacaaaaatgcgattttagaacatttattattatatgtatattactattttttaaatatcatactttaaaaagtaaaataaattaaaatcaaatttattctttttggatttttttttagacggagtctccctctgtcacccaggctggagtgcagtggcgcgacctgggctcactgcaagctccacctcccgggttcacgcctcagcctcccaagtagctgggactacaggcacctgccaccatgcccggctaattgttttgtatttttttttttttttttttagtagggacagggtttcatcgtgttagccagaatggtctcaatctcctgaccttgtgatccgtctgccatggcctcccaaagtgctgggagaacaggcgtgagccaccgtgcctggccaaaatcaaatttattcttatggcaagattttaattttttattttgaatggaacatatagtaagaaaagctccatttaaaaaaaaccacacatatgtaatttaaactccaaatggataaaaacatgcaactcaaaaaaaagttcccaaaagaatcactaaatgatgccatattactagtaactttaaaaatatacaaataatatttaaaatgctcacaacgctggccttaaggatggatagaaggggtggttatctatgaggtctgattttgcacttcttattgcctgaaatgctattaacctggaattattttgaactatgctatgagcaataaaacatgggagagttggttttaaaagtgttaatttattcaataaaattggattgctccaaatatccaggaaaaaaatgggagtctttctgatgttgaagaaattcaaaagagggtaagaatattgagaagactcagccaggaaaccatagagctgttggaataaggcagccagaggatattaagtagaaaataataaaaatgaaaatagcaaaacatctcatttcaaaattttaccaaaccactgtttctaagagcaccataaaatagttctgctttttatttataaaggtttaggttttactattgtggctgtggttatatgtcttaaactcctttattttcttccaatattaaataaaatgtacagatagacctttattaatgtcagcactttgcataattatgaatgaaacacactgggcttttaactggcatacagtagagtaaataagttaattaaatgaatgaatgaatgaatgtacgactgtgtttaagaagatgcatgttattctttgactagttaactcaagattctctttttaaaataatttttttcactgaagtacttcaatgatcagtaaaatttatgcttaccacagagccaggcattagtcctacttgactcccaagtccagatttttcatccaacccagccatttgagctgaaaacggctgtaaaagcgatatgttgacattatttctacagtaaaagacatacatcaacgtccttttcatatggataaatgtacactctctagaattcttatagaatgactcttctgagaatcattctaagtgcttgactttaaagcctggaaaaagacttaagttgctttgattgtttgtgctttttattgaccattctttcccagagtattgtataagtatgttgctccagagcagtttctgaaacagggcaaatgtctgatacttgataaaagcatggattgttctgataagcactagccagtctaattgattgcaggtttaagtctctttaactgatttcttcccacagttagagatgccaaacatctaaacaaagcctaaaagatgcctttaaaacatttgtcctaaagattccagattccattttggactgtttttggatgatattctttctttgttcaatgcccagtaaactttaaattacatttatgtaagttgataacacttttatagtccttttaatgaatccctgaatgttccaagtttggaaacagtttgacctactctctttcacaattaaaaaaccctagtaatcaaactgaccaaaattgttcatatacattttagtagtcacattagtttccaaattttgttaggaaagaatgtgtgtactgtttataaataaattggcaatttattctacaatctgttgagaaaaatgtgtatgaacttttgtaaagcaaaaatcatattcaggcttcatatgtttccttgttaaggtctcaatctacaggcatgcctcattttactgtgctttaccaatattatgtttattacaaattcaagtcttatggcaaccctgcaccaagcaagacaaccggtgccatgtttgcaatagcatgtgttcactctgtgtctctgtgtcacactttggtagttctcataatactttaatattattattgttcttattatatctgttatgatgatctgtgttcagtgatcttgatgttactaaagtagttgttttaggtgccttgaatgatgcccatacaagacaataaacttgatcaataaatattgtgtgtgttgttctaccaaccgggtgttccccatctctcttcctctccatgggcctccttattccctgagacacaacaacattaaaattaggtcaattaataacccaacaatggcctctaaatgttcaagtgaaagaaagagtctcacatctctcactttacattgtaagctagaaatggtctagtaaggaaggcatattgaaacccaagataggccaaagctagacctcttgcagcaaacagtcatccaacttatgaatgcaaaggaaaagttcttaaaaaattagaagcactacttcagtaaacacacaaataataagaaagtaaaacagccttaatgctaatatggagaaaggtttagtagtctggatagaagatcaaaccaaccacaacattatcttacccaaaatcgaatctagagcaaggccctaaccctcttcaattctgtgaaggctgaaagaagcaaggaagtggcagaagaaaagttggaagctagaaaatgttggtttatgaggttaaaggaaagaagccatctccataatataaaaatgcaaagtgaagcagcaaatgctgatgtagacactgcagcaagttatccagaagatcaagttagcatcattgatgaacgtggctacactcaacaatagactttcaatgtacacaaaacagccttctgttggaagaagatgccatctaggactttcatgtttagagagaaaaagtccatgcctggcttcaaagcttccaagaacaggcttattctcttgttaggggttaatgcagctggagactttaagctaagaccagtgtttatttcttattatggaaatcctagcatccttaggaattatgataaaacaactctgcctgtaccctataaatggaacaacaaggcctggataacagcacatctgtttacagcctttacagcattgtttactgaatatttcaagcccactattgagacctattgctcagaaacaaaggattcctttcaaaatattactgctcagtgacaatgcactaggtcacataagagttctgatggagatatacaaggatattaatgttgttttcatgcctgctaatacaaaaaccattttgcagcccatggatataaataaatttcaacttttaaatcttattacttaagaatataatgttcaaagtaaattgagaatcttctggaaaggatttatcattctaggtgccattaagaacattcttaattgattggtgaaaatataagcctcaagagaagtttggaagaagttgattccaaccttcatgaatgaattttagtggctgaagactgcattgggggaagtaattgcagatatgatggcaatagcaacagaactagaattataagtagagcctgaagatgttgcttaattactgtaatctcataataaaactttaacagatgaggacttgcttcttatgaatgagcaaagaaagtcgtttctcaagatgcagtctattcctggtgaagatactgtgaagattgttgaaatgacaacaaaggattttgatatggcaaacttcattgttgtcttattttttaaattaccatagcaattccaggcttcagcaataccacccttattagtcagcaactatcagcatcaaagcaaaacaccctatcagcaaaaagattatggcttgctgaaaggtcagatgattattagcaatttttaacaataaggtatttttaataaagaaatataccttgttttttagacataatgctattacacactttataacagactatattgtggaaaaacataagtttatatgcactgggaaacaaaaaaaaattcacataactcactttactgcagtatttcactttattgaggtggtttggaactgaacccacaatatctccatggtttgcctgtacttataaatcccctatgtctgacattaacaattcaaagaagtcggtattgaaaggctttttgtttgactttacttcaagtaaaaaaactaaaattgaagaaataattaggtgtcatttttagtgtcaactcaatggccttctcatatccctcatcatggatgtgtcatcctctcttgtggaggatacggagcagatttttttggcattctgagcctagagaataggacagataaatctctcatttcatttaaagagggggaaagcagtggttctttagaatcaatagaaaaaacaaagcacatagagtctagagctgacattgagaaatacaaacaatttgaagcagtactttagaaaatacttcttccaatttttccaacaattccctgtgggtttattagttctactgtccatagcagtgttgaccttatttaactgctcttacagtcaagtgtcaatatctgaacagacacaatttaaaatcctaacaatatatcaataatttaaaacatgacctgtacgtgacatcaaacaatgcacacaactcaccctgctcaagccatcgggtcctgggtgggacggatgtccaggaggtcctggagcaccaggttgaccaggaacacctggttctccatcaattccctgaggtccacgagggccctggaaaacaagccagttaaaattagaacccactgccaaatatacacttagtagaaagctaaaggcacagacttcttaatggcaagggagtgtttattattttaaaaatacatggcaatctagccacttagagtaatttcatcagccatgtcactactgatttcagcataggtctgaacttctaccattcggatgtggtctgggtaagaattttatgtggtgtgttaaatacccagaaatcagcattcttagaataattatttttaaaattttcagttcaacagtattctaaagtgaacttccttatttgattgagtttttgccgtgcaagggtatttgatcaacaattataaattcacttgtctgtcactgaaattacagtggattgtcattggattacagttaactatgtatacgtctgcttaacttctcccttccccccaaaattcaagaatcccttgattggagtttgtagagattttctgtctaattgtttaatgctttgcatagttcctggtacatactagacactcaatacatgcatattatattgttacctttcagtcctctttaatactttaaagcctggcacactttattttacttcccacccccagaggaagactagaccattgagaaattagaggcaaaggcactgtgacccagccaagtctaagttctcagagaagtgagcaatgatttctagctgccaaattccacccttctcctaacccacattctgaaggcagcttggggaacagccacgtcctcagttctggaaatgctccgtcctctaacctcatcattcccacaaggctagttaagtattttctggctccttaaccctaaagaatcttgaaaggcttcaaaaagaaaggaccaaaaagtcatcaggcaatatgctttttataattataagcagggatcaagggaaatatggtaaatgaagtttaatagttaaaaaaagaactcccatgcttaaacatgagaatacctatgggaccacagtaagcaattcaaataggagctgatagtgcagagggagcaaacacaggacaagctcaggtggtggaggtggcagtttgtatatgatggttttggggagggtggcatcatagctattcagaaatttaattattttaatatatttaaacatttatatagacatatttacttcttgcagtagtgggacaaacaagcaaatttatctattaaatagaagtagaatacttagcctgaaaaacttatatttaaaaatgatatcttagaaaattattctcagtttttaaaaatcaaaacttttctgactcctaaactactaacaatttacttcacacttcattatacacaacagaggctgatttcaattgttctctaggactcctggatcatatgaatgagagtaacatgaactggatatgtatatgacagcacagacaaaataatagtctggtttattcatacagccttgtgtagaaaactctgattctgttcttgcaatgctcagttgctaattaataaccagatattattacatacaaaaagtgaactaatgcataatctctgctcccaatgagagttccaaagagacatacacaaaactatatttattgtcaacaggagtggagataagtttgagaaatattcattagtcctccaaagagattgtgactttctccattcttctgtaattaacacttcgtatttcaaagtctgatcctaagattgttttcattgacttcagattcattatatgtctccacggaatgccctctaaatagcttatgaaatttactgttgcacagattaagattaaaattaataaaaacgtctataaaaattatctaaaattaagtgaacacaagaatgtttaccggtaaatatcaaaagcaaattagaatttgggagctcattaaaagtatctatttttatatctccaagtgagctgaattacataattcttatattaaggtaaatgttacatttattatcattcccttccatttccaagatactcaaatacctccgcagtaatctacaataaaaaagtactttgaggttgccactaggtggcgatgtttaaacatccacaagtagaaaagacgaatgaccgggaactgttaaagaacttcatttctctcgtttctctctctctctctttctctctgacacacacacacacacacacacacacacacacacacacacacacacacacacacacacataaatgttatagatgttaagatctagtatatttcccattttacagatcaagaaacataccaatagtggttaagtgtcatgtgcaactagaacttagcacatcattgacggtccatctcctgacagtttgctagcttgtcactatgaagttatctgaacaatacacttaaaactgaggacgtgtgatgagagacagtcatgaaaatcattggctaatcctgaaggtcttgtaggagtatctcatactgaactactgacatactagttctcagtccagagctattttgcctggatttggcaatgtcaagaaacatttttaactgtcacaattgtatgggggatggcagtttcaactggcatctagtgggtagataccaggaatgccgcaaaacttcctacaatgcatatggaattatttggcctaacatatcaatagtgttaacagtgagaaaccatgctgtacattgtgagccttccgtactgtttgatggtaatataatggtgggggtgggggaatgctatttatgatattgtgacagccataattttagtccagctaagcagctcccagaaggcttgagacatgaggcaaaacattctacctatgggcattctgttacatcatgcccatcatttcatatacatcatttcatgcaaagctatacatcatttcatatcttgaaatcggtgtaggcaggcattaaaagatttgttaaacacttaccatcacaccagttctttgctaggattaagagaggaacagatttcctacttggatatctgccagggttgtctcacttgattcctcctaaaaatctacccccctttctccctctctctctctcgctctttcatacacacacacacaaacacacacacacaacacgcacacacttatacccaattcacattgattgtctcaggcctaaccaagacaggaaattgaccacatcacaaagtcaaatagggaaaataagtgagaagggttggggagtagattctttggatcttaaccaggaactctggaagtctggtcctacaacaacttctacctagacttaggacccaatgttatcaattacttacagtgtacaaatacaccaatgcaaaatctttttttttttttctgtcacgaccacccatcctccacccaactgatgttattttctacctatttctgtctttctagatctaggagagacatctggagacctacagcagtgtttaagctaccaacactagtgagaaaactcaatacaaccacagtgaagaatggggcatataataatctggacacaccccaagatatggccaatctcttggggcactgctttgcacctacatgcctgcaagtaacatccatagtgcagccccgtttaagaaaaagtactgacatcacactatatatgaggtgaaatgagtagaaggataatgtagtaacaagaatgaaactagtggcaagagttcctaggcatatgatctaaaatatattttatcctcatttatatattcaaacttgtctgctgtttgcttatcttctaatcctcccatttaaatatggataaatatatatttaaaaggataaaaatctactgagagttttaatagatacattagagaaaaaattaaacagtacaaacaaaattttctaattgaaacatgggataatgggagcaatatacaaatgaatacagttatttagtatatgaaagacattagattttagaagtgatacataagaaaaaacgttgtagggaggccgaggcgggcggatcacatcctggctaacacggtgaaaactcgtctctactaaaaaatacaaaaaattagctgggcatggtggcgggcaactgtagtcccagctactcgggaggctgaggcaggagaatggcgtgaaccagggaggcggagcttgcagtgagccgagatcacaccactgcactccagcctgggtgacagagcgagactccgtctcaaaaaaaaaaaaaaaaagaaaaaaaaagttgtaactctaacacttgagaacaatatgtattctgtgcagataggtaataaaagaaaacctttggtatatattatataatatcctcatgttttatctcaaagatattgaggtcactattttattgtaaaggtatttcacttgtctagtaatgggattgctgatttttaaaactactcctttgctatctctgcagtggctgctgagtgaaaaaggcggagtgctacctgggaaataaacttgttgtgcaaccacttgaaagaaaattttatcctctaacaattttttcccgtatccagcttggttattcctgtggcaaccacagatcatataacttggatgttttatctcaacagtgcattcttggcattgcttactcatgagtgaaactcatgacatgttaactatgcttccttaagttctactttattttgatttgacctcataagggacaaggaaatatcatttgtgttatctaataagataatatacaattattattgtatttttgtaaaatttaatggaggtgaaagaggaatagtgctcccagcttcttgctgcattcagagaacacagtgtaaactgactggctgtacgttccccacaaggagccctcctgtcaacttacaggtcttccttttggccctcgctctcctcttggtccctgtgatcctggaggtccctaaaacagaaaatgatgattatgcatgcaaaaatgtatactttcttattgaatttttaaaagtctacttgataaaagaaaattggaaaacagaaataccacacttaattcagttcagttgaagactatagagaataaagccatgtgcatataaaagttctgtacgcttagaagcgttgtttatgttatcagtgacatttaaagacctatgaagaactaggtgcacattatggcatcatggagcatagtgagctaaatagattagcttgactagtaattgcaaatttttaaggatcatatttgctgtcttctcccaggtaaagcctttgccactaaactctgagcacaaaaacttacaattctgattttgaaaattacataaatgtgcaaaatacaaattatcaattattccagggactgtatgaaatcaaattggtacatgataccccaaaatgttcatcactgttcaagttgctgataaaagcaatggaaaggaaagcctcttagcctactacagtactgctttatgtacactcaagcatcttttctttttactttacttagaatattgcattacttcccttgtatgtttaaaacccacttagaaatttccaaatcttaattacagttacttttcccttaaataacaaatgactattatatttcaaaagtggtgttattgtgctgatatcttaaaatgtttttccccccctgggaaatggctgttgccagggggactttgtttctctttaaaagaggatttaaactgagttatgaagattatattgtgtatttactcaacccaacatatagcatcgtttaaaagtgagggcttcagaagaaccagagtgagtccattaaagctaacttagtattttaagctgatttgatgtgtttaacatttacatgaagtgtgtgtatatgttatgaatactgctgataatccaaacttgaaaaaattaatcttttatactaagccataaatatgctctcctgctgtatgatttctcaaattctactgcaatatataattttattaagcagataaaactagcctaccattaatcatagtcaaacaacacacaagtatgccctaatttcagtgaacaaagtcacactaaaattaacaaatgtaacaataaagtgttttgtcttttacataaccaatagcaagactaacataatgtttcttcagtttcagaataaaatgatcccttatctaccattcattgctgcaaagcaatgtctaacttgaagatggtttaagacaaaatgttttaagagaccaagtatcattgtttaattcttttatcttctcatggatataatatctgtaaagattttcagtatctcaaggaatacaagagtaccaagaatattgggagaaactacttactgccggtcctggacgaccacgtatgcctgttacctaaacaataaacaagaaaatttgtaaaggtaaagtttctgcagatattcagagaggtcaatagtaacaaataagaataacaacaaaaaccacagtaatttttttaacaaatggatgttgtcaattgatgaccatttcctcctctccttaagatttaagatattatctagttttaactaatatagggaggcagtgctggcgtaatgataaagagcaccaacactggagccaaggggcctgggttcaaatcccgacactaccctttaccagatgtgtgactttggactaattacttatcctctctgttcttaaggatcttaagtggaaacttaaatgtaaaatggtagtgatgattaggtaattacctccctcatagagttatgaagacaaataaataaatatttgtatttgtaaagcacttaacacctaagacatagtaagcacacataaatgctttttaaaattaaataaaacaatatgaattatttaagttttaggtaatcttcgttaaaaaaacaagccaattaaaggcaaatagagaatgtaaacactgctaaataaatcaacatgcatattctttttgtcttgacagactgatgataacacctttaaaacttaggagaatgaggccaaggtgggtggatcacttgaggtcaggagttgaagaccagcccggccaaactggtgaaaccccgtctttactaaaaatacaaaatttagccaggcatggtggctcttgcctgtagtcccagctgctcgggaggctgaggcacaagaatcacttgaatctgggaggtggaggttgcagtgaactgagattgtgccactgcactccagcctgggtaacagagcgagactctgtttcaaaaaaataaaaataaaaaataatgaaacctgacagaacgacagttgaagagctttaatcctgtttagtaacatacttcttgatccatttacaagtttaaagaagtcttaggaattcttatgcaacagggaattttgctcaggatcagggcatgatgtatttccagaagtgtggaataataaactactatactaactagtactaatattaactatcagtgtatatccacatgtaatatatttaactttttaaaacaatgactttctacctttagtcatgggactataaaagtcaggaacacagaatatcaaatattgtattaaataactaatctgttctggtttgcttgtgttatactaaaaacttgtttttaaaataactaatttatttttgaaagtatgtacataagcaataatatacaattatactataagctaagtttatttaaggtacaaggaaacaatgattatacatatacttacaacaggcactaatcctggttctcccttttgtccctgtgacattaaaaacaattcaaaaattcaattagcacaatataatggcttgctgggcaaaaacatgtcaccctagaatatgccatgtaaacacagggaatttctatgtaagaaatgcaaaaaactacaaaaagaaagttaacaatttttaggatatttagtcagatattactcattaaaatattactgctcacctgaaagacataaaaaaatccagcgtgtgaaatatgtaaagctattttgcttcagtttccacatagatcaaatccaaagagttgactagagcacaaaatagttgcaacaaaaagatgtaaagacaaagcaccagaggaaaaactactgaaagactgaaaacacaaaaagagccagaaattgtaatacataaaaattaatataaattaatatatacaaattttcacacttttatcatatgacacatagttttcaggatctaatcagatgccattcctgaactactagcacccttttttagtactcatggaagggcattaaaaatgagtacatgtgctcatctttaataaaaagaaagaaaaaaataataattccactcagatgattctcaatacctgaagaaaatctaggaaaaaaaatcaattgactaagaaaatcaaaaacaacataagaaactatcatgtaagtaaatagggtcaggtcaatataattgcttttataatagatatagcaaatgtaatagatgtagatagaatttattttgtttcttagaacttttctcagaaatggaatcctcattgcatgatatcaggtacatagattaaataatattggatgaattgtagctttatctatttctacttaatcatttactaatttgtattcttcatttcaaaatttgtcttcgaacagattttggtctcctcaaagtcatggttgtgtcttagtctacttcacatgctcagcatagcaaatggaagcattcaatgaatttttaaaatgtattactttccattaatatattaagaaataatgctttttactgggcaattgtgtaggatgaatatgaatttaacatctctaaaatgtagaaaaacacaagaagaatgagttctagtttattttatttctcctttcatatatattatcctttaatctgattataaaaatactatgtgttcatagcaggaaattttgaaaatagaagaaatattttttaaaaaaccctaaatatcctactcaacaccccggagataaccactgttaatatgctggcattcttagttttccaccatctacatgcactttgagtatctaatcaatgcctcattatcttactcttaaattttgttttcatttttaagtttaagaatgacattaaaatgaatatctttgtttataaatgtgtccatggtatctctgattaataccttatgatatgtttttagaagttaaatttgtggactaaagacattttaagtttttaacccatatcaccaaattgtactactaaagatacaatctacttatatccttccaatactatcctgacaaaacttcatgaagtgaaatgatggacttaagggcggaactaataataactcagtcacagttgctgattctaatgttgaagcagcgaatactctggaagtaaggaataaattgagaatccaaaagaaggaaagggctctccagaagcaggaggcagttctatagggtaagttcaagattgaaacactagggactaatagccaacctacacaaagcctaggacaagaaagaatcaacatatatgggcttcaaagtaaaataggcttatttctgcatgttcacatccactaacttctagagtctttctattttaaaaaatacaaaaataataaaatttaaccatgtaagagctataataaaagatatttttcaaaatgctgaaagaatttgaattgtttagaaagggtacataaatttttgtgcaataaacaaaggactttatgatgctgaaacaatgctccttctagaggaagactagaagaacaaataaaaagagaggacaaattgtttcagtcagaatgagaaaaatggaacagcctgctaagaatagttgtgaaatttccatcctaagagacctacaagcaaaatgcactttatacttgctttatatgtaggggaatagaactctctgatacctgtcttacctaaattgtaggctttttgatatatgactgttctgttgctgcacaatatttaaaaggggttaagtgttcaattataagtttctaataataaattccctaatgattctatagatttcttattttggatataagccacaaatgtaaatatttgtttctattgtttgtattaatataggctttgaataagttaatttgtatggaataatggtctgtctaaagttttactaaatttaattttcatatccactgagaaacataaagttcatgtactcagatccagatgtgcattacaattacttatcatttaataccatgtggacatgctttgtagaatgtcattaccatggaagcagttatagtgtttttctcacatttgcatcatctataccatttgcctcatagccatataaaaaaggttcagtaattatgttggagttaacatgaattaatgaatgaatcaatcggtcaatgagttgtaagtaaatatcaaagtggatataaacgaagaacaaattgcatttttataacattgctttgctcttgtgtttctgatgatacctgatgacaaatgaaaacaagtcatgaagatagtggcacataaccacagtctgctacattggcagctgctttgagtatattcttcacccagctctcccacactacttttggagaaaggcagcaaatgacacagcctaccagttatctctctaagtcgggtaactgctaactgaattaaaatgattatttcatggcagtactcattgttaggattttttgttgtttcatagattggtctgtctctctatctgtctatccatgcatccatgcatccatccatctatctttcacctatctgtcaagtttgttcaaggcctataccaatctgctaagtttcaatttattttcgttttcacaataaattaaatgtgaaatagcatttgcagcccttctcctttgacatatattcatatctaatttattccaaatgagacaaatttatgatattgccctctgaatcaaaatgtgtaaaactggccaggatctccccttgatagcatcactcttacttatcatgaatgtgtagcattgctttatctgttatctgataaatcattttattaaagttccactgtgtgcaaaagtaaagaaaatttatggaaattgggaccagcaacagtttctactgccttgatccctgtgcccatctcatttggatacaactgaagtaaatgccataattttcaagataaccaaaaaacagagagcactcttgggcaaaaagaactatcttcgcttcgtaggattaccttattgatggcaagtgaccaagctgaccagctatactcgggtcatggatgcagcctaccctgttttcaagtgtaaagcttgtgtccagaattagattttaagctctctgaaggtgaaggaggggagaggaggggaagaaatgtctgtttggtaaaatgttcaattaattctggatctttacttcccaaccaatgagagaggggctacaggcccattgaagtcaaattgacattcttcgttccttccttccttcctccctcactttcttccttcctccttcccttcctcctatcttttctttcttccatcaaatgtgtattgtacttctaatatgtgcaaagtatgtactatgcaatgacaaatgcaaagaataaaaggttaatcagacattttcaatccctaaagatgtcacaactttctggcagaaacagatatacaaacagaaattaaccataaagtgaatggttaagaggcatctgtcctttggaaacacagtagctgaactgtgcttatatacttgtcacaatgtatttgtatggtactttgtacttttcaaaagctttcaaacgtttcagagcacagttctgtgtggatagtattggatataagtctgcttatgaaaaagaaaatatgcaaagtaacacttacctttcttcctctacctgtaaaaagaaaagagtaaatgtgttattttatgaggaaacaattattgagaatctgctaaatatttactttcaataatagatttcttctggagtcagaattacagtgatagtgattacactatcagcagtaagcagaattcaaaaggttttggatcaatacttccataaaaggcaaaaaatgcatctttttggaaaattctaacatgatattaatattcttcacaacatttatatgacatttaaagttcattaaattattaaattagctattaaagctataatgaattatctttcatcaatattctccatttttgctttttataattttatgagcaaggctgtttattcatatggttcaaaagcaaaaatgtattaaaagtatacaattatacactaaaaaatgtcattccatctggtcctgtgttccctatttccactttacccccacccccacaggaggccactattattggtttctcgtatgttgttctcaagtttagtttggaatatttaagaaaattattacagactcatttttctactttttccatactgttcttcacttgtctgtatatcacatagttcattaaatcttacagatctttgctcatcagtatatagtttctttattgtttttcttaatttttttataagattccactgtattaatctaacacaatctatttaactaattttgacctttacccattagggacatttggattgtttctaatcttttgttatcactaggatgtactttatcatctaaccaggacacttttaagaatgaaagtgaaagttattgtttattatgccaagaaaattgatgtaatttggggttttcctaggcaagctagaatgaaggtcatgctggctattaaaaataatattgtaatgagtaattgttacgtatacgctacatgcaagtatatttgtaagataaattccccaatatcctttttgagttaaaggtataggcattggtaacttgatagatactaccaatatcctttcatagaaattataccactttacactccacaaataatggacacatttccccacaggcaatatgcagtgatacccagtatgctatcaaacattttaattttggccaatctgataggtaaaacatgatagctcagtatagttttcattcacatattttattatgagaaaatttgacagttttgtcatatattgaaaaatcatttgtatttccttgttcgaatgattagctaatttcccttgcctatatttttattaggttattgatattttaattatttatatctagtatttctttatatgtaaagaatattaattctttgtgaattgagttgcaaacatttctactttgctcattttttgtgtcacacaaatgtttattatttttgtacatttttatgccttctgggctttgagtcagaattcataaagtcatatattttagaagactataaagaaattatcctatgttatctttgaaatcattatgatttaatttttctcatttaaatcactgctttatttataatttgtgctagtgtagaatatatttttattattcaacttcatttttttccagatgattgcctagccattccaacaaggtttatgaaataattcttcttttctccactgctacgatgccatctttattgtattcaatctgaccatgtatatttggatctacttcaagattttattttattcatgtatctacatcacattttttaaactaatgaatcctttttaaaatcttgtagggctagtcatccttaattgctcttattcttaaggatttgcctgattattctttcttgtgtagtctatgaaaattttaacttgcaatatgttgaattctcaaagaaagtgtgctatgtttatattgagatcatgttaaaatcactaattaacttatggagaatttatgtgagtgtaatgtttagtctttctaaccaagaacataataggacattcagtcttttaaatacttagtttgaattagcagtattaaaaaattttcatcagatctcatacattttgtgttaagttatccttaagtgtctgttgctattacaaatgaggaatttttattcctattatttcttctatgatgtaattgtttatacatagtaaacctattaatttctgcttgttaattttgcactctcatgtcttactaaattcttttattttttgtagttttatttttactcaatttaataggtttgtaagcatacaattgtattttctgcaaatggatagtttttgctcctctttttagagttttgaaacctctgatttctttttttaatgtcaaattatttattcaggcacattcagtactgttaaatggtaatggtgataatggatactcagtctatctttgtgtttagtagggatgcttttagtattaagcataatgaaacttttaagttgagatgtaaatattgtattatgttagtatcatttattaccaagttagtaactgtctttatcaaaagtatttactgatcattgtcaaatacttttactttaattatgaaagaattcatatactttctcttcatagatctgttaagataattatttttattaatagcttccttaatagtcaattattttgcacttgtggaataatcgccactttttcatgaataattactctcttaatatgctaatagacttaatattttatttagaattgtaaaaaaaatttatgagatcagttcatagttttttgtgtgtgtcattgttattacttttgctgtaaataatatacttccttcatagtaaaactttgaaagtttgctgtctctttcaatgttcaagaagaggatttaaaagcattaaaaccatctgatttctttttaagaccttttagttgtttgacacaactgtgaaaacacctggacttgctgctttgggaatctagctgctttgcaaatttctctgtttcttctaagaaaatccatgttctaagattttctgtttctaccagagctagtcttagtaaattacattgtcttagaaaattattcatattagttttcaaatttatgaagatacagttgaataaagggacctcttaatgattctttcatgttgttttactttcattaggtaattttttctttatcattttttgctttaggttagatcttttggttgggtttttatgggaccatgttttggatttacatattatttctactatatttcagttttctcacttttcaacttctgtttttatctttacaatttttttcttccacttactttcagtttattttgttgattctttttaactttttgagaaagatgctaaatgcacatacttttattctttctttttatttatataagcatagaactatgattttttgttaaaattttaaaaataaaatgtttcactgtgttttcaagtatctttgtttggtgtgttagaacttcttatgtttaaaaagatttatatattagttctatcaattatattccatattctgctaaattatgttaacattcttttacattactcatagatctgtatttgtttagacagtttctattagttccactaaaatgagcaatgataaaattgacagtgtttcttttttcttacatgccgctcaggttttcttctagcattccattttaacaaggaaatgttctttttagcatttatttttgtagtgttaaatgtgccactactttgttcatgtgatttgtcaggtttgaatgatattatctgactttcacctttaaagatgaggaattaccaaactcactctagttcatactttcttttgcctccccctttcattatatatgttttataattatttctgcattgtcagaagctataatatttacaatcccatctgtcaccctaagttacacttttgttttagtctttttctagatttaaatataataaatgctcacataagttctttgacagtttcttcaattaactcttggttgccttgcatttagccgatggtagtttccctgagaaatttatagaaacaataaccccacagaaatgcttttactgtagcttttatatttgaaggagagaatggatttatatttaactttaattaaccatattatctccttaagaaatatgtatatattgctccactgtcttctgacactggatactgtggagaaatttgtgaccagtcttaacaacttttcccttgagaaataatctgttcttattctttgacattctaaagaagtatttatttatctttaaagtttaatgacttcattaagttacatatgtctctgttaactcttttaggtcaatttttcagacatgtggttgccatttcaatattgacattaaagttttacttcataaaatttttcttgtattatattgttatttgttctactcaattgtattaattttttctttgggtgcccatcttcagggttatcccttgcttgccttctacatctattattttttaactctttaaaaattgtaattcattattttcctattctcatggcccttgctttattttgtgtgatatcaactctccttatgatccctcatatttcatcttcatttctttgtgatgatttgattttccttctatttcttttctgaccattacttatttctgctttatagccttctttcttaaagagaattactttattaagtttttttttttttttggttcacggtaaaatgataggtcagaattttcacatggtctatagcaatatattttctggtgtgttatctcgtaaatttagctgaactcaaccactttttatcttatggcatctgtgcataatgcaattgccagctcctagaccaactatttgaaggagactgtatattttggtgtgttttctgatatttgccaccattgttcccatttgctattcacttatccccacggatttaattttactttattcctgggctgttttgatgattgtatttgctttgggtagctcttatatgtcttggttttaattctttcttttatatatttcttattacattactgaaaagtgagtgtaggtatttacccaaggcacattgtttctgttcaagaagcagagaaaaggtaagttgctatctatttccatatacatactgttgaaacctttattgtatttgctgttatttgcaatgaaattttgaaaaaaaaataaagccttgatattgtcttgacaatgatgaattagaagtctcatgactgctaacacaaataacctgaaggtttaatattgctcttaccttgtttattgaaacctataaatataaacttgtttccctaacatgtatctttaaaatatgtactcatactgaaatacataatatctgttaaacacagaaactttttcttcaaagaagttttaaaagttttactttatattattttttctcctggaaatctatttcattctttacctagccaacatgaaaagcattctgcatttaagagccaatgtaatacagggtgctgtggcactgaattacattaggaataagtattccattcactaggacaaagttggcatcattgtagataaatgtgttttctagatcttctctcaggcattaatggacttaaagggaaactgaaaaataacttggaggcactcatcatgcatatggtaacaaatgatcatcttaagtgattcaagaaattctcagattagacataaccaccaaaattcagccccaaatgcttcagatatttaagaagacaggaaattactgtctgcttctatctaactttagatgaagtgagtgagcaaaatcattaatcattaaccccaaaagccaccaaaaaagctgcttaattattctcttgagttgctgaatgctgaaagtgaaaaacactgcaactataaaggtgagtaactggatcaattatgagttggccctaaacattcttaccaaaattggtattgccacctccaggtgtttgtgaacagacaggacagcattccccagggggcgttacagggtcggcacagtccagcacatcctggcattctatcttgtcacagagaatggctccattgtcacagacacagatctgacaaggggcaggtttccaaatgtccctgtttaagtacatctggccattctgagtgcaggctatttcttcaccatatccttctaaaataagaaaagaaagaagaggttagtaatctgaaattatagaattgagaaaataaaaggtgagccatcttgtggattctaaaaaattctggactaagaagtaaccttccaaggagccaaacacagatgaactgatttcatttcataacaaaataatatgtaattcaccatgaaataatgataatgtatccttgcatgataggggaagaaataaaagtgatacaatggaggtatattttttaaccagataatgcttccttcaagattttattcttgaaggtatgaatgatgaaacatgagaatatcaataaagagggataaaagagaaccatctgaaaatggggagaaaatgaatagctcaaaggagaatataaaatttgaatgtttggtgaaccctattatgacttgcaactcactggaaactttagtaaattccacaacaggagacagtatgttttcatgtaccatagaaaaaaacttcaaaaaagaaaaaggtgtatgtttttattaaaattatttttaaatgtacagtaaaaaagtataaccatgtcccatttcatggagtagaattctatttgatatactaaattgatggtgtttactcaactgtggcagaaatgcaaaacttatgcagataatgagtgaattatgtttgcatcaaaattaattaaggaaaaccatagccaaaataatacagtgagttaatatatatttgtctagtgcttttctacatttacattacaatttaagaaagtttgggaaaatacacacacatatatatgtgtgtgtgtgtgtacacatattgctcaagagcagttctattatacatttactaacaagtaaacacatatattacatcattaactttgtgattttataagaaatactacagaattttaaaacataatgtggatcaaatcatccttgcttaaatacatcaagaacttcccaactacttaaattcaaaacttccttataaaggctaaagaccttctttcccatttcttgcacaacttgaccacttttgcccagcactacctctccttccttcatcccaggcccacatggctatctatcattacttacttcaatgtcatctccccgcgaaattcttttctgactaccctgcaaaaattagacttcctttacccaactgatatttttcagagaccttttcaaagaactcattcactcagccattcattcatttattcattcattcattgtgtattatatgctaggtaattgaagagatactaaaatgtgaacaaataggcaaaaatcactgccctcaggaagtttattagaatgagtattaattttttatttttgtttagtttatctccctcactagagaaaaactagatgaaagtaaggactaggcgtcttgttcatcactgtatttcttttcttttttttttttcttttttaaaatggagttttgttcttgtcgcccaggcaggagtccaatggtgcgatctcagctcattgcaacctccgcttcctgggttcaagcaattctcctgcctcagcctcccaagtagctgggattactggcacctgccaccatgcccagcgaatttttgttttagtggagacggggtttcgccgtgtttgccaggctggtctcctgacctcaagtgatccacccacctcagcctcccaaagtgctgggattacagccgtgaaccactgtgcccggcctcctcattgtatagcttgatgctatacctttcatagaacagccatttaataaatatttgtctactggatggatataatgaatgaatctaaactacggtaaactagtttaattgcacagcatgaactttgtacttcataaaaagatgttttaatgtagttgtaatcagtttatgaaagatattatcatttggcatataaatatattcaaatgataatgcaaagctacatatgaaaattattttagtttacaatacagatattaatacaaaaatctgctttatataattattatttgtcaattataccttaataaagctggaataaaaacatttttctcactgtcctgtggaatattttgctttatgtatttagtctttcatcacagatatttggcaaacggaaaattgctttcagagagtaacactactatatcctaatggtttgtgtgctgttttataagatgaggacacaagtttctaatctgttttatcttcattaaaagacttgtatcacataatacatatctaatcaacaaaacagtattagctctatgtccatagtgctattatagtcatttaaaaccaaggggaaaatagaaattatgttttaatatgcttttctggaagattattttgaaaaaatgagaaatgtattcatcaaataaacagtgtgacttttagatgaaatatcactttaacacagtgtaattccatgaataacatttccaaagacacaacctgtataaaaatgggcttatgtctatagttcactgaacaattccattaagtagataacttaagggtaattttgctcattaagttttatgattgagaaggaaatatccacttacaaatgttaaatgctattacctgaaaatgagatactacttcaattagcttgtttctctcattacacactcttgggtgggggtgctgggagttaagtgcatatgtgcctagtactaattgtgcaaaatattgaaagcatatgtggctgggtgtagtggctcacacctacaatcccagcatgttgggaggccaaggtgggaggattgcttgaggccaagagttcaagaccagcctgggcaatatagtgagatactatctctgcaaaaattttaaagttagccaggcacagtggcttgtgcctgtagctccagctactccgaaggtgaggtaggaggatgattttagctcaggagttctaggctgcagtgagctatgggaacgctatgctactgcactccatcttgagcaacagagtgagacctggactcacaaaaagaaaagacaagaaggaagcatatgtgttcctttctgtcctcaaaatatatattattgtggagtattatatatattatatatgttacacatataacaatatatgtatgttttatatatataacattgtggagtgctatatttgttatataatagatgaatataattaacttattatataattttaattatataatatatgtttgtttattgtataaatcttgaaggagccatagagaacaggataagttatcccctgaagatttataaaatgaattattataacaaaatatgttattattggatatatattatatataaggatatatatgctgatgggataattagatatttggaagcagagaatatgaaaaacaaaaacaagatgacacgtaatgatgtcaattaaatattaaaatatgtgaggaactcttcaaggagtagcttatcttcttccttgtggctcctttagggttggaataaaaagacacattgtctcagtcttgtgttaacacctagaagagcagtttctttctgaaagtttaagacaacataacttcaactcaaggggcaaagaagtgggccactggattactttctttaaatgataatgttaaaggttagttttatactctgagtcatcatggcttcccttctcctgagaatttataattaaatttaagatgatgtggaaagttagttggaatgcttttaaatagcaaggagacgaaaaaccacattcactgttaaaccttgtcttctcttcactcagacaagaatccatacacatcacagagggctcaaaaactcagtgaactctcattgtccatgtctgaatgaaagacatgtacaaagaaacagtgggtagaaaatacagggtgtcttgcagttttcacggatctacatggtagttgtacaccatatgattaagttgtcccttctgttttctacacagacatttacttaaacgaaaagaaaagtaaaatagaaagcaaaattgcagccaatttgttgaaaaatattgcagtaaagttgtcataatagaattattttataaatgacaacacagtataaaataacaaaaattttcaaatgacattctgagaaattcaattctgtcctcctgatttctctatccaaatcataaaattaacccaagctgacgtccaaagcttagattcaaggcccaggacttaaaaaaaaaaaaaaaaaatgtttcttaaaatacctggatattggggccggtcagggagtagggtggggttgcgggagggagagcattagtaaaaattagaaaaaaatagttaatgcatgctgggcttaatacctaggtgatgggctgatgggtgcagcaaaccacaatggcacacgtttacctatgtaacaaacctgcacatcctccacataaaccctggaacttaaaataaaaataaaatttaaatttaaaaattagataaatatttttatataatctaaaaaagaacgccaaaactataattttgcattacttgtattttttgctgtttatgtttaactttcctaaaattgattaggactggtagaaatctgataataccatcactattttgtaattttcatgtttatctcccaacctacaagattcttttaccctcaccaaatgttccaataaattgaatccattgtgaagtcattcccacaacaattgtggcactgatatattacagaaaagagatatattttatctgatcacattttatttgaaatcaactcaatttttctgtttctcatatatcctcatagatttctcttctcataaatcttaagtgcttttaaatttagttgtaagaattcagttcttaatcactagatggcagaccaaatccaccatcttattataacaattagaaactaaattatcacaattgcagcttgccaactatatggtatgccctgcatccacattttttcacacaattacacctgtgggggaaaaaaaaaaagcctgcatagaaacggccatattgaaaccttggactggccaagagagacgactgtatttgcatattaaattattggagtctacttacaggctttgaaaaatatatgaaataaaagtccctaaaattatgttagatattctctagccattaactaaagttctttcaagcagaaataatacacagcacacacgtgttataaaaattttaaatctcttattcagacacaggtttgtgctgatcattttcccctgtgagctgtgagactgtgagctcctcgacagccagaactgtgtttacctcagcaaccttcacatttaatgttatataatccgtctttgataaacgtatgtgtagcattgatgaatgcagatgtgaatgaggaaagtaaggaactagttcattgatatgcctattaaaaagataagcacttttagctctctttcctccttccctaatctttccagagaggatgtgctcttaggaacccttttttgaatgaaagggaatggtcacttggtggttcttaccaggtgtgtccctgacattcaggcctctgtgtgaccagaaaggaagaagactgtgtcagtcacaacagttcatattttagaacaaccttcagaaagctacagcaacccttcagccttcctgacccagcagatttaggtcccttttgggattgtgaagatctgggctaccattacttaaagtttctctgactgtaaaggtccttgagggactataatcatgacactgtcagctggtggcctcatgaagtggagagagaatgccttgtgggacaaaggaggaggtaataaagccgcccacgtgtcagtctggatgccacagatgctgcctttagtaatgcacagcagagcgtgggctcctggatggggttccagagaacctaccaaggaaatccttcccttccttctgctctagggcactgtttatcattagaagggaaagacgaagagggacagcattcaattccttctttagaccatgcagaggagatgccaaaaattccacattcctcattttgctttccttaaacaactcccaaatttgaaaagttagatacatatgaagccaccagggatacctgagggggatctattacatactttgacaatttttttctatctcagcctcaagatctatgggatggtgggaggataagtatgtatggggtaggcctatggggttttacatcttctgttcttcaatccactgcaaagacttttactttctagtgagccccgcaagcttaaatctggttttaggatagttatccaaattattactttttctgtgccctgctccttttttccttgtaccaactgaacaagagtaggcattcaataattatttgagctgagttaaatttttgttccactaaggacaatcatgttttatattctaaagcaatataatgacaattttgaaaattttccttgaaatctgaaaaattgaaaaggagatgactcatagaaagcttcatttcaatgcatttcagtgagcatatgaatttaaaaaatttgataaactgtctgtgaaggtggttggtttcttcagtgcaaccattaaatgttttccaatctcataagcaaagtttttcagttaactagtaaaactgctgtttttactttacttaaaatggaaaaaatagaaaggaaaaactctcatattaggtatacttaagtttttttccatgtatcattgggaaatctaaatgactgtggccaaaacgtgaaactaaaactacacatactgcacatgcaatgctcatctacagttctgtctggaagagcagatttcagtctgctaatgcatttgacatagattttttttcccacatacctcaaactactaaatagctgcaaaacagcacaaagagaattgagccaactctataatctatacactagaaatttcagcagtaatttttatagccaaccttagttctaatcttaaatattaatcctcagtgaataagtttggtacagagctatgccaaatgtgtctgcctacctaaatacatgaaacatttgtaagtgttctgaatgatgtctacttaatctctcctagcctaatattgcttgagatcaacaggagagacaaaaatctgcttaactgtttctctttcaaaggagaagtaaatattcagtaatatatagtatccacattccagatttccttcatctccttctggtcttagctcaaatgttacctactctggtcaccttaccaaaaaaattgcacatgactacacacacatacaaccataacactctcaattcactaattcttactcttttttttttttcttttaatgtagtagttaccactttcaagcctactatatattgaatttattatgtttattgtttgtcaccccatgatagaattatagctctgtgagaacacatataatttattttgcttcctttgttgatatattctgatatcctagaatagtgtcaggatcatagtaaatgctcaagaagtatttgttgaattaatttattgaatattagttgtttgcttaagaagctttatatggtaaagtcatttcataatattcttttgtatataaaaagggatttttatatctaaagtcaattgttaagaataccaagtaagagatctaggccatattgaatacaaaatgatatgcttcaaccctgggctattacctgatttttagagaagcgccattttagctgcttatttaaatgtgggccaaacctacaaagctttaaaataccatgaattataggaatatgatgtattatcatttattcctgacattatatcctaaaaagaacatatatttttactcatttttgtaattgaaaataattattattgtattttaagagaatattcattattgtatactcaatgagtataaaattaaatattttacataaaacattttagaatcaatttaactctgtattttattatgtctttgcagctgcattttgcctcctttttcaattttccctgatacagaagaatatttagggcctctagagaaaatccagacattgtagtcagcttatttcttccaattcattctttattctctgcccttgccttgagcaagttgaaatttcttttacaatccaccaaacattccacagttctcaatggctctttgatcccattcatttcagtaccaaggattctaaaatattttgaagaaaatttctaataggaatttaaagggatgcctctttctgcattattccctctggagctcagttctggaggcatgggtgaaaggagactagtgctgtcatcccaaaggccaatttctaattttatcctcttggaaatatctagtgacttgaattagtattcagttttgttctgctttacacagatttaatttacatctattttctagctattaaaaaagtaagtgattttgctgaagaacaaaactaaaactagattttactcttctttctggcattcctttccaagtcacttccagaacaggtaatagaatctttaaaaaaaaaactgtaattgttatttcagaacctaaattcatctcttaatcttcatatttagtttatcccttataatgtgcataattgcatggaagccaatttatttattgcatgtttaagatcaaaactcaatatgctctgaatctcaaaaccagccaaatgccatagtcatacttggtatgagaaaaagagttgttgcctttattggaaagttatatcaataactttttagatgcacagcaaagctcttcattgggtaatttctctacttgtagggagaacaaaagacaagaaaagcaaacagacaaggaggatgaagagaggaaggagggagaggggtagaggaaggaggatgagacaatcatcttctttccatgtaactttactacatcaagaaggaggttttacaagtttctttagaaaacaacagaattaacctgaagatacttctttatcctattagggaaaatacaaagaatgaatcggagatttttcacctacaaatccatgtgcttctaaggagaagttgctattttccttaacaagtaaacatgggcaaactttattagaatttcaaaagttttagattattacttaatgttattcattcagttttttaaattctgaattttatcattattgtataattcacattttaatttatttaaacatggtgactacgaataaaatatctataaaggaaaacaatactcttgtcattttctttaaatacctgtggaaagatttaaagtttctaaaatctttcaaaaatttgcttaattccaagtaactacagaatacttatttcttgctaatacagtcattagcacatgctgagatcagaggagaaaaatatataacatttcctaaactaaggagtataaaatttagtttggacaaaagattaactaagttgtttactagtcaactggttattactaaattaataaatgaaaagtgtgcctcagtttttctacttgttaacatatagaaaaagataaaacatgagcctttacttttgcagataagaaatatttaaagatgtcataaagaagtttgctttaaagtgtgtttgaaagctcatcctaaatttgtcaatctggaaaaaggaatagaggcattagttaatccatttaatcgatagttatttatctagcaaatataataacaattttattaaatacttgtttagtacaaaagaaaactttggatcagagaatgagacatttggagttcaacttccttgccaaaaacaaccaaaatatacagaagctgcaaaagataatgaattttttgtagaatgattttgctcatatgtgtatttcactagtgcattctggaaaaattacatacacactgaaacttcataaactcattctattttttcatttctctaacctatatgtatcctggggccttttgaattattggtccttatcttggaaatcttcctctgtgttttgagaggttttgtctaatgctgtttattttcattaactacaactaagtctggggaacatcaacctgaggatttcctagaatccaaaacaaaaacaatcttcaatcattatggaaatataaaattctgtttataaaagcaaacttcaaattagtaagggtgaacagaatacagaataacattacattcacttatgagtatatcatctattgattctcctttggtgtcctatttgataatgaaacatattttaaacccttagacaccaagacagtctggatacatagcagagagaaagtggaaacccataaatgcaaatcattcaatgatccctcagaatataccagccataataatggctaaggccacagtttagagatcctctgtgtgagtttcagtcctccctgtatgttttagtcttccaacacctttggcattaagaatgtgtttaaatcataaaataaatacacttattcttgaagcaaacatcaaaataacataatgtatgcattttgataatattgtttatttattcaacaaatatttatctgttattttgccaagcactgggaatacagttaaagtaatgaattcctctctacctttacggagtttacagactactgagagaaccagtgcagtaacagattattagaacataattctttaaatacaaaattataggcaaatcttggttgttgtgggaacatgtaggaagggcatatcatctaggctggaggtcagagaagtcaaaagaaatctgggatttgagttctttaacttccttatttcctttctttaatttattgttttgggggttgcttttttttcaagtgagaaaattaaaatccaaagcagttttttccaaaaattcatttccaaggtgtataatattgttactcctggctccttcctggtaattggcaacagattccttctctctaccaactggccaggatggatctgaaggagaccaggtactccctctcaaccatgactctgattttaatttctttaccatctcttcctttgactgagggtaaaacaacagcactcttgtttctaaaccaactggtatgtccatgggaaggtgccttggaggaggggtggggctcttgcggtggtgcgggccagcagtccagaagccaagacagtggtgcacagcaacatggcaggaaccatttgttgccgatgactaactcactctagccacactgggacaaactataaaagcatttttcaggagaatggcatgaacctgggaggcagagcttgcagtgagccgaaattgcaccactgcactccagcctgggtgacagagtgagactccgtctcaaaaaaaaaaaaaaaaaaaaaaagcatttttctaggtccaattccacagtctttcttcaattgtagatacagaattctggattattgtgttttgacattttaggaagtcaaaaaaatagtataatgtctagtttgaaagaagctgacttttgtaatttagaaaacactgtgaagtaagatattaaatacccatactaaaagtttattttacttatacttagcacatccacttatactcattttcatagattacttaagtatttattgagtctacttactgtatgcctgactatataccatggaagaaagatacaaaagttaaagatacacaagctactccagaggagcttagaggaaagtttataaagtcactcttttaacaaatatttactaagaacattcaaaatgtaaagtatcttctatccagttgtttcttcaatgaccacaattagttgaggtagcaaatagtttatataagatacgaggtttgagaattacaaataagaaatctgaaaagatggtatcactataagctgaaattatctgagaaagggtgagtagaagtgggttcttaagcaggccttgaaaaaatagaaggtatttgaggtggtgggggtaaggaaaactctgcctgggaaagaggcagggaaccacctaaaacaggaatagagagggaggaaaacatgtcatatacatagcttcaggaggggatggtttaatttatcaaaaaaaggaggtgatgagaatacttggtacatgtgatacctcttccactaggaaagttttaacgacatgcccacatggaatttggtcattctcttctcttgctctcatctcaccttatccgtacacctggcaaatacctgcaacattctattacacttattggtttgtttgcatgtaaactctactgggctgtacatttcttgagaatgaaaaatatttaatttctctctatatcatgagtgtattaaagtgcctgatacatgaaatgcttgctgaataaatgaaaaaaggtaataaataaaagaatgtataagaagctttcaggaatattaacgtaactacctaattaaagataaatcagaaataaatgagaccaaaggccactagtggaaaatgttatactggagttaggagaaacagtagttatgagaacagaggtaaagccacgagacactaggtagaaaatacgaagggtttgatgaagtttgggtgggataaagtatttaattttttttttttgagatggagttttgctcttgttgcccaggctggagtgcaatggcacaatcttggctcaccgcaaccttcgcctcctgggttcaagtgattctcccacctcaacctcccgagtagctgggattacaggcatgtgccatcacgccaagctaattttgtatttttagtagagacaaggtttcaccacgttggtcaggctggtctcaaactgctgacctcaagtgatccacccacctcggcctcccaaagtgctgggattacaggcatgagccactgcgccaggcctaaaaatttttaaagataatttcagagtctcagaaatgaatggaggaagaaatatctactgggtactttgggttaaattgtgccctgctaaaagatatactgaattcctaatcctctgtacttcagaatgtgacattatttgtaaataaggtcattgaagatgacctaattagttaagatgaggtcatactggaatatgatgggcccttaatccaatatgactggtgtccttataaggagggaagaggggaatagatacagagactcagacactcatttctgttgtcataagccacccagtttgtggtactttgttatcaagcacccctaggaaagtaacacaggtgtatggtctagacatcgaatgaaataaaagttttggagagataaacaaattttattttaaaaatcctaaactctatttaaggcatgttggagtgaatcttaaggaagaataacccagtagaaatattaatggcagctattaattgtgttctaaaagttatgttaagtgagtgataaaaattttccacatagtcctaacaaccatcctggtagaggcttggggtcaatcatgatcacaaagctagtgagtggcagagccaatatttaaaaaaaatatacgcccataactattatacattgtgttagacaaccagattgctatgttagagaaaagataaggggatggcacatttacatgtacaaaagtcttaagtcacactctaaatgtggattttgactaagagagtggaaaagtgacaaatagagctcctgtgaagaatgaagagcaatagaagcctgggttaaagaaaaaacaggtaaagcatggtttaccttagagatgagaaaaggaagcgattaagaagggtgttttaaaagaaaatgtgtgagaacaagaagcaattaaaatatactaagattgcgaaccccattctttctattcatttcccaactctaaatggaggaaatttcatttcctggtgttccgcctgtgtagccaccaaatgttaccatgctaatatccggtgaaattccccctagcttttctgaggcctcacaggatattgatgggggaaagactatctccatgacatgaataagtctttcaggtattttaatgagtagggatagtaaatgattgcataccaactattatttagttctgtttagattagtttatagggcgcaggaaatgaaatttttccccagaatattcagcttgcattatataaacatgactccgttcagcaaacagaatgcaccatgcttgctatttcacttaaactaaacaggggatgataaaaaagtcactgaggaaaaattcaataaaattcaacattataaaatgcaatttaaagaaaactatcaacttctgctttttaaattacattacattcatgttttcattttctttcatttttctgaagtctgaactagtattttaaaaagttcttaactgtgttttcttttttttttttttaatttaatctttgctatagatttgaaaatggaatcttcctaccaggaccaacttataacttcaatttttttcctgtttagtaacggtcaggttagtcacaatagattcaactggcaataaggattagaaataaaagcaaataatgaaataaatgtaattgctcactttgttttatagcaataaaagcatatgatctaataaaaaattctaagtatgatccatttgcatactgatttaatggcagataactgagtgaatctggatattcttatagtgttaatggaatagcaatgactaaaaattatttaatggaattttacgggctaaatatcaagtataaagaactatgggatttattatgaactcaaccaaacttttcatgactggaccatattatcaaatgagatgacaagatgtgctagatacaaaaagaaactcaaggtatgtatccaccaatagaaacttctctgatgttgtagaggttcaaccataagggaataaggccattcacagtatctgaattggtaaataaaacagttaagtagatttagaggcattattttatgtccagctgcatttaccaatgacttccctgggaattaggaattctaaggcatagacaaaattattctgcatatccacaccaaattgcacatacagcagtattcacatacagttgaatcttgagcaacacaggtttgaactgcatgggtccacttataaggggatttcctcccacctctgccacccctagacaaaccccttctctttctcctccttttcagcctactcaaaatgaagataataagaatgactacatttatgatgatccacatccacttaataaatcataaatatattttcccttccatatgattttcttaagaacatcttcctttttctagcttcatttattgtaagaatacagtatataacacaaacaacatataaaatacatgttaatcatctgtttatgttacaggtaaggtttccagtcaacagtaggctattagtagttaattttgggggaagttgaaagttgtatgtggattttcaactgcacaggttattggcgcccataacccccatattgtttgagagacaactgtattcaacatgattcttcctcatctcataaaattaagagaaagttgcttatttcttatgggatccaggctttggattcctttaactatagacggataggtgaagagtttagtcaaaacttacaggaatatgaaatctgcaacaataaccctctcccagccatgactttatactactttataccagcctacatatgataaattacaaactccactatatgtgttctaaagttttcagaaatttaaaaattgatttttacacaggaactatgttatacttaaatttattagagattaatttcacttaacaatcattcagcttgttcatcttaagatttaaatattagaaatgttagtaaagaaaaaaaccaatatgataaagtagcaaaatgcatattacctaaaagtcagtatatgtggattctttccaatggtaatattttgtgtaatgagaagagtttatggaaaatttctttaagttgtgattaaacccaaagtaatatttttattttaaaatgttaatatctagtgtttattaccaaaagaaattatttctttttcttaaagttattaaaaataagtttttttatttcttttcatagtgctaaacaagaatgaatttcaagaaaagtgacaaggcacttagagcacatcaagtggaacattctgcagaatttcttaagaggaaagaggaaatcagctctttggcttctaaaactcaggaagaataaattaggctttttagtaaagcatgtaagtcaaatttaatttcccctacagaggtagcattataataataaaatgcattccaaaccaagggactaataacagcataacaaaaatggccacatttagtaaatgaaatatatgcagtccagtgtgccatgtaggggatttgaagtagtcttggcagggtgaggaaacagacttgggtctccaaagaaatatccacagaaatactgcactgcatggaatgctaaggccatgagcagagacaatagttttccacccaacaaatactgagtacctattatgtgccatttcttctttaggtgccaaaactgaacaaaacaaaagaaatccctctaactccaagtagctatatcctaattaggaagacaatcagataaccaaggaactaaagtgcaaaacgataagcaacttacagaaataaattcagagtgcttagggagtgtgtacaagcattgcttagccattgtagggggattgggataccttttcttgtggaagtgatgtatgaactgagaattgagaaagaagtagaatttatccagaaacgatttgtaattcaatacagttaaaaggcagggaaagagaagagacaaaaaaaaggaaagcaaaattgagtggttaaaaagggacagggttggaaaaaatggcagcatcaggtgtctggaccacagatttctgatggccttcagtcttctttctttggcttcatcttcagagtgagtaggattttgccaacccaaatcaaaagaatgagaagaaatggaggaagagaaagcaaatttgcagctctaactaatagcctttcagatgtattttggctcttaatctactcactggaaacccttaagaggcaaaacgatgcaggaggaatggaaattgagtagttcagaaaacctaggcttttttatttattttactttttcacaccaacactgaaaactacttgctatgtaacacttgacaaattacaatttctttgattgtcatgtattttcacctaaaaaatagggataatatacccccttcccaaggttgttctgagaatcaaatagatgtgagagtgctttgaaaaataagtatgtgttatttagacacaaaccattattatttagcacagaggttcccagatttctcttgcctgattcaaatccatttacatgtgtatcaaatgtagagtcatgctcacctgtctcctccttatagggcctatcagaatctggagtaggatgcagcaggagagaaaaatctacattatattgacaaaaatccatttatataaggctatgatcacagtgaaggagtgctgcttcttccacaaaacgccctgaggtcaagtctgtctatataaataaggtcataaaacagaagtgcactcagatttcaagaacagaaatggtaagtgtaggaaagagggcaagataaatttttctgagtaagcatataatactgcacaaatccactgcagcaattagttgagcctattaatgccacagtacctgatgtagctgcccacagcaatacacctgtatttaatggaatcacagctggaaggcttttgaagctaattataaggcaccttgacaagaggcattttaagccattgaagtatgttttgtgacttctgccaatataacccatacataccttgctagttatgtttgtaaaaagtaggtggtattttgcttgcagaattgggaggcaaatcccagtaattatctttccaagccatccaaagcttcaggttatttttgtaaccatatatttatgatctttcagctcttctgtaattcaaatattttatccaaaatcagtttcataaaaattatatgtagtttgtgattttaaatgctgtgtatccctcatattgaagagtttgttgttttttgtttttttctttttaatttcagccttgattttcttttaagttggtgctcctcaaacctggctttgcatcagaatcgctcagagaattttttaaaatactgattcctaggccctacttctagtgactctgattttgttttgaaactggaaacttgtattttttagaagcatctctagtattttgatgccagattcagaaataattactatcgtcctcacaataagcattccaatgatgtgcaacaagaaaactgttgttctttagaatgatcattcccaattaggcacctttccttccttacgtccagctgttagagaagactatatcttctgcttcttccttataataacagagaaaagctaaatggggcacttgcgtccttaggaaagtttatcaccgaaaactatcataaacctgaaatctctctcaataatcatctgttgtaaggcaaaaaccctcttgaattaaaattgctttaatcaattaggactctggtatttcggtaacaaatctccatggaaaaaagtctctgatttagattagtaaagtgagattctggtgtgaatataagaagtctcaaagttctcccagattccatttgtgcctttatggtcccctggtgagttttatcactgggtagaattcacaaaccaaaaataaaaaaaaaaagaaaaacatttcacacggggaacttaacaagaaaaaacaactaccttatagaaaacagatggctagcgatactaaagccgaaaggctgtcagctgtgtcttcagcctgtttttctatgcttttataaattggcaggaaaaactccttacatttcactaaaaggggcccagcccataaatgatttgctaaagaaatctgaaaatccatgtttttcaatatgaaatatgtaaaatgtttgaaaactgatttttcaatgaggatttttcaagcttctattttgagagatgattctgggacattccttgaattattcagaaatgaagagaaaatggtgtaaataaaataataattttatgtcaaatttccttttttctcatcttttaaaatctctcttttacgtgcaaaagctactaggtactaggtgacatttacttttgtaaatcacctatttgatttcaaaagggacaagttatagtgtatgatttaggaaatcattttcaaattaggaattgaagagcaacttatctgtatcatacatccatttaaacttcatccatgttaagatttaggggaagaggttggattataattcagccatttaccaaatacacatattatgcagctacattaaagactgtgtggtgggaggtttaccgtaatataaagtttatgccctcatgtggcttacacttgtttgaaattgtgctctcttaatggttctgcctgcagcagttataaattatatgagcatatgtgaccttgaagcaaaggaagatgaaataaattaatagttagctaaaaatgtctgtattgtgatattctagaaatctttttggccatagaactaaaatctttttccctccttatattccttcagtttgattcaacaaaaatgcgttttctgtcttctccatgccagacactgccctggattgtggtgatagggcaacggacaaacacattcctgaatacttttatttctgaaagaaacagtcttgtctaatttcacatgagaattttccttcctttagtaatttgtgggaagatggaagtattttgtggttagaacctatgagtatgcttttagactatttactccaaatccttttagtcactgagatattttaagaggtgagtctatgaaatagacttctagaagtaagtgtcaggatttgagttttgatatacagcctctttacaaatttatttactgatttatttaacaatgatttttgagcacctaatatgtgctcaatttaaaagggcatttacttgtaaagacactcatcatatttattcctaatttttgctttaatagctaggctactctccactgaagcagggtatctatgtgttgttcatagctgtaccccttacacctagcaagggatctaggacatagtgggtcttcactgtagccacatgaactaaaagggaaatgaggaaataaaatcagagtattgccaccatatttaaatagccaccttggctctgaaaagatttcaaacagatctagctagcatctagtatctcttctacacagataagtttccattccattttacaaatgaaatattagagtataaaccagtctacaaacctaccttttacacaagtgcctgtgaaaaatttagtttataaagcccaagtcacatcacaaatgcttaatatatttatttttatttattcaacacattattgactaccttctatatcttaggcaccatatcaatgttagaaatataagtgttaacagacagaaaagatttagtccttaaagagcttatactctagtggaaagaaacaggaaataagcaaatattatacttactaaccatacaatatgtctagtagcaagaagtgttaccaaaaattcagcaaggtaaagacaaagagctccaggagaaaagtgaattgagaggagagcggggactgagcttaattttgaataatcagggacaagctcacaaataaagtagaatttgagcagagacctgagggaaataacatagtattttcaaatgacgattcttattggaataaatgtcatctttaagtcctgtcatcataaaaagtggtatcaagttctttcttgggttaccggaaataactttgacagctaagtgaattgtaaagttcataaaatggaacaataagtttctttgcctaggtaatttcccagcaaataaaatgcaaagcatcaaaaaggtttttttcttcttaaactgctcaagccattgtaaaaatttcacgaaaatatgaaattcgctgagaaaatttaacatttgtttaatttcttgggtgaaaaaaatgtcttaatgaattagatagtcttaagagaccacagacaatcaggatatgttattggacaaaaaatttagggtccaaggtttactttgagatgccattggacattgaaaatctctttgagcaaaaacagcaactaggcctggagctcaataacagctctgtctggacccgaaggagggaaaatatgtgataattttttgtgtaattaggcttcaggaaaacacattgatggtaccctaatgaaatatgcattaaaaaactgaattgttgaaaagaacaaatatatcaagtatgattcaattagttttagagttcctctaagagaatttcttcatccatatacataatttttagctaaatttacctctcatacttgttaaaacaaattagaggagaaaaagaaattatacgtgtaaattagtaattatgtatttctcataagaatacctaaatatttcaaacaaggcaattctatgtaatataattgataaaatgtgaatactgaactttgggttaattcagaggctgacagattttgattataaggtatctattaattcatccactgaggttcatattttgattgtcttgtattaaaatgtctgttctttgaaaaaataagtcattgagttgtatggacatgtaattaaacatagtcatggcaaagttctctgacctcaagtggccagaatagccacgttttgcatctatttttatgatacgtaatcatggtctggtttttagagacataagtagaagtttcctaccacatcaacattcctaaataacagtatcattttggtacagacaacttcagaaaatcagagaagaaaaaagggaacttgtttttggaaaggttacaaacctgattttacgtttttcttttaatttctgttaaaacagaggaaatgaactttgtgtatttaagggagctgcatagacttattagtcctggctgcagatattaagtaaaaactatcttaactttataataatttgaatgtacttttatttaagtcaagtatctttaatatctttggaaaagaagaatagtattgaaaaacaatgagtgaaattcaaataaccaaatcacaatgtataagaaaaaaagatgcattcaatgtagtttttaacaattcatctcatttattgtcaaaattaataaaacaggctgggttcagtagcttacgcctgtaatcccagcactttggaaagccgaggtgggtggatcactcaaggtcaggagtttgagaccagcctggccaacatggtgaaaccccgtctctactaaaaatacaaaaattatctgggtgtggtagtgcacacctgttgtcccagctactcgggaggctgaggcaggagaatcgcttgaatccaggaggcagagattgcagcgagctgagatcgcaccactgcactccagcctggataacagagcaagactccatctcaaaaaaaaaattaataaaacaatattaattgagtgttccctggctgagtgttctggaaataacagttggggagatataagcaatttctcagagataaagaagttgaatatagaatgctcttgggcagcagtgtagagattagttt

SEQ ID NO: 20 - DNA, 176059 bp, Artificial Sequence
  Synthetic BAC sequence
ttctgttattgttattttgagaaaatgtaacataattcgaatttctttatgtcataatttgataattgtaatacctaaagttgtgagatttcattcagcaatgttcattaaataggatttttctgaaatgccaattgaaacaatgataattactattgctacatagtagaattcagctattagcctaaacaatagcttcacagcaaatagattgctacagaactaagttcaatataggaaaaatatttcggcatctgaataagcactatagaacataaaagttttcaggaagtgatttttagactttggtaagactgtgattgggcagggaaatggcatggagtgaagtagatgggcaaagatttaggaatgcaactataataaaactcaccgtgttatgttcaatcatatacataataaaatagagtaggagcccaaggaaaggagaaaaatattctgatattaattatggctaaatagttggaatgccttgaatgccatgctgaagaatctgaacaattttatgaagtagaaaatttgaaatataaaaagttatgagcaaaaagcatgagatttaattcacattttggtttctacataaagaaggggagcagagaaattagacggtagtagattaaatactttgtaaaataatttgggaaagagataataaaaacttaaacttatggaggaagagaaagataattcttattaatgtaaaccaagtataatgaaatatgcttaaaatgttatcttagagtaacatttcctccctcaaaaacatgaaggaggaaagacaaatgacaaaatctgataggctttcactataaaacaatactgagtaaaaatataataaacaacatctcaaatgtattgccaagtcttcgaaaaatgaaaattcccagcatccaaaaatatcgaagaggctgaaaatataatgatgaatggatgctgatgctacagttgtcttgggcctctgctgatcttggaaccaccagggttggcttaatagctgcagagatcaggaaacaaatattttaactatgcaaatgaggtatgaaccctgagaatctcctgacaatttggactctttcactcagtgaaacagtgaacctaaaaatatcttcccaagaggcacacagatgttggggaaatttgtctactctgtataaaaaataaaaattcttcttctctaaaactttctcactatagacttgctccacgtgaatttgaaatccagattatgttgcttgtgtgatctagggaaacacacattacaaaattaaactgaagtgccagattttaagtcatagagcacttggcaaaaacaaaatcaagtcctttttgcagtacatgatttcaccttgccagtacaggatacccacattgccacagataaaatcctgcacaatataaatccataatcaagaattaccaactgcaggaggaaaaaagccatgataatatctttagtgtaaataaatgacaccctggaattttatgcagagctgtgtagtgcgttaagaaagagggcaaagtggtgctaagaagaatgtatattctgttgatttggggtggggagttctatagatgtctattaggtccgcttggtgcagagctgagttgaagtcctggatatccttgttaaccttctgtctagttgatctgtctaatgttgacagtggggtgttaaagtctcccattattattgtgtggaagtctaagtctttttgtaggtctctaaggtcttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcttttctttgctttccatttgcttggtagatcttcctccatccctttattttgagcctatgtgtgttggaagtaaagcactcctcagcaaaaagaacagaaatcacaacaaactgtctctcagaccacagtgcaatcaaattaaaactcaggattaagaaactcaatcaaaaccacacaactacatggaaactgaacaacctgctcctgaatgactactgggtaaataatgaaatgaaggctgaaataaagatgttctttgaaaccaatgagaacaaagacaaaacacaccagaatctctgggacacatttaaagcagtgtgcagagggaaatttatagcactaaatgcccacaagagaaagcaggaaagatctaaaattgacaccctaacatcacaatgaaaagaactagagaagcaagagcaaacacattcaaaagctagcagaatacaagaaataactaagatcagagcagaactgaaggacatcaagacacaaaaaaattcttcaaaaaaatcattgaatccaggagctgattttttgaagagatcaacaaaattgatagactgctagcaagactaataaagaaaagagagaagaatcaaatagatgcaataaaaaataataaaggggatatcaccactgatcccacagaaatacaaactaccatcagagaatactataaacacctctatgcaaataaactggaaaatctagaagaaatggataaattcctggacacatacaccctcccaagactaaatcaggaagaagttgaatatctgaatagaccaataacaggctctgaaattgaggcaataattaatagcctaccaaccaaaaaaagtccagaaccagacagattcacagccgaattctaccggaggtacaaataggagctggtaccattccttctgaaattattccaatcagtagaaaaagagggaatcctccctaactcattttatgaagccagcatcatcctgataccaaagcctggtataaaaaagagaattttagaccagtatctctgatgaacatcgttgtgaaaatcttcaataaaatactggcaaatcgaatctagcagcacatcaaaaagcttatccaccacaatcaagtgggcttcatccctgggatgcaaggctggttcaacatatgcaaatcaataaacataatccatcacataaacagaaccaatggcaaaaaacacatgattatctcaatagatgcagaaaaggccttcgacaaaattcagcagcccttcatgctaaaaactgtcaataaattaggcattgatgggacgtatctaaaaataataagagctatttatgacaaactcacagccaatatcatactgaacaggcaaaaactggaagcactccctttgaaaactggcacaagacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatttagaaaaccccatcgtctcagcccaaaatcttcttaagctgataagcaacttcagcaaagtatcaggatacaaaatcaatgtgcaaaaatcacaagcgttcctacacaccaataatagacaaacagagaaccaaatcatgagtgaattcccattcacaattgctacaaaaggaataagatacctaggaatccaacttacaaagatgtgaaggacctcttcaaggaaaactacaaaccactgctcaatgaaataaaagagaacacaaacaaatggaagaacattccatgctcatggataggaagaatcaatatggtgaaaatggccatactgcccaaggtaatttatagatcaataccatccccatcaagctaccaatgactttcttcacagaattggaaaaaattaaacttcttatggaaccaaaaaagagcctgcattgccaagacaatcctaagcaaaaagaacaaagctggaggcatcatgcttcctgacttcaaactatactacaaggctgcagtaatcaaaacagcatggtactggtacccaaacagagagacagaccaatggaacagaacagaggcctcagaaataacacacatctacaaccgtctgatctttgactaacctgacaaaaataagaaatggggaaaggattctctatttaataaatggtgccgggaaaactggctagccatatgtagaaagctgaaactggatcccttccttacaccttatacaaaaattaatttaagatggattaaagacttaaatgttacacctaaaaccacaaaaaccctagaagaaaacctaggcaataccattcaggacataggcatgggcaaggacttcatgactaaaacaccagcagcaatggaaacaaaagccaaaattgacaaatgggatctaactaaactacagagcttctgcatggcaaaagaaactaccctcagagtgaacaggcaacccacagaatgggagaaaatttttgcaatctacccgtctgacaaagggctaatacccagaatctacaaagaacttaaacaaatttacaagaaacaaacaaacaaccccatcaaaaagtgagcaaaggatatgaacagatacttctcaaaagaagacatttatgcggccaacagacacatgaaaaaatgctcataatcactggtcatcagagaaaagcaaatcaaaaccataatgagataccatctcacaccagttagaacggtgttcattaaaaagtcaggaaaaaacagatgctggagaggatgtggagaaataggaatgcttttacactgttggtgggagtgtaagctagttcaaccgttgtagaagacagtgtggtaattcctcaaggatctagaactagaaataccatttgacccagagatcccattactgggtatatacccaataaatcatgctactataaagacacatgcacacgtatgtttattgtggcactattcacaatagcaaaaacttggaaccaacccaaaagtccatcaatgatagactggattaagaaaatatggcacatacacaccatggaatgctatgcagccataaaaaaggatgagttcatgtcctttgtagggacatggatgaagctggaaaccatcattctgagccagctctcacaaggacagaaaaccaaacaccacaggttctcactcataggtggaaactgaacaatgagaactctcggacacagggcagggaacatcacacgtggtggcctgtcgtgggttgcgaggcagggggagggatagcattaggagaaatacctaatgtaaatgacgaattaatgggtgcagcaaaccagcatggcatatgtatacctatgtaacaaacctgcacgttgtgcacatgtaccctagaacttaaagtataattaaaaaaaaaagagaaagagggcaaagtaaatgcattttcaaataaaacctgagtttccactaacagacctaatttattaaaggaattttaaaatatgtagtttattaaggaaaaggatattctttagtgatctcaattcttaggatggactgatatacaagaggtaatggcgtgcaaagaaattagaaagggaggggcagagcaggatgatggactagaggccttacaccatttgttcctccacagtaacaccaaattttaacaactaactacacacaaaaagcactatcacaagaatgaaagatcaggtgagcaatttccatacatgattttaacttcatatcacagaaagagatgttgaagagggcaggaaagacagcctccacacaccgatgctctccctccctcgttctctcctgctgggaaatctatgcacttaagggagggagagcacagtgattgtgaagttttgcattgaactcgctgctgccttgtcacagtggaaagcagaacaaggttgtactcaactgacatctgcccatggagggagcatctggaccagccctagccagagaggaatcacccatcccagtgatcagagcttgagttccagcaagcctcaccactgtgggctgagtgctctggggccctgagtaaacttgaggggcagtctaggccacaaggactgcaatttctaggcaagtcctagtgctgagtggggctcagggccagtggactggaggggcatgtgacctactgagacaccagccagggtggctaagggagtgttgcacagcatggagaaatctatgtgttgggagagggagagcacagtgactggaggaccttactttgaactcagtgctgccctggcacagcagagacctggcaggattcatcacttgctgactatagagcccctccgccatcagccctgagtaactaacagtgatacccaggtaatacaccacaggcctagggctctaagacttgctggcttcaggggtgacccagcacatccacggctgtggtgactatggtgaaagactccttctgtttgagaaaagtaggggggaaaacgaagggaactcagtcttgcaccttaagtaccagctcaaccacaatagggtagagcaccaagcaggctcttggggtccctgagtccaggccaaggctgttgatcaacatttctggacctgccttggtccaaacgggagccagtggccctgaagggtgagtaccgggtctggcagcattcaccacaagctgactaaagcgaccttgggctttaagtgaacaatggtggtggcctggcagaaccccacatggatcagtggtggtggtggccacagaaaggggctcctctgcctatggaaaagggagagaagagtcagaaagacttggtcttgttatttgggtgtcagcttagccacagtagaatagaacactagataaatttctaaggtttttgacttcaattcctgactcccagatagcatctccagacccacctagggcctgggggaacttgctgctctgaaggagacaaagtaatggccagctttgccacatgctgatcatagatccctaggtccttgagtgaactaggtggtagccaggtagtggttacagtggaccttgggtgagacccaatgctgggcttggctgttcaggtctaaagtagcacagtcctagtgttggtgaccacagggttcttgtgtccccccacccccagttccaggaggcttagcaaagagagagagactttgtttgggagaaggtaagggaaaagaacaagagtttctgcctggtaatccagataattattctagatcttgtccaagaccaccaaggtggtacctctctgagcctacaagaaccacaacgttattgggtttggagcccatgtctctttgaatacctggaaagccttcccaagaagggtgggtgtaaacaaacaagcctagacagtgaagactgcaataaatgcctaactcttaaatgccctggcaccaactaacatctacaagcatcgagaccatgcaggaaaaaaaaaaaaatgacctatgaaattaaccaaacaaagccccaaggattaatcctgaataaagagagatatgcaacttttcagacagaaaattcaaaatagctgtgctggggaaactcaaagaaattcaaaataacacagaggatgaattcagaattctatcagataaatttagcaaagagattaaagttatttttaaaaattgagcagaaattctggagttggaaaatgtaactgacatactgaggaatgcatcagagtcccttactagcagaattgatcaagcagaagaaagaattaatgagcttgaagacaggttattcgaaaatacacagaaaagacaaaagaaaaaagaaaatacacatagaagacagaaaaaaaaccaatgaagcacgcttacaagatctagaaaatggcctcaaaagggcaaatctaagaattattcaccttaaagagaagatagagagagagataggggtagaaagtttattcaaggggataatgatagagaacttcccaaacctagagaaatatatcaatattcaagtacgagaaggttgtggaacaccaagcagatttaacccaaagaagactacttgaagacatttaataatcaaactcttcaaagatcaaggatagagaatggatcttaaaagtagcaagagaaaagaaacaaataatgtacaactgagcttcaacacttctggcagcagacttttcagtcgaaattttataggccaggagagaatggcatgacatacttacatacttaaagtgctgaaggaaaaacactttaccctagaatagttccggcaaaaaaaaaaaaatccttcaaacatgaaggagaaataaagacctttccagaccaaaaaaagctgagggattttattaacaccagacctgtcctacaagaaatgctaaagggatttcttcaatcaaaaaatgacattaatgagcaataagaaatcatctggacgtacaaaactcactggtaatagcacataaaaacacagaatataataatactctgtgttatgtaaaatactcttatcttaaatagaaagactaaatgatgaaccgatcaaaaataataattacagcaacttttcaagatgtagagagtacaataagacataaagagaaaccataaaatgttaaaaagtgagtggataaagttgaagtgtagagtttttattcattttatttttgcttgtttgcttatttgtttgtttatgcaattagtgttgtcatcagtttcaaataatgggttgtaagatcgtttttcaagcttcatggtaacctcaaattgaaaaacacacaatgggcacacaaaaaataaaaagcaagaaattaaatcataccaccaacaaaaatcaactccactaaaaggaagacaggaaggaagaaaaaaacaaaacaaccaccaaacaaccagaaaacacatagcaaaatggcaaaagcaagtccttacttattaataataatattgaatgtaaatggactaaaatttccaatcaaaagacatagagtggttgaataaacataatagcaagacccatgactgttgcctataagaaacacacctcatctataaagacacacatagactgaaaataaaaggatgaaaaaagatagtgcgtgacaatggaagcaaaaaaaaagaaaggagtagctacactatgtcagacaaaataggcttcaagacaaaaaatgtaataagagacacagaaggttattatataataataaatgagtcaattcagaaacagaatataacagttgtaaatatatatgcacccaacactggagcacccaggcatataaagcaaataatattagagctaaagagagagatagacttcaatacaataaaagctgcagacttcaacacctcactttcagtattggacagatcttccagacagaaaatcaacaaagaaacatcagacttaatctccactttagaacaaatggacttaatatatatttacagaagatttcatccaatggccacagaatacacattcttctcctcaacacatggatcattctcgagaatagatcatatgttaggttacaaaacaagtcttaaaacattcagaaaaattgaaatactatcaagcatcttctctgaccacagttgaataaaactaggaatcaataacaacaggaattttgaaaactatataaacacaatggaaattaaacaatatggcccagaatgatcagtgagtcaatgaagaaatcagaaggaaactgaaaattttcttaaaacaaatgataaggaaacagaacatgccaaaacctatggaatgtagcaaaaacagggaaatttatagctataaaacctacatcaagaaagaaagaaaacttcaaataaataagccaagaatgcatctttaaaaattagaaagacaagagcaaaccaaacccaaaattagtagtagaaaaaaacataaagatcagcacagaaataaataaatttgaaattaagaaaacagtacaagagatcaatgaaatgaaaatttagttgtttgaaacaataaataaaattgacaaatctttagggagactaagaaaaaaagacaccggagccaaataaataaaatcagagttgaaaaaaatagagacattagaactgataccacagaaatacaaaggatcattagtagctagtatgagcaactgtatgccaacaaattggaaaatctagaggaaatgtgtaaattcctagacatatacaacctaccaaggttaaaccataaaggaatccaaaacccgaacagaccattaacaagcaatgagatcaaagctgtaataaaaagtctctcagtaaagcaaagtctgggaacctgatggcttcacaacagaattctaccaaacatttaaagaaccaataccaatcctactcaaactattctaaaaagtagaggaggaggaaatacttccaaattccttctatgaggccaaaaccagacaaagacacatcaaaaaagaaaactacaggacactctctctgttgaatattgatagaaaaggccttagcaaaatactagcaaactgaattaaacaatacattagaaagaatattcatcatgactaaatgggatttatcccagggatataagaccactttaacatatgcaaataaatcaatgtcgtacatcatatcaatagaatgaaggacaaaaaccatgtgatcattttaattggtgctgcaattgacaaaattcaacaccctttcatgataaaaatccttaaaaaacaggcatagaaggaacataccttaacataatgaaagacatatatgacagacccacagctagtatcacactgaatgaggaaaaactgaaagcctttcctttaagatctggaacacaacagcaatgccactttcaccactgttatccaacatagtactggaagtgctagctagagcaatcagacaagagaaggacataaagggcatccaaattggaaaggaagaagtcaaattatcctagtttgcagatgatatgagctgatatcatctgcaaagactccaaagaaagtatagaactgataaacaaattcagaaaagttgcagagttggaaaaaaaaaaagacattagaactgataccacagaaattaacatgcaaaaatcagtagcatttctatattccaaaagtgaacattctggaaaagaaatcaaaaaagtaactccatttacaataaccacaaataaaattaaatacctaggaatcaaaaagaagtgaaagatttctacaatgaaactataaaatactgatgaaagaaattgaagaggacacaaaaaagtgtaaaagtatttcacgttcatggattggaagaatcaacattgttaaaatgtctatactactcaaagcaatctacaaattcaatgccatccctataaaaataccagacattcttcacagaaatagagcaatcttaaaatttacatagaaccacaaaacatccagaatagccaaagcaaaaagaggaaaactggaggaatcacatcacctgacttcaaattatactacaaagctacagtaaccaaaacagcatggtactggaataaaaacagaagcatgaatcaatggaacagaacagataacccagaaacaaatccacacatctcaagtgaactcatttttgacaacggtgccaagaacatacaatggggaaaggacagtctcttcaatacatggtgctgggaaaactggatatccaaatgcagaagaatgaaacttgactcatatctctaaccatatacaaaaaaatcaaatcaaaatggatgaaagacttcaatctaagacctcaaactatgaaattacttcaagaaaacattgaagaaattctccaggatattggcctgggcaaaaatttcttgagtaatatcctacaagcacagacaactaaagcgaaaatgaacagatgggatcacatcaagtttaaaagcttctgcacagcaaaggaaatgtcaataaagtgaagagacaacccacggaaggggaggaaatatttgcaaactacccatctgacaaggagtttataaccagaatatataaggagctcaaacaaccccatagggaaaaaataataatctgatttaaaaataggcaaaagatctgaacagatattccttaaaagaagacatgtaaatggaagcaggcacatgaaaaggagatgaacatcattgatcaacagagaaatgcaaatcaaaaccacaatgagatatcatctcactccagttaaaatggctttaatccaaaagatgggcaataacaaatgctcatgaggatgtggaaaaagggaatcctcatacactgttgatgagaatgtaaattattacagtcactgtggagaacagtttggaggttcctcaaaatactcaaaatagagccaccatataacccagcaatctcactgcttggtatatacccaaaagaaaggaaatcagtgtatggaagagatatctgcacttccgtgttcattgcagcactgttcacaatagctgagatttgaaagcaacctaagtgtccatcaacagacaaatggataaagaaaatatggtacatatacgcaatggggtactatgcagacataaaaagaatgagatcttgtcatttacaacggcataggtggaactggaggtcattatgttaggtgaaataagtcagacttggaaagtcaaatttcgcatgttctcatttatttgtgggtgctaaatatcaaagcaattgaactcatgcagatagagagtagaaggatgattaccagaggctaggaagggtagtgggggggtgaaggagggaagtgaggatggttaataggtacaaaacatacatatacatacatacatacatacatacatacatacatacatacatacatacatatatatataattagaatgaataagacagaatttgatagctcaacagggtgactatagtcaataatactttaattgtacattaaaaattaacttaggtcagcgcgagggagcccgggtggccgccattactgagcctggcgctgcggctggcgctgggagagcggggagggacggggccgcagctggtggcagagagggagggagggtgggtgagcaggctgcgggggccgtggggctcagggtttccgggcgtgtgtgtcggggagggcggagggaggtgcctgaagggacgcgccgctcggtgagcgcgccgggggagaggcgagcagagagtggaggaggaggcggcggcgggagcgctacccaggaatgttgctgccgcagccacagccagggccgctgtggttgaggaggagacagaggagaccgacgttgttaggaaaatgatctctatgatcttgaagatgtttctgcacagaaatgagggaaatacaaagaaccaaatacagttctgaaacttgggatctgtattttcagatgattttattttcagaatgagaagcatatctggtttcatatctacatttatgaatgtagaggcatgagaagagagttatgatggcaaaaaacaaagagccttgtcccccatcctatactatcagtgtagttggactctctgggactgaaaaagacaaaggtaactgtggagttggaaagtcttgtttgtgcaatagatttgcacgctcaaaagcagataaatattatccagagcatacttctgtgcttagcaccattgactttggaggacgagtcgtaaacagtgatcactttttgtactactggggtgacataacacaaaatggtgaagttggagtagaatgcaaaattcatgtcatttaacagttcattgatgaccagacattcttgcctcatcggagtatgaatttgcaaccatatataaaacgtgcagctgcatctagattgcagtcagcagaaaaactaatgtacatttgcactgatcaactaggcttagaacaagactttgaacagaagcaaatgcctgaagggaagctcaatgtagatggatttttattatgcattgatgtaagtcagggatgcaataggaaatttgatgatcaacttaaatttgtgaataacctttttgtccagttatcaaaatcaaaaatacctgtaataatagcggcaactaaatgtgatgaatgcgtggatcattatcttagagaagttcaggcatttgcttcaaacaaaaagaagcttcttgtagtggaaacatcagcaggatttaatgtcaacattgaaacgtgtttcactgcactggtacaaatgttggataaaactcgtagcaagcctaaaattattccctatttggatgcttataaaacacagagacaacttgtcacagcaacagataagtttgaaaacttgtgcagaccgtgagagattatcatgcaacttggaaaactgttagtaataaatttaaaaaatcatcctgattatgaagaatacatcaacttagagggaacaagaaaggccagaaatacattctcaaaacatatacaacaacttaaacaggaacctataagaaaaaggagagaagagtatataaatactttaccaagaagagtttttaacactcttgccaagtctagaagagattgaacatttgaattggtcagaagctttgaagttaatggaaaagagaatagatttccagttatgttttgtggtgctagaaaaaacaccttgggatgaaactgaccatatagacaaaattaatgacaggcagattccatttgacctcctgagcactttagaagctgaaaaagtctgtcagaaccatgtacaacatccaatatccgagaagaggagggtagaaatgaaggaaaaattcaaaaagactttggaaaaaattcaagtcatttcacctggacagccatgggaggaagttatgtgctttgttatggaggatgaagccttcaagtatatcactgaggctgatagcaaagaggcatatggtaggcatcagtgataaatagttgaaaatccaaagaaaagtttcaagaaatgctttttgagcattctgaacttttttatgatttagatcttaatgcaacacctagttcagataaaatgagtgaaattcatacagttctgagtgaagaacctagatataaagctttacagaaacttgcacctgatagggactctcttctacttaagcatataggatttgtttatcatcccactaaagaaacgtgtcttagtgaccaaaattgtacagacattaaagtggagcagttacttgctagcagtcttttacagttggatcacggctgcttaagattatatcacgatagtaccaatatagataaaattaacctttttattttagggaaggttggccttgcccaagaactagcaaatgagataaggacacaatccactgatgatgagtatgccttagatggaaaatttatgaacttgatcttcggccagttcgccttaccttttgagtcagttatggactgctgcctttaaaccacatcggtgcttctgtgtatttaattccattaagtcattgagttttattgggggaatttattgggaaaataagaactgaagcttctcagatcagaaaagataaatacttggctaatcttccatttacattaattctggctaatcagagagattccattagtaagaatctaccaattctcaggcaccaagggcagacaagttacaatgtccttttgtagatgtacctgctggtacatatcctcataatttttatgaaacccaaataaagcaagctctaagaggagtactggaatctgttaaacccaatttggatgtggtgagcccagtttctgccaagaaggacatatcagaagctgacttgagaattgtcatgtgtgccatgtatggagatccatttagtgtgaatcttattccctcacccttccctgattctcattcttgcagtgctgctcaagctggacagaataattccctaatgcttgataaaatcattggtgaaaaaaggaggcgaatacagaccacaatattatcataccactcttcaattggagtaagaaaagatgaactagttcatgggtatatattaatttactctgcaaaacagaaagcatcaatgggaatgcttcgagcatttctatcagaagttcaaaacacattcctgtacagctggtggcagttactgatagccaagcagattttttttttgaaaacgaggctatcaaagaattaatgactgaagaacacattgcaactgagatcactgctaaatttacagcattgtattctttatctcagtatcatcagcaaactgagatctttattctgttttttagtgatgttctagagaaaaaacatatgatagaaaattcttatttgtctgataatacaagggaatcaacccatcaaagtgaagatgtttttctaccatctcccagagacttttttccctataacaactaccctgattcagatgatgacacagaagcactacctccttatagtccaactggggatgatgtacagttgcttccaacacctagtgaccattccagatacagattagatttgcaaggaaatgaatattctattcatagtaccccaaactgtcgtgaccatgaacgcaaccataaagtgcctccacctattaaacctaaactagttgtacctaagacaaatgtgaaaaaaatggatccaaacattttaaaaacaattgaagctggtattggtaaaaatccaagaaagcggacttcccaggtgcctttggcacatcctgaagatatgaatccttcagataactatgcggaacccattgatacaattttcaaacagaagggctattctgatgagatttatattgtcccagatgatagtcaaaatcacattaaaattcaaaactcacttgtaaataacacccaaggagatgaagaaaatggattttctgatagaacctcaaaaaaatcacggggaatggaggccttcaaaatacaaatataagtctaaaatcatgtttagtaaagccaagtcatactataggagaacacattcagatgcaagtgatgatgaggctttcaccacttctaaaacaaaaagaaaaggaagacatcgtggaagtgaagaagatccacttctttctcctgttgaaacttggaaaggttaggtattggtaatcctgcaatcacttctgaccaggagttagatgataagaagatggagaagaaaacccgcaaagtgaaaggagataaaaagcagaaaaagaaaactaagaccttcaatccaccaacatgtagaaattgggaaagtaattactttgggatgcccctccaggatctggttacagctgagaagcccataccagtatttgttgagaaatgtgtggaatttattgaagatacagggttatgtactgaaggactctaccgtgttagcaggaacgaaactgaccaagacaatattcaaaagcagtttgatcaagatcataatatcaatctagtgtcaatggaagtaacagtaaatgctgtagctggagcccttaaagctttctttgcagatctgccagttcctttaataccatattctcttcatccagagctattggaaacagcaaaaatcccagataaaacagaatgtcttcatgccttgaaagaaattgctaagaaatttcatcctgtaaactatgatgtattcagatacatgataacacatctgaacagggttagtcagcaaaataaaatcaacctaatgacagcagacaacttaatccatctgtttttggccaaccttgatgagagctgattttgaaaatcaagagtttctgtctactactaagattcatcaatctgttgttgaaacattcattcaacagtgtcagtttttcttttacaatggagaaattgtagaaacgacaaacactgtggctcctccaccaccttcaaacccaggacagttggtggaaccaacggtactacttcagttgccgccaccattgcaacctcagctgatacaaccacaattacaaacggaacctcttggtattatatgagtaggaagtaattgcaaacaggctggatttggacaaaaagcaaatctagacatgcatgtttcagggttcagtagtatacttcatatttcatacagataattcacattcaaaatgacattttctctttgaactagatggtattccttattcacttacattacaaatctaagactatgtgataggcatgactggagaggtttaatttttataaacaaaaatagctataaaatacaaagctgctgctgcatgcaaccttattgcaatcagtatatcattcctgtgacaatttctgtcacattatgttgtgaataaaatttttccatagaaattaaatgatttaaaaactcacctatatgaaacatttaatgcttttcagcctgctttctggcgattttgttatttgatgtgctaatttgggcaacttaatttacattctggcagtcagtgtagataagtaaaagcccagttaagtattttatactttcaggctactgaggccatgcttgggatgttgtttgaaagaaagaaaaaatacacttgacatatttcacatttctgtaccttcatctttacttacaaataaacctgtggatgatttgatgaaggataaatgaacctatttcttttacacacataccaaggacatgcttgtgactaaagtgagttgataatattgtgcaaaggatagttgtcaccaactcatttctttctggtccataatgaaataaacattttgtagactgttaattctgtaaatagatgcatggtcaaaagatctatgatgttcttataatcttaatctaatatattttagatattttaattttttcccttttggagaacacatttagtatagtgtagaaaatacttcatgacatttgcattaagtttatataacttttcatacataaacatgaaatttgttgtagaaaattctttaaaccaaacatttaaatctaagacttcaatttaatttgttccttgtgtctatttttatgtggcccttaaaaacatatccaaaaaaccaataaaaatactttgggtactgacaaactcttcggagtgtttatgttacaaatttgtattcatgttctttcctgtgatgtgttatcctaaaacccaaaatggcttttgcaccatttttaagccaatttttttcctttgatgttggcaccagaattactataaacgactgctgcttttgggtgtaaacattttgttagtgaagatataaccagaacaataaattatggataaaattttcagaataggtggcacaggcaaatttcactaggttatattttgtgtagtaaagaaaaaaattctttggtaaatgttatcttaattcagactacaattttaagattgtcttatatgtattatagtaaatagatgattttcagaaaaaaataactcaaagagtataattggattgtttgcaattccaagaataaatgcttgaagggatggataccccattttccatgatgtgattactgcttactacatgcctgtcaaagtatctcaagtaccccataaatatatacacctactatgtacctacaaaaattttttttttaatttttaagatcttaaaaaagaaagcaggctggtaaatctaaacaagtattagtattatgaaaccttagtaataattgttttcaaggaaggtagaagtagatataaagtaactttagagtttatgccaagtatgtatgttatgtttaagagtagcttaacataacatgtaagagtagctcctaacaataggggtagaatatataagctcccaactagtatgatgaaatgagtttaaatccattaagtcaaagtaagaaacaagaaaagaaagaaagagcagggcaattagaaactataaaataacatggcagaagaaatgcaaatataccattaatcacaatatatgtaaatgagataaacacattaacacagagtttgtaggattagattttgataaagtctaactaaatgatacttgaaagaaacacttgaaattactacacagaaaggttgaaagtaaaagaatggagaaaagataaactcattaaatactaatgaaaagaaatctgggtcagaggtaagaatgtcagatagattaaattttaggcaaaaggattataagattatgtcataaaacattaaattaaccaataacacacaacagtttcaaccttgtataaaactaatacatagtctcaaaaatataaagaaaaaatgtacagaatcaagaaggtagattgagaaatctaacagcacatgagagattaaagagaaaaaaattttgaacaaatagttacaggttgcttcttatgtgccaggcactctttgagttgcaggggatgctacaaagagaaaaatgaattctcataaaaatgcttgccctcatggagcttatactctagtaacatgtatatggtattccgtgggggtgagtactatggaaaaatagaagacaaaggaggaacacagggagggagttggccttgctgaagagtgtttaggaaaagcctccctggaaatgtagtttttgagcaacatttaatgggggtgaagaagcaagaacagacatctggatttctaagggaagagtatttcagaagaaacaacaacttctaaggccttaaacggggcatgtccaagaaacagtaaatgggccaatatttttagaatgtgttgatttagaggatgacctagtggcaggagaataagaccaaaaggtaaacactggagagagagaaagtcacgcagtgcctgcaggctattgtgtgaacctgtgaggaggagaggatgtggaatggcaaagtaaggaaagagtcaaatctcaacaagcgtcacactggcatattttatgaaaagtggacttaagttagaaatcagtgaagaataacttaaaatttatacagttggacacttacaaatgcatttctcagtaacttgtggatcaaatattacatataacaaatattttaaaatacctagatgtgaacaaaacataaatacagcatatcaaaatgtatgggctatagtcaaagtattatgaggggaatttatattcataaatgcttatttataaaagctcaaaaaccagcttaacaagttagaaaatgaggccaggtgtggtggctcatgccagtaatcccagcactttgggaggtggaagtgggcggatcacgaggtcaggagttcgagaccagcctgaccaacatggagaagccccgtttctattaaaaagacaaaattagccagacgtggtggcaaatgcctgtaatcctagctacttgggaggctgaggcaggagaatggcttgaacccgggaggtggaggttgcagtgagctgagatcgcgccactgcactctagcctgggcaacaagagcaaaacttggaaagaaaaaggaaagaaagaaagaaagaaagaaggaaacgaaaggaaggaaggaaggaaggaaggaaggaaggaaggaaggaaggagggagggaaggaaggaaggggaaaagaaaagaaaagaaaagcagcagagtgttcttaaagaaaactgagggaagagaatatgtggaatctaaatctaaaaaggtcaaatacatagaagcacagagcagaatggttgttatgagggcctgaagggttgggagaaatgaggagaagaaggttaaagggtacacacttgcagaataagatctgaaaacctaatgtacagcatgataactacacttcataataacatattatgcacttgaaatttgctaagagagtagatcttagctattctcaccacataacaacaacataagtggctaggtgaggtgatatgctaattaccttaattgtggttgccatttcataatatataggtctatcaaaacaccacattgcataccttgaatatatgtaatttttatttgtcaattagaccataacatagttaaaaaaaaagagagagagcatatggaaaagtagggagggaaatgaatacagcagaaaagattgattaaactaaaactgagttcttgaaaaagactaataaaattcttaaacctattgcatgattgaccaagaacaaaaagacaaaaaacaaagaaataatgatagcaataaaatcgggacataactaggtatctatacagaattacaatggaaggaaatactatagtcacattttacaaaaatgaaaacttaggtaaaattcagtttttcagaaaaaatatatttcacaatatagactcaaaaaattaaatagatttctttttttaaatagatttctagaaatacaaagtaaaatgcaggaagaagaagaaggaaagaaggaaggaagaagggaaggaaggaaggaagtaatcaaaaactggaagagaacaaggatgctgattcttagtattactactgtgtattcagtgcagtaagatggcaaaaaaaatatgagatacaaatacagaatagaaagatttgaaggaagaaatgatttaatttgttgttagattaataatatatacttattaattacaaaaaatagtaagtaagcagtggagaagtcagacaaaaccttccacatgtcatcaaaataaacattgctaaggggcaaaagattatcacatgtgtctttaagaaacatacatcacttatgcaacgttctaggaaaaatatctaaaatctaaatctaaatgtaagaaaaacatcagacaaactcgaattgagttatactctgtaaaatacctgtcctttattcttcaaacatgccaatggcatgaacaacaaacaattgccatagaattgtttgttgttgttcatgattttgaactggattctatactggaaaaatcattgctgtaaaggaaaaattattgatgtaagagacaaaactagaatatagattatagtttaaataaaagtgtattataaatattcagtttcctgcattttataactgaactgtaaatgtctaaaagtacgtatatcatttttcttaagaaatacacattgaggccaggtgtggtgactcacgcctgtaatcccagcgctttgggaggctgagacagagggaacacttgagccctggagtttgagactagcctggcctatatggcaaaaccctgtctctacaaaaaaacacaaaaattagctgggcatcatggtgcgtgcctgcagtctcagctcccagctacttgggaggctgagatgggaggatcacttgagcccaggatagggaggttgcagtgagccaagattgccccactgcactccagcctgggcgacagacagaatgagattctgtctcaaaaaataaaatatatatattgaatttttatggcatgaaggtacataatgtatacaattcactgccaaatggttccgtgaaattttgccattgtgtctatgtatctagaaatggataaagatgataaaataaacatgatcatgtttgaaattgtcaattccagattgtatgggagttctttttaatattcttgcaacttttatataattttgaaattttctataagtttgaatttttaaaaaactaaaaaagataaaatatacagtaactacacaaggaccaaggaataagtctaacaagggagatacacaaacttttgggaagtaaattataaacctttattaaagacgtgaaatagaatttagaaaatggaggaatataccttgtttgtggataaaaagttatccacaaacttaacaaaacttaaatatatacatatatatatacacacatatatatacacatatatatatacacacacacacacacatacacacagtactaggagagaatccaaacaaagcatgatagcttcactgagttgaagaaacagtgattggagttcagttagtctaaagtcactggaattgcaaaaagtattggaaaagagtgagcaaggcagggaaagagcaccatagcattcactggagtcttcggctgaacaccaagctatgcatggttagagtatggatccgtgagactaggcacaaaactataggggaaagaacatctactaggaaactaaaactgaacactcactagagcttgcacagggcagaggaataattggcatctgaccaggcagaatgtagaaagctcgttaaacaccaaaggcattcaaaagtgcactcagaaaggtcaagaattaacagtagggctgaagtatctagcatagggaactataaacctgccctgacagaatgctttttttttgtaaagcatttaaaaatgcttttttaaaatgctttaaaaaaatgctttttttcaaaagcatttaaagaatccagctgatccgaaagaaacttaaccgcctgttaaaacaaaactcagttctcttaaaagaaaaatatcctgacctcagtaatgtgatattcacattgcacagtgttaaaaaaaaaaaacccaaatgtgaagaaacaggaaactaggactcataatcagaagaaaatcaatgaataaaaatgggcccagaaatgacagagataatgcaattgacagacaaggacttgaaaacaactattatataaagatttttaaaggaaagcataaaaataataaaagcaaagtagaataaaaattaatatcatggaattcaaggaagttgatgcatacaagaatgaagagatgaataaagatcctacaggaaatgtgaacacattgagtcaaggtggatggcaacactgaaaatgagaagcatttttctaaaccggaacaaaatgagatagaatggatgacaatgccatctcacaccagttagaatggcaatcattaaaaagtcaggaaacaacagatgctggagaggatgtggagaaataggaatgcttttacactgttggtgaaagtgtaaattacttcaaccattgtggaagacagtcttgcaattcctcaaggatctagaaccagaaataccatttgacccagcaatcccattactgggtatatacccaaaggattataaatcattctactataaagacacaggaacacgtatgtttattgcggcagtattcacaatagcaaagacttggaaccaacccaaatgcccatcagtgattgactggataaagaaactgtggcacatgtacaccacagaatactatgcagcaataaaaaaggatgagttcatgttctttgcagtgacgtggatgaagctggaaaccatcattctcagcaaactatcacagggacagaaaaccaaacactgcatgttctcactcataaacaggagttgaacaatgagaacacatggacacagggaggggaatatcacacatgggggcctgtagcggggtggggggctaggggagggatagcattaggagaaatacctaatgtagatgatgggttgatgggtgcagcaagccaccatggcacgtgtatacctatgtaacaaacctgcacgttctgcatatgcacctgagaacttaaagtatatatatatatacacacacacatatatgtatatacatatatgtatatatatatggatggtaatgcaaaaaaaaacagtaattgcatctaagaaatagcaaaagctttcctatcaaatggccttgttgagtatgaaagtttcatgggaaaatcagaaaaagtcagtaggaattaagagaaataaaatgatgcaagaaagtggaagcaaattatacgacaaaactaaaatatatatatatatatatgtataagatgattttgaagatcaaagctatattaaatgtattaattagtagaaaaagctaacatattacatgacttttgccatcatagttttaagactaggaggccaatatgatacaaggttagtcaataaccaaaaaaaaaagtagggtgttagttaaaccaagctacatagaaagatctcaagatagaaacgacataattgaataatagaaagccatcaactttctagagatcataaaaatggcagagttgattcaagagaacttggggaatggcaactggagagatgactgtgtcagagagaccacaacccttcagaagaaggtgcgaatcagggcctggtcctgcatgcaggtgattgaattagaaatgaaacaagactgaattaaagtaaggatataatggagctgataagagaaaggtgtgtgtgtgcatgcgtgtactctgtgatgggatagacacaagtacagaaaccttcaaggaattttgaggatctttctgttgattggttgacaaggaatgtcatacattcagtcacatgctgctcttttgggaggatggcatgttaggaggcccttactgaggcatgagatatataagctctcatatttgctttaaaaaggtatctgggtgttatggtaacaggaaaaacacactagcccaaaccacattcctctagcctgccatacttgtacaccaactctataaaagacctttagcttaacgttttgttttctgttaaaattttaaaaattcttgaaaggagtattcacctaaactgatccttcatttgttttgtggagctgatgaatttatcgaatctttttttctgacagtaatttgaataaaaagaaaggaggaaaatactaggtcatagagaagttccagtaagaagaaaatactgcatcaaagaagaagctaggaatacagaattcattatttaactgagctcacttctgcctgccacaccttgtacatacctgggccgtacaactctgaaatgaggtgtggcccagtgttccaggatgagtccaggcagagacttttcctgaacccctgtcaaatttgctgctcaaaaagcttgagtttaagccaaatccaataaaaggaaagatttcactcactatgtggtaagcttggttttcctgatttctcagcgagattgtctacagaagatctaatggaaaaaaacgttgttatatataatctctgggtgtgcctgagactgggggcagggtgggaaagtgaagaaaaagggtgcatgctatttgattatctgtatccaggtagttaatccctttctttgaataagtcaaaatgatttgacagccattatttaaaaataggttctgtcttagaacttaaaaacagatgaaagtacatttcctattttcctgcttgaatatataggtatctactgtttattctttatttttttaatatctatgtgtgcttttttaaatgtataactaaagcaacaaaattttaagaatctctgttttgtcattgttcacgtaacagtgagagacagagaccaagtgtcaggagaatcttgtccttcagtggttactcaggattctgatgctcacgctatgcttacaggggcagggtaatagccttttcactgcagtctagccctaggcctttgaaatgctaccatcccagcgagattaaaaaaggactgcttaaagatggttagatgttgggagtatgtggtatgtaattctaccgttcattgattttgacaaagcattttaactacctacataaactgtgtccaaaataaccacttactgtgttattgcaatgtttgcattgccaacttcatgaacagagtttctaaaattatgtgactttatatagataatagtctactgatgcagtaatctatgacattcaagatttgtaattaatgccacatatctacaactatctgatctttgacaaacctgacaaaaacaagaaatggggaaaagatttcctgtttaataaatggtgctgggaaaactggctagccatatgtagaaagctgaaactggatcccttccttacaccttatacaaaaattaattcaagatggattaaagacttaaatgttagaccgaaaaccataaaaaccctagaagaaaacccaggcaataccattcaaaacataggcatgggcaaggacttcatgtctaaaacaccaaaaacaatggcaacaaaagccaaaattgacaaatgggatctaattaaactaaagagcttctgcacagcaaaagaaactatcatcagagtgaacaggcaacctatagaatgggagaaaatttttgcaatctacccatctgacaaacggctaatatccagaatctacaatgaactcaaacaaatttacaagaaaaaaacaaacaaccccatcaacaagtgggtgaaggatatgaacagacacttctcaaaagaagacatttatgcggccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccaagtcagtgtggcgattcttcagggatctagaactagaaataccatttgacccagccatcccattactgggtatatacccaaaggattataaatcacgttgctataaagacacatgcacatgtatgtttattgcagcactattcacaatagcaaagacttggaaccaacccaaatgtccaacaacgatagactggattaagaaaatgtggcacatatacaccatggaatactatgcagccataaataatgatgagttcatgtcctttgtagggacatgattgaagctggaaatcatcattctcagcaaactatcgcaaggacaaaaaaccaaacaccgcatgttctcactcataggtgggaattgaacaatgagaacacatggacacaggaaggggaacatcacacactggggcctgttgtgggacggggggatgggggaaggatagcattaggagatatacctaatgttaaattacgagttaatgggtgcagcacaccaacatagcacatgtatacatatgtaactaacctgcacgttgtgcacatgtaccctaaaatttaaagtataataataaaaaaaaaaaactgaaaaaaaaaaaagaaaatggcaaggccttgctccaaaatcctcaaggcctccgctaagactcacctatgggaacctgccaaaggctccaaacagcatccctatctgccagtgatacctcaaaccattggatctcctgggtcatatggcccaagtggcagagcagcttgcacagcagcctggacctgttgcagagccttctcctgttctggaccccactcaaaactgagagccttttgggtcacctgataaatgggctacagtaacacacccaaatgaggaatgtgttgcttccaacatccaaacaggcccactaggcattgtttctccttcttggttgtaggagaggccaaatgcaacaacttatccttcagcttagaaggaatatctctacatgccccacaccactggacccctagaaattttactgaggtagaagtttcctgaattttagtcagatttatttcccatcctctggcatgcaaacatctcaccaaaaagtccagtgtgtttgctacttcttgctcactgggtccaataagcataatgtcatccatgtaatggaccagtgtgatatcttgtggaagtgaaaagttatctagatctctccaaataagattacgtcacaaagccagataactgatatacccctgaggtaggattgtaaaggcatattgctgtccttgccagctgaaggcaaattgcttctggtgggccttatagacaagaatggagaaaaaggcatttgccaaatcaatggctgcataccaggtaccaagagatgtgttaatttgctcaagcaatgaaaccacatctggtacagcagccacagttggagtcaccacttggtgaagcttatgataatccactgccattctccaagatccatctgtcttctgcacaggccatatgggagggttgaacagagatgtggtgggaatcaccacccctgcgtctttcaagtccttgatggtggcactaatctccacaatccctccagggatgcaatattgtttttaatttactatttttctaggtagaggcagctctaatggcttccatttggcctttcccaccataatagccctcatcctacaagtcagggagccaatgtgggcgttctgccagctgctaaatatgtctatgcaaattatacattctgccactggggaaatgaccacagtatgattccagagacttactggacccactgtaagttgcacctgagctaaaactccattaattacctgacctccataagcccctactttaactggaggaccacagtgacgttttgggtcccctggaatcaaagtcagctcagagccagtgtccagtagtccctgaaatgtctgatcatttccttttccccagtgcacagttaccctggtaaaaggccagaggtctccttggggaaggatgggagaaagattcactgcataaattgttggtaatatagtgaggtccttcctcaagggggcccagcctccccttcattcaaggggttctgtgtttgtaaactggctcaagtctggaaattggtagaggggctgttgctctctgtttttgtaattcaaattagtcttttccattcaacctgcaagttttctgtttgtatagcttaagtaggaatgcagtaggcttcctctcaatttcacttctaggaacaccatgattaattagccagtaccagagctctacacaagtcagactattctgattgccgctttgcctctgctgtccattacagcagctatgcccaccttgcctttgaaggttgagtgctgccatttggcccctgccagctcagttattcccattgtatttaaattttgtagttgagtgactgaggttctcatcattagatctgacatacagagaagagcaattacagagcacttcaaagatgcaggtgctgccctcacaaatctattttgcaaggcactggtcaagggtatatcttctggcccctcccatctgggatgagtaggtctaaagtgattaatccactccaccatcccaatctccctaagcctgtggatccctttctctacattaaaccaaaggagatcaggcatttccagctggctcacagtggccatcttttaatccatatttcagctaaccaaggaaataaactatcagaactttttttaactccccaagctgcaacattaaatgcagagttcttacttagtgggcccaaatcaataaattcagcctgatccaactctatgttccttccaccattatcccatccccataatattcatttcccatgcctgttctccagattgctgtttatgtaaattagagaactcaaacagttcttttcgagtgtagggcacctcctcatgggtcatactcttaacctcacctctaggggcctgctgggactttagtctagttataggtctataagcaaacagatgtattgggggtggcttctgaggagaatcaacattatcttgcctggcaactgcctcaggggaggccatcactcttgcctcaagcagtgcagggtttatctccccagacaaaggtggaaaggctcatggcagaatgcgtcagggaggggatgttgtcactactggggatggggaagctgctccttctggcaaaaaagttcatcagagtttacaagctcagtgtccccagcttcatcggggtcctcccacacatccccattccaagttgcaggatcccattcttttccaatcaatgccctcactttaacagtagacacctggtgaggcagtgcataaacctttcattgcaggtcagccactcgcgtgataacagcttatgtctgtttttccacaatttcagttctttctctacaggagataagactctcattcagggaaatcttagcagatttgaggctcagtgtctgcttctgaagctgggagacagaatccctgagttcatcattttctttcatcgctgtgttcacaggatttaggagcaaccaaccagcttcattatattccttggttctccacatatgatcaaaggtattatgtttagagtcactaaactccttgcctctcatgagtggtgaatcaggaggttcaaatgcatttattttgcataactctctaaacagtttacaccaaggactatcagtgttctccatactataagtagagttcttagcattttggggtgtaatcatattaaacagccaactccagaactccatccttaatattctgtttctctagaaccattcctggtaccaaaatctgtattagtcagggttctcttagagggacagaacttaaactaacaggatacatatatatcctattagataggatagacagaactaataggagatatacatatataatatatgtgtatgggagtttagtaagtattaacttacatgctcacaaggtcccacagtaggttgtctgcaggctgcaagctgaggggcaaggagagccagtcggagtcccaaaactgaagaacttggagttcaatgttcgaggggaggaagcatccagcaaggagaaagatgtaagctgggaggctaagcccgtctctccttttcatgcttttctgcctgctttatattcgctggcagctgattagattgtgcccaccaggttgaggctggatctgccttccccagaccactgactcaaatgttaatttcttttggcaacaccctcccagacacaagtaggatcaatactttgtatccttcgatccaatcaagttgacactcagtattaaccatcacaacaccagagacagacaattaaaaaagaaagaaaaaaatgatcaataagatttgaaatgtcaccctaaataataaacaaataaatacacataaaaataagtataaataccatgattttattattaaattagggaacagctcttttttcggagatgtaagtaaatctttattgtggatattcagtgtagtgtaaaacagacaaaactgcaaacttcccaaatagattagcaaaatccaagatgtgcaaatccaagatgacataataagcagctgataaaaatcaggattttttttgtaatctttgtaggtatatagtaggtgtatatatttatggggcacatgagatattttgataccggcactcaaatgtgtaataatcacatcatggaaaatggggtatccatcttaggaaataatttaaataataagacacttggggagacaagatgatctttgtactttgcaacgtaaaagagcatgttgcaatgcaatatgtgcagaatatttcattttcatacaaaataaacatacgtgtatataatgttaattaatcatagggtataactttgtatatacaacatgatatacactataagcgagaaggtatgtgcacacatacagaaaaatatttacatgcagaaggaaatacaccaaactatggataataactggtcctaggccatgaattatggattccttttcttatatctttatactgtctctgtttctcagaatgtcaactgtcaacatgaacatttctggtgatcaggaaagctgctatcagataaaaatgattgagaataaaaattccaaaggaatacacagcttacataagtactgataaaattttagctgaacataaaaccaagcagctataaatgaggcaaccaaaatttaaactttctactctagctacaaataaaatatcccacaaaggtttgtaaggatgtataatttctttgtctcattgtgataattacaaaactaaatttgcccagttctataatattgtaaggactaaatgaacagcattgttctatatagaaatgctaaaatctgaaataaatgaaatcaatagtgatctacccaatgcggctatccctaatccatgtcctgcatctcctattatttgggtcacttcctgagattacccaaggcaaaagcacatgccccttggatgagaaggagggggccagatctctcctttgcacaggaattgaatcagcccttgagcttggctgactggacctgcaaaagggaaaccagagtgtggcctgaggttgaacttcaacacacaccctggtgaggcacgacagatagaaactctgtatttatctccaggacttcctgaaatcccaagacatttttcaagaaatttaaaaactgatgtctctatctgaatctctccaaaaggaaaatgaaaatgaaagagggaagatggtaggtgagagatggcagctgtgtgaagacgcctgaggcatgtggacaggcttaggaggaagagaacggaggtcaccctgcagtggggcaaggaggggaaggcagcagaaagaacaagctagtctaggcccatggaatctctaaaggcaccacagctggcagcagagctacctctaaaggctgggcttggaatgtggctgaaggaaggggtggattaaaggtccacatgaaacagcaagaccccagatgtccagttccagccacagcacaagaggccatccctccccaaccttagcatggaccagccacccatgcaggctcctgaagcagctaagagcaatttgagaaacatttcttactatagattctctcttataagtgagagtgagtccaaatgaataaagacatacagtcctgggcttcaagatactgaaatctgttgagtatcatgctgaactttgatggagcctcatccctttagatctggggccgtagacgtcagaaggttgtatgaaggaggcacctatatgagaagctttgtgatcccttttatttcaagaaggcttctatttgggacgtggagcttacggttaatccacatttcagagggtattattgcaaattagtcaacaaatctctaggcttttatgacttccatgtgtcgaaatgaagagcaaccaaccaaatgaaatgacccatgaatattttttaataaaataggacacaaaattgacttaacatgcattcaaatgccctagaatttatttgttgcactttgtaacagaggtcaacatgtgccaagattgttttcatttatttccttaatactaaatcagctttagcaaagaggaataaaattcccaagtacttactatatccgagccaaattattcaatcaccttggaactattgaatcagtttaattttttcactggtaacttgttattcacagttctagatgtttattcatgtaactaaactaaatacattgaaaacagcttcaaattctgtgcaagattacaagaggttgtgtgcgtgtgtgtgtgtgtgtgtgcaatcttatacctatattatatacatagatatgacagagaaaaagagagattccataagtacattttggtttgtgtttgctatttgctgtggtcatgtgcaaccacatagttggcacataatacatgaactacttttatccgtgctttccagtcatgacaccaaatttagcccttttacaaataatatttagactatctgttgatgtatttggtatggctagaagaaatttttttttatttcccaagtgctgaaagcagccacaccagtctcacctcttaggagctaactctggggtaactttataaagtcaattaaaagaaagtttgaaggaagctgcatttgccacagtgcagaaaacaagaagcagcagggaaattgcaaatcttgccaattgtgggttctgccattctgggatgcagaaataaaaaaaaattaaaaggccagtgctggcccctgggatttctttttctctgggtccagcactttggactccagtcaaccccggcagctggcatcccagaccagttttagtcggcaggttggaatcctggccattcccactcagtgccttcatctgtacccaccacacataaagggctgtttgaatgagaccttaagaatcagagctctgcctattcttcattttgggcaagattcatctttgttcctcaagagacaatggctgtgctccctttcctctcagttgaactcttggcaacccacagagagtagggcatctgcttctgcgtgttcagttcccactgcactcactgttcggattgcacacaccaactctccaaatgcgttcgaaatagatctgtggctcttgagtgagttctgtgagcttcacagctgagatgtgtgtccctcatcaccaagtggatgtgggaacagtgacgatgactcagagcaggaatgaagccatgttcctccccctgcatcctggaagccatgacattcgattatggaggaaatatgtggtgggtcctcatgtgtatgaggtctacacaaggtgttggtggtgtaaagtcaggtgaaacatgatcccagccctcaaggatatttcaattcagagatgaagaatctatcagaatgcgatgcatgctaggtcattcaacaaatacacatgtgtatctactacctgctgatcttatgggaggtcatttcaacctcgactcccagttttctctcccacccacatcctacttgttgcaaatcctgccccatcttctatgtgtattcaggatccaaccctccttcgattgcctccaacctgcctggagccatcagcgcctctgccaactgggtgctcagttctactctttttttttttttttgagacggagtctcactctgtctcctgtcttccaggctggagtgcagtggcacgatctcggctcactgccacctccatctcctgggctcaagtgattctcctgcctcagcctccccagtagctgggattacaggcgcgtgccaccatgcctgactaatttttgtatttttagtagagatggggtttcgccatgttggccaggctggtttcaaaatcccaacctcaggtaatccacctgcctcggcctcccagtgttgggattatgggcgtgggccaccgcgcccagcccctgttctactctttacctctgctatctgttctccaggcagcagccaacaatggttcttataaaatgtgagtcaacgatgagaggtccttgctcaaaatattgcaaaggctcccaaacagatgagaaatatgacctgaatctcccccgtggtccacaggcctcacaggatcgaggtcaccgtcagcccacagagctcatctctggctctagctgcactggcacccggctggccgcccagccttccttgctctcctttggacgtctccctccccagcgggccccaagttggggcctgccctccctggggaccctctgcctgcagctctcttccctcacaagtgcacagggatcagctcactcaagtctgtgttagatgtcgccttctcaagtggccttctctgacagttgaaaagtcacgacgcctcttcatcctccctctcccctactcattttctctcatttctctgaagtgcttatgacatttcagcatgcttcacagtcagctcttgcatggggtcagcatgtgcctccatgcagtaaaatgcaagctccctaaggagcagttttgtttactgctctatctccaatttctaaaacagttcctgcagcagaggagcatgaaaaaaattgagcagggactgagtgttggatcccaaaacacttttcaaaatgctcaccccctggtgttgatgatttaaacactaactggtgctaacaagcccatgcccctgtgtcgtgttacagggatggacaacgtgcagtggggcatggaatgcactcgcctaactcagcctgacgggatgaggagagcttctggaggaggttgcatgcaggccaggttttgtggcagaaaatggggctcttctaggagatggggtgtgggggaaatgctgacaggcagaggaagccccttcctcccaccttgtcagttctccttttctttcttgctataaagaatgagaacatggcaggactggtgatgcagccagtgaagcagacatgcaggatgccacacaggcacagagcaaagctcccttaaaggtgaggtcggcagaggttcctagcggagatgaccctgaaaactaagttttgaagaataagtatggaatgtttggaggttctgcaggacctcaagtgagaaacagtgagtggctgagctagtgcaatgaccatggagtgaggaggacaaggttgataggagaggtattaaggggatggcatcactgggcatggtggctcatgcctgtaatcccagcacttatggagaccgaggtggacggatcacctgaggtcaggggtttgagaccagcctgggcaacatagacaccccatctctactaaaaatacaaaaattagccgggcatgatggcgggtgcctgtaatcccagctactcatgaggctgagggaggagaaccactggaacctaggagacggaggttgcagtgagctgagattgcaccactgcactccagcccgagtgacagagtaagactcagtctcaaaaaaaaaaaaaaagggtgaggggagggatggaatctgaggaggcggacactgacgggatgtggtgggggctggaggagggaagccactcagatgaagccctggggtgctgcctggatggctggaggaatagcagtgccattagcagaggaaacagaggccaggcgctaggcagaggaaaaggcatctagaatcaatgacctggaggtgcctgtgggaaatagaagtgacgtctctgtgactacctggtgtatggttagatgggtctggagctcagatatggatgatgtttagcttcattatttgctggtttattctaaaaaatttaaacatatgccgagattaggaaaataagatagtggaccctatacgtatccatcaccaagcttccaagattgtcattccactgccaatctggttttacctatgccctcacctatgcccaaccttaactattttgaagcaaatagcagacatcacatcttttcatccataaatgtctcaagaatgaagatttttttaaacacacaatacctctatcacaccaaaatattagcaataatttcttaatattatcaaatatccagttatgtacaaatttttcccattgactaatacgtatttttaaaatctgaatcagaattcaaaccaggatgtctcttaaggtttttgcagactctaaaatctttctctctctctttctttctcctgccatctttctctctctctccatttttttacctcccttcttcccttactctttctcaatttatttgttgaagaaagtgagtagtttgttggtagaattttatatagtctacattttgctgattgtatcccaatgatgccctgtctcctatatttcctgttaactggtaattcaatctagatattttatcacatccacgttcaaatttttagcaataaaatacaacaaaccccccatatctgtgtgtcctgcactcatggattcaagcaactgcagatagaaaatagtttttagaaaatcgtgtctgtactgaacatgtatagacttcttttttcttgtcattatttcttaaacaataaaatattgtaactattacataacatttacattgtattagatattataagtaatatagaggtgatttaaatcatatgggagaatgtatgtaggctacatactaatacgaagccattttttatcaggagcttgagcatctgtagattttggcacccacgggggccctgaaagcagtgcctgcagatgctgagggatgcctgccctcatgcgatgccagcacttccagcactaggcacagaagcccgctagcctcacctttctgacattagcagacactggtggtaagggcccaacctattatttcattagatgtgaaaagatgctaacagtcaactccaccaatccttccttattgcttatcagctggaagagatcaccagaagtcacgaaacagcagtgccaggccgggatgaggacatccaggaagagggtacagggtgaggcctggggaccctcagcacttcaggagaaatgagaaggggggatgctgagaacagcctggaaagtgaaggtcctgccagaggggagaatgccttcaaagaagccaaggtggaggagcgtcataagcgacagggagggccacagtacccagcatcctggcataacaaagagataaagcaggagaatcacatggaaacgacagttccttgaccacaatttccatcattgtatttgaaggaatgaaaggcgattgaccttgatttagcgccctatatgacacctccagcctccaaagctggcttccacgcaggaggcatgactttcccctgcattcccattcccactcgccttcctctgcctgtgggaagcagtcaggataatctaggctgatttgcttgaagaagcagatgatacatgattgggggaaaagcaacagcctgtccttgtttttttgttttttttttaagtctagtctctgagtaaaaggaaagtctcataaaacatagtagcaacccatttagaagctgtgatgagaaatcgcagtttcctcattggccaacccagagaaaggctttcctcttcagggggatggcacagagttggaaaggaaatgaagacaatgcaggcagtatcggtggactcctgagaaaatgatgactcaggcagttggtggggagaagtgtcacattgtctgaggatgtccaattgcaagggggaattatgccccttaagtaggtggagccaagggaggtagcaagaactagcccaaaagtatatatggatgtgattagtcacaatggctgtaatagtcatacagggctcccttcccaccatggtccaggaagcaactgactccaggggcctgagaatggtactgaagcagaacgaaatcctccttgaccctaacaatactgaaacaaagtgtgattcagcagcaagccaccctcaggagcctaggaccaaggactaaatggattttcagccattgtcagagtggatgggtaaagtcaaggacctgcctacacagatgacccccacccacccagcatcacgatgaccatgatctgtgctgcttctatgcaagcccctgactatctgcgaaacaccgggaattgaagtgagacacaaatccaaattaggtttctgtcaaatagcaagatggagttaaaaaggaaattgagttagtgtttaaaatagaaagagagaggacagagggagggagggaaggaagaaaagaaaacaagaaagttacaattctttatatacaaattcatgtctagatgtttatgtattacacactctcctgcccacacacacccacctctaaaatttggaaaacaataattttgaaagcccaatatttgctaattcttaatttcttctactagtagcaacaaggagttaaattttctttccttctattcggaggcatttctgcccttagagaccagcccacatcaggtaataacacggcagcctcaaattgagacccttcatgtttgttatgctcatttcataatcattgtcatctctgatgagtcatttcaccctcaccataaatcatttatgacacttgaatataaatatgaaaatagaaagctttattttaaaagtgtaagcaggctgggcatggtggctcatgcctataataccagcactttgggaggccgaggtgggtggatcacctgaagtcaggaatttgagaccagcctggtcaatgcagtgaaaccccgtctactaaaaacacaaaaattagccaggtgcggtgggggtgcgcctgtaatcccagctctccagaggctgaggcaggagaattgcttgaacctgggaggggaggttgcagtgaacccagatcacaacactgccctccagcctgggtgacagagtgagactccttctcaaaaaaaaaaaaaaaaaaaaagtaagcaacaaactccaagctataaaacttttgaaagttttgcatccctgaggccatgtagccaggcaatgcctgggtagtgagcacttgggttgttagcctggtgttgctctttgtcctgggctcagagctggggccgacaacacatacaaaccacccacatcttggcaaatatatgccgccattgtcacgtttccaccagctcgaaagtgaggttaaaaaaaataatccttaccagcctcaagctctaagaagggaaactcattgcaaaaggatcagaaggaaaaataaataaataattttattctcttctctatagcttatccacaccctaattagcagcaggatcctaatccatatcctgctaatacatatcctattggttctgtttctttggagaacccctgactaatacatcaatactctgcagagatttcttgatttaaaataacaatgatattttgggtgaggagtaattaagtgattctaaagtttatctgtaagcatacatagaagagttagaaaagagtgtttgctattgtgaatagtgccgcaataaacatacgtgtgcatgtgtctttatagcagcatgatttacaatcctttggatatataccctgtaacgggatggctgggtcaaatggtatttctagttctagatccttgaggaatcaccacactgtcttccacaatggttgaactagtttacaattccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatcttttcatgtgtcttttggctgcataaatgtcttcttgtgagaagtgtctgttcatatcctttgcccactttttgatggggttgtttgattttttcttgtaaatttgtttaagttctttgtggattctggatattagccctttgtcagatgggtagattgtaaaaattttctcccattctgtaggttgcttgttcactttgacgatagtttcttttgctgtgcagaagctctttagtttaattagatcccatttgtcaattttggcttctgttgtcattgcttttggtgttttagtcatgttactgggtgcagcacaccaacatggcacatgtatacatatgtaacaaacctgcacattgtacacatgtaccctagaacttaaagtataataaaaaattagatagggggaaaaaagagtggtgacctatattagttgtctattgttacataaaaaattaatctcaaactgaaaagcaacctttaaaggcattgggcagcagttttggcagggtgttcatattgtctttggaagccatgcgctaatctggaaatcattcccatgtatttatcaggaagtaagtcaagggtaagcataaagagtttccaaagtgttggaacctggtgtttccaaagaggcaacacatttctgccaaggatcatagactttgccagaattctgaggacaacagggctccaggtgtaaccagaacaccaataattcacatgtcaggctgggagttagagtccatcacaatatgaatacagctaaagtttgtttttaataaaacattttctgtaaggcaaattaggataactactaaggcctcacagctgataaatggcagagcaggaatttgaatcctgttcactttgtttacaaagcttgtgctcttaccatatgtgatgattaatttcatgtatcaacttgactgagccatggggtgcccagatatttggtgaaacattattttaaatgtgtccataagagtttttctggatgagattagcatttgaattggtaggctgaataaagtaccttgccctgcccactgtgggtggacctcatccaatctatcaaaggcctaaatagaagaaaaagtctaagtctgagtaagagagaatttgtgctcttggtcttcacttgccttcagactcggaattggtctagaacttaggagattcgctcgcctggttctcagggttttggcttcctgggtctccaccttgccaactgcggatcttgggacttcttggcctccacaatcacatgccaattccttataataagtaaataaatacaaatcctgtttctctggagaaccctgacaagtacatcaatatgctacagaaaattcttgacttaaagtaacaatgatattttgggtggggaacaattaaatgatactgaagtctgtctgcaagcataaatagaagagctagaaaagagtggtgatctatattctgtctattgttgcataaaaatcactccaatatttagacacaaaacaacaaacactcatcatctcatgatttctttggtttgagggtttgggagtggcttagcttagtggttttggttgaaagtcactcaggatatttggcaatgatgaacattttattaatgtcctaaaactgggttgtgaggttggttaaaatttactaaaagttattaaatggatctatggtctgagcgtttgtgtccccttcaaattcttatgttgaaacctaatccccaatgtactagtattaacaggcagggctttgggggtgatcaggccatgacggtgcagcattcatggatgaggctagtgcctttacagaagagcccaggggagcatgcatgcccctcccactctggagactgcagcaagaggtgccatctatggagggaagggagagccctcaccagacacagaatatgctggagcctgtatctgcaacttcccagcctctagaatttcccagcctctagaaggaatacatttctgttcttggtaagccagccagtttatggaatgtttgttatagcagcccaagatggttgagacaagtggtagacttatgatgggtgagtatatgaattctatctcagtaaagctgttaaaaagaaaaagaaaaacaaagctaaaagttgtttccttaaaaaaattagtgaaatcagtaaagtttagcaagacagatcaaggaagagaaaaggagaaaatacaaattaccaatattaggaatgaaaagagaaacataactgtgtatcctacagttattaaaaaggtaacaagagtataatataaacaactttacaacctagaatttgccaatttagatgaaacagatgaataaattctttgaaaaaaattccaaaagtaataggaaaagaaataaagaatcttaggtattttatgaggccagaataacttagataccaagactttacaagcaccttacaaaatacatacatgcaaaactcttaaataaaaattagcaatcaaatataacaatatacaaaaaatacattattaccaagtaaatttattctaggaggttaatagtagcttaatacttgaaagatattcattataactcaccacatgtggtgaaattcaaatacgaccacaaaggctttaatactcccccttcagtactgtggtagaacgtaattcccctgcccttgagtgtgagctggacttactgactcctttgtaactaatagaatgaaacatagtgatgatatctaacttcagagaccagtttataaaggacactgtgattttctcatctctccctttcttggattatagtcaaccctctatatctgtgggttcctcatccatggatttcattgactccacattgaaaatattcaaaataaataaataacaatgcaacaacaaaaataatacaaataaaacatacagtataacaactatttacatagtgcttacatagtatttggtattataaataacctagagataatttaaagtgtatggaggagaaaggtatatgtgtgtaggttatatgcgaatactatgccattttatatcaggaacttgagcatctgtggattttgatatctgcaaaggatactgaaaccaataccccacaaatactgaaggatgactatactcaccttgaagtaaacaaacagctttacggtaaaatatatatcacataagatttgccattttaactatttttaagtgtaaaattcagtggcattaattacatctccactgtctcattccaaaattctttccataccccaagcagaaactctgtacccattaatctgttaccgattttaaacaataaaagttttcattttctttcattatctcattggacataagatatagtcagcaataacttagttaaagccttttcttatatttaaatgtaattataggatacttttcttgggaagggaggaatgacaattgattctaaccacagtctaatgactttaactgttctggagctaagtttacctgtctttagaaggtttggaaccatggtattaactacatcctctatttcatgaacagcttccttgggcacaatagttatgttctacccattgagatagatacaaaacagggtgagatgtgttcaggaaaataagcttgttattaatacttttaatataacaaatactgttatggtccagacaccaaactgagcaatttacaacgtttacctcatttaatcctcatgacacccctatgacatggttactatttctatgtgcattattcagaataagcctgtgacatctcagcaatgtcactgagccacacactcaccctcctttaggtaacaccttcactacctaaggcaggtgaaaaaggaatcataaccatgagagctaggtcaggggacagagtggaatcaagacactagggtcacccttgtgagaagagcatataaactatcatgctaggatgctttgacatctgacttgagttttctttgtgttgggcacgcatcgcatagtgtggtgttaagtacgtgggttgactctgaaataaagccatctgggtttacatgagagctatggaatttattaagtcttagaatttactaaagcttttacttacgaaggcaagttaacaaacctgtgtaagtctctattctgaataatgcacatagaaatagtaaccatgtcataggggtgtcatgaggattaaatgaggtaaacctcgtaaattgctcagcttggtgtctggaccataacagcagttgttatattaaaagtattaaattaaaatgaaacatcaataaatgtcagtaagtgaaggtttatgtgctgcttttgagattcataaacatggctgaaaagagaaggggtttaatgaacaagactgttcaaaatgtcaagtttacagattatcaaaactgtttctttaaatagtgtttggatgtcaagttttggaatggagcaaattaaatattcctttcacagtctttctcttccaattctaagatgccaagtttcagacaagtgcctgaattccaagtgacattccaacatagccctgttataaagtgcctttatgctcattcttctataaccttgatttagtccatttgttttttggaggaggagggtttcaccttcaatagctacgtgcgaagtctagagacacattcaagtttatgagaagtttgtactttgcattgtttatgattattctgactcaagctgaatggcccatttctctgtattgcgacagcccgggcaattgcacacctgagcatgtccttggaatgcgtgagacacaaacattccaaactgtagggatgccaactattccaactatgtatccagagttccccacacgtatcttagcaaacaagaacaaaacaactcgatcccattgcttgaacatgttgggccacctcatgttctcaggccaccatcctccacctcaggtcacgtggtgaacatccataagtaaggattattcagactgaaggctaacaaggaaataaataaatgacccaggataagccatggtatctagttcagggtttttttagagacagtggatagagcagtcattgggtctacttatgaccaggtcaatgatttcccgaagtctaaatacatccaacagatgtgacacagtagactgccatggtcttggtagccaaggaatttgctcccaagtggaagagaagggagcagtggtggttcttgatatcctgtgggcattctcagcccagaaaagggaggctcttatgaaccttctgaggaataatacattcttttaaacacagaagaatctagcagaagcttatacagggagaggactgcaagtgtgaaccaagacctagcacctggcaggccagtcaaataacctggccatacttggtggtggggagaaaggaagccggcccagtgttcctacaagcactgcccagctcgattcccaggcctgtggcaaagcaccacatgcggtcttcatttcactctggaagctgtcagtacagcccaggtgtttctgctgcaggctcgaaagggctgaaactgccggtggccatttggggttggggttgagagacagggactgacaattgcaaagccttgaaatacaaccgctactaatcacaaggaatgaaagtattgccatgttgactatgcaacatttagtaacaatagtacattttaaaattagtgtttgcttaattgttgctcaattacattgatgctgctatccccaaatgccaaactatttccacttttctgttgcagaaaaaagaacatcacctctatagttataaccttgacatagaaaataagtatatattttgtttttgtatttatgctaactttgaatatgttttatgttgcataaactccacagttattattttaagttctgcattttaaaatttatttccatttttatcttatggtagaatattaaggttgatgccaataatttgctattatatgtaaatacacaatgatcatcttcttacttttagataaagtcacagtagtaggatcctgatcaaaggtatttttacttgtcagtatgtttttctgtcagttttcacaggacagatgctgcaaacgtggcttcagtaacactgcattcattacgtcaggtatgtcacagggggacacctccttcactgctgacacctcattaatcgtaaaaggtatcttatcagtcttctaaatataatttcattcacacatcacaatgttaatcatcatttgatgtttgcatattaaaaatatttcctactatgcaaattttctgtacttaaacttgaagctctcattcaattctcattggtttgaataacaaatacattttcctgtataagccaaaaatattttccaagttatttgtttttccttttgataggtatttttcatatatgtttaatgatttgtatagtctcatgactgggagtcactgggagatcttacctcttgcagcacccacgctcccatacttgacacagtcctaaaactaatgacagcatcatctcacttacacgcgggatgtagcaagggtggattcacgtgcatggagagcagaacggaggtgaccagaggctgcagggagaggctggggaggtgttggtcaaaagatacaaatttcagttagacacggggagtaaggtcaggagatccattgtacaacatgatgactatagttcccaacaatgtattatattcctgaatattgctacaagagtaagtttcaagcattttcaccacaaaacgatacgtttttgaggtaattcccatgttaattagtttgatttcaccattccacaacatacacacatttcaaaacatgctgtatgttataaatacatacaatttttgtcacttaaaaaatagtataaaagaagccactaagagaaaaaaaaactcatgacaaatgactaatatgatgaatcatttgaggaatattggtgaaataagattaagagaagattacactgaagaaggaaagacccacaatccctctagaggaaggacagtcaccaagaggagctagtggggtggcggcgctgtcaggaccgccagggccacacgtggaaggaggggacatgaggggctgctagagctcacccttctcatccctgcacttgtcgcccaggaggatgggctcaggggcaggatcctcccatcagcctgctgagggtggggtgtggaggtgtgaaactcaagtgtgtacaagaggttacatttgtataaaagcttgtttccgtctttttttctgattagattttttctttctaaactgagctatcattgacctggttgtgtaaattcagtgaatgtcaatttcccctccaagccaatctctatcaggttttcggtccttactcagtgtggtgtggaaagcaggcatcatgtgaaccacttattggtagacgctaaatgaatctggcacactctgaagcatgacattagaagacatacaaatgtcttcttgcctgtagtagtgaagaagatattgatgctgaagatgcatgtgaaaagactgaataaattttttaactaaaaatgaaagcatcaaagatatcctgcaatagagtcatagttctgagaaaaatttaatgtattctgtaactaaaaaaccctgaagtgcaagagaggcaaactatgttgaaaagagtaaatacttttttccttaaataggcttactataaattataggaaaaaacttttaaatatttttctgaggtttattctgcatattattaaaagacatagaacatctacaaaacgtgtaagcaatattaacgacgaagctacaacatacacagctccactggtatggagagccagatgctccggtccacactcacactctgagcaacgctgctcctctggagactcctcagcaggagggacggccgctggtgcgctggggaaggagccagaggcagatgaagggcaaaggagatgggcgggactgccctgagggtgggcacccagtttcagggcaatcaggacactgagcacagggcgacagagacaggggagtgggctccggacaaagtcaggctctctaggtgggtagcagagtccctgaactaatttcctgttgctgctacaacaactaactacaaatttgggcctcaaaacagcacacgtttatcaccttacagtcccagaggtcagaaatccaaaacaagtctcactatgctgaaatcaaggtgtcaccagggctgcactccttctggaggctctgggcaagagtcctttgtctcatctctgccagcttctggaggaaagccaccgtcacgccctggctcacggcccctttttccagtcagcagtgtcaggctgcatcttcctcatgcggccatctcccatccttctgaatctcttgtccacttctacagatccctgtgattacatgggacccacctagattatacaaatattttcagcatctgtaagttaatcatgggggcaaagtcccttttaaaatgtaaagttaatgcattcataggtacgggagatcagagtgtggaaaatatttggagggggtcagtattctgcctgccgtagcccctatacctgtgatactcccagggcttgatcaaggcagatgcacaacctctctggacaaacacatcctccgtagaggcctgcaggattcacacacatgaagatcaagcagcaagcccacaaccaacaccaacaaagcccgaggaggcgagccacgagagaggtgcagtagcaggcacagacggcagactctcaccctgcaggaagtgggcatagatgatcaggaatgagcatgaagatattagaaagatcaaagacacacacagagagaaagagagagagagtgagagacagacacagagagagacagagagaaaatgaatgaaggagaggcaatatttgaaaaggaaatgggtgagaattttcagaaattatggaaaaatatacagattcatgatgcaaaacatatattaaactgaaaaataaaagtaaaatgtacaggacacgtcttctaccctgcctcacatcttcttggctactgtttactataataattgctgcagcaaccatctttctgcagggacagctggcagcatcatgcctcagctgcaactcatataccttgctttttgtccggtacttctctgatgtatatgggaacctgataggcacccacacatgcaccaaacctgaaaattcaaggaggtaagcatttaatagaataatcctgaccactggggaacagaaactggtggataaatgctccctcccctagtgcatgcccacacagccaattctgaagcacattctaaaaagcactcagaacgtcccagagggcttgagccccaagtttccacaaaagtgattagatcaataacgtacccttgcattgggtctccctacatccttattctatttttccaatctcatttttcctctccctggcctctatttccccaaaataaactacctgccttcaagactgtgtgtcagttaggctctgatttctggggggaatcagaactaattttaaaaagtgaatttccatatatgttggagaataactgcaaaataccaaatataatagaaagtcttaaaactgttcagagagaaagaaagaaacacctaaaaagaaattattgtaagactgatagtagacttctcaacaataagagaataaaaacaatagaaaaatacttgaaaaggctgaaagaaaacaactattaatctagaactgtgtaaccagaaaaaccatattttaagagccagagtaaaatttaaaaaaattctagataaatagaaactggaaagcttaccatcaatacatctacattaaagaaatttctaaagcatgttcttcaggatgtagaaaataaacttagaaagatgttatcagatacaaaagaatggcaggaaaagaaattggcaaacatgtataaatctaaacaagcaaaacttctaagatgtaataaaaataatgtctaatttcagagttaaaaagtaaaacaaacttaaatcttgggcaacaataaatgtaaggaaaaaagagtattcaaagttaaaatgttgcaagtatcccacagcagtgggtagagacgttgagatattaattttagacttagttccatatacaacgtaacattttaaaattcagcctccagaaaaagagaaatagaattttaaacttccaaacacactgaagaccaaacagaattaaaatgaggaaaaaagaaacagcaaagcagaataaatgaagagcaaaaaacatgaaatgggagaaacaaattcaaatatatctgtgaccacaataaatataaatgatctaaactctcccactaaaatatagaggatgtcaggctggcttaaaaataagaataaaatgagtctatctctatgtggcttgcaaaaggcttgcctaaatcataagaatgcagaagagttgaaactaaaacaattgaaaattttaccaagcacatactaccagaatgtatatttctaaatgcttacaataaaaaagaagtacaagaaatttgaaagcagaaatcagctaaatagaaaacaaagataaaatagagaagataagtagaacaacaaaaaagcaggatcttagaaaagactgtttaataaaagaggtaaacctccatgagattgccaagaaaacagactctagtatatgatagaactgaacagggaggcatgcctacatgtaggaaagagattgaaataatgaaattactaaaaataaccttattccaatgcatctgaaaacaagtaaaatgaacaaacttctagaaaaatatagctaaacaaaaacaagttcaagacgaaattttaaaaaccttaatattcctataattagaaagaaattaaaataatgtttccaaattttagactcaaactttcttgcagacaaattaaacaaacttttcagaagcagattatttcaaacttataaaacttttcccagaaaatagagaaaaaaaggaaaatattccataactctataattcatatgaagccaatataactttataataaaactagagagaacagtataaaaatgaaaaaatctaaattaatttttctttacaaatatacataaaataaatcataactaaaatttataaataattaaaatcatagcttaatccaataatatataacaaagataatatatcatgagcaaattgcaaatgccagtactttcacattaaaaaaaactataaataccattcaagacattaaatacttaaacagcaaatattttatgaccaccaatagatgcagaacaaattttgataatccatctctattcatgattttttaaaaaaatttctggcaaactcagaatagaaagaaacttttttagcctgatgaagagttatttacaaaaaggttatacataaaacgtcagtcttgatggtgatatctttgaaataatatccttaaaatcaataatgtgccaggcatggtggctcacacctgtaatcccagcactttgggaggctgaggtgggtggatcacttgaagtcaggagtttgagaccagcctggccaacatggtgaaaccctgtctctactaaaaaaatacaaaaaaattaaccaggcgtcatgacgcacacctgtaaccttagctactcgggaggctgaggcagcacagccgcttaaatccaggagacagaggttgccgtcagccaagatcgcaccattgcactccagcctgggtgaaaaagtgagactctggtctcaaaaaaaaaaaaaaaaagaaatcaataacaagatagggtattcattatcacaatctcattcaaccttgcactgtagatcttccccagagcagtaatggaaaacatagaaataaagccataacaattataaaaaacaaagctctcattatttggatataactctctgcatatgaaatccaaaagaatgcatgaaaaaattattagaataatgagagtgtttactaagtagctgaccagtaaatgcattatatatgtcatcaacaatcagaaaatgtatggcttaaaaaataccatgcctatatatgtaacatatatgttatatatgttatacacatatgtatgttatatgtacatatgtacgttatatgtatatgttacatatatatgcagagccagatgcatatacacttagctatatacatacttataataaaaataataacaaaatttttaagtcacctaagaaaaagtctaacataaattgtgttagatctctatgagaaaatttacaaaaacttaatttaaaacattaagaaagacataagtaattattgtattttggattaaaaaactcagtattgtgaacatattatttctctcaaaattaaaatatagagtggaagaaattccgatcacaattctctagagcttgtcctggaacttgactagctgctttatagttttacatgggaaaaaaaatgtgagaataaaccaatcaacatgctcctgaaggaagaggatgagaaagagaaaggacaggtggaaaaggggtgacttggccatcagatttcaagattttctataaggtttctctggtaattaagacagtgtggtacaggtgcaggaacagaaacatggatcagcagagcagaatagagatccctgaaacagactaatgaatacacgaaaatattatatatgatagagatggaagtataggcaattaagaaaaaagggactatagaattaatgaagctgggagaaatggttggaaaaaatcaataaactttatccctactttacacaaaaacaattttgatatattgagaaacaaaacatgaaaggcaaaattttaagctttaagatgtatatatcataaaaaaatgaaaaaaaatgacgggaagttgcttggcagttacaatgtgcattgctccagtgatgaatgccttattgaaggccctgactccaccacaatgaaatctatcagtgtaacaaaattgcacttgtacccgtggttacatacacctttaaaaaaaagttgaaagagaaatacatgttttactagatcttacaaaaaaaggaaaagaaaagaaagaaattcaagagacaagccacaatctgggagaagacatttgtgacaatatcccacaaataattcacaaattgaatatatgaataactttataaatctacaagaaaaagaccaaaaaaatagaaaaatgggcaaaagacatgaatagatggaagactaatgggaaaaaggaaacgaaaggaagcaagcaaggaaggaagcaaggaagaaaggaaggaaggaagaagaaaagaaacgtttctcaacttcattagtaattaaagatgttttattttattttcaaaataaggacacaataagacattgttgtcaaaataagaaaataatgataacattctatacctactcaaaattggtaaaaatttaaaagtccaatataccatgtgttagaaagaatgttgattcaacaagaatttatacgtttccaatgggtacgtaaattggtacaatcattttttgaggaataactggtattaatcaaaaaagcatggtactagtatgaaatgacacagagatcaatggaacagaatagggaacccagaaataaaaccacatatttacagccaactgattctgacaaagttgacaagaacatacactggggagacacaccttttcagtaagtggtactagggaaattggattgctttatgcaaaagaatgaagctggatctctaactctccatatacaaaaaccaagtcaagagtgattaaagacttaaatgtaagactggaatctaaaaatagtattagaaaacctagggaaaactcttccggacatgggcctaggtaaagaattcatgacaaaaatctcaaaagcacaggcaacaaaaaccaaaaaatacacaagtaggacttaattgaactaaaaacttctacacagcaaaagaaataaccaacaaagtgaacagacaatctgcagaatgggagaaaatatttgcaaactatgcatccaacaggggacttccttgggaaattccaagggaatttcaactcgacaacaaacaactcagcaacaaaaagtcaatccccttaaaaagtgggcaaaggacatgaatagacatttttcaaaagaagatgtacaaatggacaaaaagcatatgaaaaactgctcaacatcactaattctcacacaggtacaaattaaaaccacgatgagatataattttacaccagtcagaatggctattatcagaaagacaaaaaatagcaaatgttggcaaagaatgcagagaaaagggagtgctcatacactattggtgggaatgtaaattaatacaatctacgaaaaacagtatgaagatttctcaaaaagctaaaaatgaaactaccatttgacccagcaatccctctacttagtatctactcaaagaaaagaaatcattatatcaaaatgatacctgcactcatagtttattgcagcactattcacaatggcaaagatatagaatcaatgtaagtgtccattaacaggtgattggataaggaaaatgtggtacatatatacaatattattcagccatattaagaatattattcagccataaaaagaatgaaatcgtgtctttacagggatggaactggaccccattatcttaagtgaaacaacttagacacaaagacaaatacctcatgttctcacttataagtgggagctaaacatgtgtacacatgaacatacagggtagacagtggagacacgggagggtgagtgtgcaggagaagagtggatgatgggcaattacttcatgggtacaatgttcattattcaggtgatggatacagtaaaagccctggcttcaccattactcaatctatccatgtaacaaaattacacttgtaccccataaatttatacaaaaaaaaatttttttaatccaaacattcacgtaccctataatacaacaattcaattcttaggggtatacctagagaaacatttgggcatgtttctcaggggacaggtaccagcatgtttatacagtacaacacaaatgtccttagacagaagaatagttaaataaatatcagtgtatttgtataattaatattatgtatcagtgaaaatgaataaactataggtacaggaattgatattgatgagtcttaaaaatacaaagttgaaaaaatcaattttcaaaagattacatacagtatgtactataacatttatataaagctcagtaaacaactatatatatataaaatccctaatatgtatgtgtatcactaatatttatctccctaaaaatatcccatatgcacatagggatataccaaccttccaaataacacttcttaacttctttcattttctcagttagattccttggtctgtcatgtcactggcactcctgttagtaccttaaacggtctttcattatattctacccacctggaaaaatccctttgctcaggcaacaagtatagagaaggttcaataaaaattcagaggttcctacataaactctgactgagcagtcttcacaggccctcagtcgttctggctcctccaatctcactcttactgcttcaaatctgtttcgctgttacccagctaacaacgccaccctcatcctcagcacttacaacaaatgcttacactttttactttaaaaataaaacacacctttgtcacctggacaagaaactgataaaactaacctgtgtagtcacacttccttcctattacaaaagacactgccaattctccaatctcttcacctaggctttggagcttctccaccccactgattagtatagaagcttttgttgcgtttgtgtagtaagtttttccctctcagtaatgcagaaccaggtgcataatttgtgggtcccagtgcaaaatgaaaatgcagaacagctggctcagaagtgataaagaatttcaagctggcagcagcagagccttaacccgagggcagggccttgtgagtccaggaccactgcaagtcagctttatggcaggatccttcccatcagctcagagaggatacattcaaaaacagcaaatccacctctatctctgttcctgtcctgctatgaaagaacctctcctcccccttagaaacgtacctagcgttgtctctatttgttgtctctcacacctgcccatacctcaatgcattccaagccgccttcaccccagtggcttcatggagagcattatgtcccaggaccgccaagggctgtggggttgccaagtcaaacagttgtttttcagttctctccccgttctgaaaacacttttcttagcttccatgagccacactgtcttgttgttacctctgcaagagattctgtgtcttctttgcagaatcatcctcctcacctagacagtcagtgaacactagaataacttaaacaaaccagcctttccctcttgcaaatataccttcttcccttggtgttctcattggagtccacatctttagtttaacttctttatggtgtatacgtgatggtataggattggcatatttttatgtagctaaaactgccatttctctccctttgtagtagatttattgacctatttaggaaggctttctcccccaaatcctaggaacaacctatttatttcttaccacttttatgttttttaatttttttaaaaaaaattttgaattctattccagcagaatttattttatatgtggcgtctacattttaaaccaattattttagtttccaacatcatctgcctagtaatttgaaatctcactttatcattttttggaataaacaaacattatttttatgatcagagaaagtgacaagttttaaataagaaaataatattgtatataatgaaatctgttttttcttcacaatttatcagagtaataaatgatcaaaactaattctttatcacattttctgatagttttccaatcatttcattttctattcaaatcttaaataaattataatttttaaatttttttttctcacttcagaatataagctctgtgacagcagggattttgtatctattgttcaatgccttatccctaccctacagcttaaaacagactagcaggaagtgtttaatacacatttgttattaatagctagataagtaattgaatgaatgatttgctagccagtttctctaatcttgtacctatttattttttcaaggtgttttaaattaccttgaataattttttttttttttttttttttttttagataggatctcgccttgttgcccagactggagtacagtggtgcactgctacctcggctcactgcaacctctgcctccagagtttaagcgattctcccacttcagcctcccaagtagctgggattacaggcatgcaacactacacccggctaatttttgtattttttggtagacacgaggtttcaccatgttgatggggctgatctccaactcctgacctcaggtgacccgcccgccttggcttcccaaagtgctgggattacagtcatgagccactgcaaccagcccgaataatcagttattatactctaatatgtcattggtctataattataattacaaaccctattggttccattgatttaattgtctaggggcatgccagtatgactgcattccaattactgtgccggtatgttacctttgtatatgttttggctacaatatctgaacttcccagaatagtttccgacagtcttatatttgaataaataggataatcatttagttttgttaaacaaacattattttgtgacttccagttgactcaaacactatttactaatttacaaaagcttgttttttagcctatccatgtacatagtttgcattcggggatccagggtgtgtgtcagggaggaagcaacataggcctatccccaggaggcctctccccccaggacgccctcgggcgccgtggaagagaaccggagatgctatgaaggcagggccaccccattggccaggaagagagaggcaagcgatatccacgggcagagggagcgcagacatgggcggaagagcagcggcttccaaaggctgcaagcaggaaggaacaggcaccaaaaagaggggctgagaaaaggagcccgcagaggcggtgctgggaccccgtgcttagacaggaagagagaggcataaggaggaaggacccaggaaaaatggaggagtactttatttccttgtatttcctgatcagaaatttgacgttcagcgtaagaaaattagaaagcaaaaatttatgaaaatgaaaataacattcacccatcatgtgagaaatgaggactaataacttttacttttaatgttttactttgtagccaaaaaagctaaatatttttatagtttcacatatatgttttccccttccccatccatttcctggacctaatactttcatctttttttcccaccttttttgatcatattttaaatctttctttcaaacagataatagctggattttattttttagttgaatctggtatgcggtcatttctacgctcacggggaggacccacaaccaagacccctcgccaggttgtttccaggccttgggtccttgctggctctcagtggtgagagactgagtacacaaatggacaatggccagagcatctataagagtagaactcccacccaccccctgcagcagccagcccaggaggccaagccttcatctacaggaaccagccagggaggccagcctgctccatgccaggcttgtaggaattcagattgctgtctctagaaataacatgggaaattaaacattgcagtctgtaataatcagacccaaacagccaggacttgattaataactcacagtttcctagatttcatccctgcttccaatctagggccaaccagagaaagcccagtatgtcccctagccagtcccatgggatgcccacttctcaccagccgcccccggcttcctcaggcccacagcccctgccagggcacccgaagcctccccttttccacggtgaagcttccccactccttgcctgcctgagtctgtcaggatgcaactgatggccatggacccccttgctatagcagctctgaataaacagcctttgcctgttcttatttgggtggtcttcatttatttccacagtgggagacatcagttccttgacacgtgaccctctccacagggcagctcaggacatggcagccagctcccctcagcgcagagacagcagcccaaggctgaaactgcagtgttcatgtcgctaacctcagcagtgacagccatcacttccgctgtgtcccattcttagaaaccagtcattggcccagcccacacgaaggggaggggattgcacgcatgtgcgctggccaggaggtggggatgacctccacccaccccacctagcgtagtgacgaatgcacttgatgttatccaatcataacatgtatgttatttacggcttattttataccgttgtctcttccttttgtttttgactttttttgatgtttgtcatatgattttccacatgattattttgaatgtcctctgtatatttccgtttcattaattgtaattttccttttctctgctctcagagacagatgcatttgatgagactattttttaaaacaagggacctactattttccctccatgaaattcgttgtatcattacgacgagactgtctgatcatacaataagaggttgcctctaaaacagatccaccgcttaagtctttcatcccattgtgatctttaaaacttgttcacacaccgctctctctgtgctgccctaggcaactccaataccttgctaatatgttggtcatttgttaggattcccttcacatgtgtctcggtttcaagagtcctcatttcctactcctaagatgtttagtcttgtcaattttcatacacggacagacagaggtctgttttccactgctatttcctcttctgtttccaaactcccatgttaaaatctgtcctcttggtttgtttttacattttttttttcactttttactgaacagcaaagtgcacacatcaaaaatgaacaacttgatgattaaatgtaaacctacttacgtaactttcacatgccaggaactaaaacacagccagcacccagcagctccgtgccccctgcctcaacccaaggtagcaccatgccgacttctgatgccaggggtccattctgcctggcttcaaactttctgtcaaaagaataatgcatcattcactaatctgagcctgacctctttcactgaaaattacgtttgtggattgatccatgtagctttagttaattctttttaattaatagatagcttttactcatatgaattaccatttactcatccattctactcatggtggacattttggttgtttctaatttgcaacaattacaaacaatgcagctataatcctttgtatgtgtcttttggcacatgtgggcttgaatttgttaattctatatctagaagttaaattaccggtttacaggaaataaatttttaattttaacaaatagtttccatttccaatacttgtacctctttgattcccagcagcaatgtctaaagtttccctgttcatttgtttttttttctcttttaactcagcatttgttacgtttaataaagacttacttgaacattgacaactaaaacaaaagaatttcaggattctaaactttacaattatttaccaagactttatcagcatctgcagaaaattagagccctgatgtcctacccacgttctcagtcccacgttgaacactaagaacagggtcaatcagaaaacttacagaacgagatgctattgtggccatagaatgcttgccacctagaaagtcattttcttcttcttacctataaaattccaatagtaattgtaacagctaaaatctggcagaccctagaaacttaatgaagatagctatattctttatagctatattgtttattcattgctgctgttttaattttatttttattgaggtaaaatatatatgtaaaatttaccatctctactatttttaaatgttttatttttaattttatgggtacatagtaggtgtatatattcatggggtacatgcgacattttgacacaggcatacaatgtgcaataatcacatcaaggtaaatggggtatccatcaccacaagcatttctcatgtcgttgtgttacaaacaagccaattatactcttttagtcatttaaaaatgtacaataaattattgttgactgtagtcaccccattatggtatcaaatactagatcttatttaattccctctaactacatatttttacccattaaccatccccacttctctaacttccctgctacccttcctagcctctggtaaccatccttctattctctatctctgtgacgtcaattgttttcatttttagctcccacaaatgagtgtgaacatgtgaagtttgtctttctgcacctggcttatttcatgtaacataatgacctccagttctatccatgttgatgcaaatgacaggatctcattcttttttatggctgaatagtaccccactgtgtatatgtaccacattttctttatccctacctctgtcgacggacatttaggttgcttcaaaatcttggccatggtgaacagtgctgcaataaacatagtagtgcagatatctttttgatgcactgatttcctttctattgggtatatacccagcagtgggattgctgggtcatatggcagttctatttttagttctttgaggaacctccaaactgttccctgtagtggttgcactaatttacattcccaccaacagcacacaagggttcccttttccccgcatcctcaccagcatttgttattgcctgtcttttggataaaagccattttaactggagtgagatgatattttattgtagttttgatttgcatttctctgatcagtgatgttgggcaacttttcatatgcctgtttgccatttgtaggtgttcttttgagaaatgtctattcagatcttttgcccattttttcatctgattattagactttttcctatagagttgttggaactccttatatattctggttattaatcccttgtcagatgggtagtttgcaaatattttctcccattctgtgggttgtcccttcactttattgactgtctcccctgctgtgcagaagcttttttaactcaatgggatcccctctttaccattttcaagagtacagttgagtggtaataactatgttcagattcttttttctctctctcatctctccctccccatgtacccttcccagactctgataaccaccaatctactctctatcttcaggtgatccagttttttatctgcatatatgagtaagaacatgtgatatttgtttttctgtgcctgatttatttcacttaacatccagttaccgcaaatgataggatccatattgctgcacatgacaggatttcattcgttttcatggctgaataatattccattgtgtgtataccacatttgttttatcctttcatccgttcatggacacttagattgattccatattcttgctgttgtgaatagtgctgcaaccaaaattattggaccataatgatcattttatttcagcaattttcacaatgagaatggataacaatgaatcatttactgggtttgtatgtgggcaattcaggaaatggtcaaaaatattaaatgagttcttcatgactcactcagtcacagttgtcagagccagtcttggtgatttcttttagctgattgcagccactctcatcttcgatgactctgcttggtgcagaatatcacttctgcatctgctcatttgtccaaacattccataaggattatccagctctgcgtcaacactgcctggagcaggaggacagcgaggtgaagagggccgagctctcctattcagatggaccttgtcattttgttttattccccctccttgaacccttcataaacaattcaaagaaatgtacaaacccatgtgacaagcagtgaagctcacctggcagccactgcctgtctggggccaagactcaagtgtggctgagcaggacagagggttcccagtcaggagatgtcagccataggttgagctgtaagatgccctgaggtcttagggacagtgagtgtcccctgaagaccacaacagcaccacgagatgctagggagagctgtgtcaaatgctgttcctatggactccaagccaagagggtctgccagaggctaaatgaattgttatttcttatgaagagaacaggaaaaagtaaacagaaaatattcaaagctatgagaaggcttttctggaataaggaaatatttcacaatgcagattaacccacaagaaacacattctggagaacacacaacaaggcacagcccgtgaaattactgtatctcaaggatgaagaatcatgtaagtattcagggggaaaaaaagcgagttacattttggggaggaagtagggtttcctatagtaaccagaaatgccagaagataaatgaaactgcccaccagaattgttacacagtaaatttctccttcaggtagaaaggccacagaagttctcaaacacgtaagaatctagagagattattgcatcaatagtttttttaaataagatttttaaacacaaagcgcaacaaaagtgcttcataagatccctacactaatccaaacacagcatttatggtactgagtattcaatacatttaagtatataactatggaaagaaataattgtggtgaatagtgattatagaaaaggatgtaactgtgattaccatgagcacttaatataataccaaacatttgtaaggacacaaagaaatgggatggctcacacattgcgggtgggaatgtaaaatagtccactgatcctggagtggggcggtttctaaagactaaacctgcacatatcatacaacccagaaactgtactcacatgtgtctattcggggggggtccctgaaaatcactcaaaaacctgcacatgagtgtacatagatgcctactggtgataccttaaaactggaaacaacctaaatatccttcaccaggtgactggttaaacaaacagtgacacattcatgccacagaatagtattcggcaataaaaaggaatgaaatattgatacatgcaacaacatggatggatctcgggggattatgtggagtgaaaaaagccggtatcaaaaggttagttacctaatatgtgaatccatgtatgtgatattcttgaaatgacagaattacagggatggagaacacattcttggtgccaaggcttgaagaatcctggtgatagaattattctgcgtcttggtttgtggtggtcacacaaatctacacatgtgataaaattgcatggaattaaacacatacacatataagtacatataaggctcatgaaatctgaataaggtcagtggattgcatcaaagttgatttcctggttgtgattttgtactatataatgtatatatgcaagatgctatctttgaaggaaactggatggaggctaaacagaatctctgtactatttcatatatttctttgtagatgtgaatctataattatctcaaaataaaaattttaaaattaaataacaatataaataagaaaaatggggagttataggataataaataactaaagcctaatgctaaaatgcttagttaatcaaaataatggtcttttaaaggtttttataacctttgcttaaatttaaagagataatttagaatcaagataaaaataaatttcagttgttctaatttcactttagtttcttttaagttcaagtaaaattaaatgtaatataatttatttcaaaataacacatgtaatttgattttattgttctacaattatttctgcccattttttctttcttgatatctgcaactacacacagacactagacttagaaaattttgcacgtaatgccaagaatgattacttcttgttaatgggatttgatctaaatttttaaactttctttattatatttttaaacatctgatttttatcgtggatatgtgttatgtttaaccctaaataaacaacaaccaggaaacaaacaaaccaccaataaaaaagcaccctctgaccttgaggagatcattgtccagaatgatgacaagcatgtaaacaaagatttacaaggcaggtcaaagtcttcacaaacacacagagaaggaagaagctcaagctgcctggagtcaggagttaaagaaggctgcccagggctgatgaagcatttacaatactgttttttaaaacagtcactcttggtaattttacaagttctggctggaaaatcacaccatagtaaaaatggtttcaagtcagactttctgctatgaaatccattttggctagttttgatgatttattgacacaactttataaaaggtaaaaactgtaagtagaaaagcttggatttcaaggccaaaaagtgggcttttgtttgtaataaagaacagttttcataagcagagctttacttgaataagacacttttcaaaaattcatttctattatttcaactatcatttatttttatctttataaagatgctattaaggccaaacactgcagtatgctagtaacctactgttttcacttatacatacaataaatgagcttacagattattaattttcataattagttggcaatttttctaatcattaaatagcaggtattaatttgtccctttatcttcttaatctctgaatatacaattcacatatttttcctcaggacttgacaccacaccaaaagctcttgtactcacagggatacataatctaaatctttcaccaaatctatgtctaatatttgtacagttgactgagcatgtccccatctatttacaaggcctaattgtgtaataaggtaattggctatcataaaatcatggaggtggacattcatcagtccaatctcacccacagtcctagctctcctgaaacatggtccctcagctaccgagtaagcagtagagtagttttaggaaactagttcttcacaatctagacagaaatatgccagtggaattgatctcgtatctctatagacataccttgtgtattttatactatcacaatttgtgttcaggaaggctctgtagattgcaaatgacaataactatctcaatcatgtgaaagaagaatggggtggtgagagttctttgcagagttctttgctgaataaattatagaatctgggaaataccaccaccaccaccaccaaacatgaaacagtccttggttttttttgttgttgttgttgccccaagggcttccacatcagtaattcatggaccttccctttgcaacacagccatcaacacctgactacacacttgtctctgtgttttagttcaaataaaacagagagatttaaataatccaccagcctctagggagctcgtgcttgcgcagtgaatacccagggtggagtgtgagttctgcaggaggagagtgagaagaatacatcaatatattgtgatgccattaatgttgctaattccattgatttcccttttttcactgaattgcatattggaatgttggctaggtacagccattgcttatgaactgtagcactggcaatgccagctttagtttcacagttcttctcaagtgtctgcaataacacatcacacatgtgggtagttagtgccattttttataacaatgaaaatatggtttgaaccactttcacaagttaataatccacaagcaacatataattgcaaaattgtccacatactacataaaagagatgtcatttttgaaaaccagatgtgatgacatttgtagagtatttaactcagaatacatgtcacatagctgagtaacgtttattaaaacctcatgttgtatctcctgattgtatatgtaaatgtatttttatgggttttggaacttatgtgcttctgtttttttatggttctgaaaatgagtagaacagggtggggaagaaaaccgagacctgtctcaccccgtagtgactggttgtaaaagccacatttttgcacaaatattatgatagaaagttgccatgtttgttcattaaggaataatatttgaatttcatcatgacaagcaactactgtctctcagtagaaattcaataacaacttgccattgaggggtggagaattggaaattaagccaagatgctgaggttctcttcttagacaagaagtaattgtgctgttctgtgatgttgaggaaattactctgtgtctctgagttttactttctttgtcagtaggaaatgaaatcgcatatgaggggactaagactctactgtatgacaaatgattcacttacattatgtctaagcctcagaacaaaaacacagccatccccagatgtttcacaactggcagatagaatttaaaatcaaattctaacagcctcttatcttgcgtgggctctcagcgtacacacccctactcagccctgcctaagaaattcacaaaggatccaggcccaatgcacgctcaagaacaagcctgtgtcacctggatgcccacatctctgtgacctggcacctgtgttgttacttccggctatcccctcactcctccatctccctgggtctcacaggctctgcgagtcctcagtccctactcttctgagagaatgtgccctacccaaggcatttttcccaggacttccaaagctgcaaagcctttgcaataaccccaggcattaaatactcaagcatctccttctgcctgctaccgtttgcattgccagcaaaatatcttttagagttactttttggagttagagtaaatatttctatttccttcttgcagtggcagtacccaaagaacatagagaaagcccttagccagggctatataatgcccaactcaacatgacccttgtcttcctctccagccttatccccagcaaattccttgttcttagaaactcacattctaacagtagtgagcagcccgtaggccgcttcatacctctttgccttgtgtgatcttgctctctctccaactccattctaacatggttgaaaatgtgcttcctccattctgagaggatctgggcagcagagttcatctttgtgtcctctgtaccctatggtttgtccaaacacattctgctgttatcgaatcaggttcacagttttgccttgttttgtttcaatttggatcttctatactagtctgctcctcagaggtccagtcaatgtttacattcctttgggcatccttgccacttagcagagtgcctggcccataactgatgttcaacgaacaattgttagtgaatgagtgagtgaaaaatgaataaacaaattacagtcttcaaagggacatggtagcaagagatcaccatagggaccttcatggattgagctgaaggttgcccttgagaatcgcatcgagctctccaagcatcattgtattggtgtaaaaagtaacataagaggtaagagtgcgtgaagaaatgcagagagcacgaccaagttccaaataatggcagctgctggctttctcatgagagtctcggaaagctgagacacattaggcaatggccgctgctaggagccaagggaaccaccaatggcagacgcactagtgatgctggttcgggaagggctgcaactccaagggccgctgggtggaaggtgatggcaggcttcctgccgccagctcacatcaggacagcgtccacccatcgggaggcatcaaacacaggccatccgggacttccgtctctgccagaaaaccacgaccctctccctcccacacggcatcctctccgctatcccagtgggcagggcagagattgttttcaatacattctcctgaaaagagagagaaagccattttcccaacagaaagccagggagcaagaagatctcagtgagcctttcagccagcgactggaaacttgaacggacccaatcttcacattttgataaaaggcaaggggcagggaagggggttggagctagaaacaggataacaagaacggaggtcatgtgaaatctagtgagagaagtgttcagtaaaaaccaatacaaacacaaaaaaaagagacgaatttcaaaccaaaatgagggtttaataattcttttattgctggaaagaactgagttcttccaatttctcatcgtgagaaaggaactaatatgtgcctgatgctgaaagtccagcaaaccatttcaattgctgagttttccaggtaatggggtatttcttttgtaaaagctaacatttcctaaattttcgtgttttcttcctctgttgcacctgtggcgtatgaaattcaaacaagtcacctagattaaaatatttctgcgaaggctattaaacagtgctgcttgtgcctccgtttttttttcttcctttctttctttctttttttttttttttttttactgaaagcaagtttttggtgtagaaattaaatatctaatgcaaatttttagaaatagatgtgaagcttttcttaaaattcactaaaatgtccagggtgctgtaataattttgctactatgactgttggacctaggaagaaattcaccttgtgcttaaatacaaagtatttcaaaataaactagtgtttattgatcgtaaagcagtaaatactctttaaacaaaaacataaaaatgcagagaagtagaaaaaagaaaacaatcacttcttagtgccattgtacaaatacaaccatgtttttaagagtacatttcttttcagcgttttccctctctgtaaaggggtcttgttttcaaagttgtcattaactccatgtacaatttatgtgatgactttatacaaaatgtcatcttaattataaatgtcacaatagcaataacaaggttgggcgtggtggctcatgcctgtaatcccagcactttgggaggccgaggcaggcagatcacctaaggtcaggagttcgagaccagtctggccaatgcggtgaaatcctgtttctactaaaagtataaaaattagctgggcatgatggtgggcgcctgtaatcccagctacttgggaggctgaggcaggagaattgcttgaatccaggaggtgaaggttgcagtgagctgagattgcgccattgcactacagcctggacgacaagagcaaaactctatctaaaaaaaaaaataaaaaaaaaaataacaatgactaccatctgtggaatattttcatgtcatagctgctttatatgcaccaactctaatccacccgatccaatgcaggaagtgaaattctttctcattgtagtgactacagtagtcctatgtgaaatatgtaagtgtatttccagggcctccacaggttcacttgtaaatttagactagccttaaaaatgccttatttacccacaaagacagcacttccaagctgaaagagcaacaacagttgctggtgtgcaatctcatttttaaaaagagagaattagggccaaaatagattacgcaatttgctcaaagccacacagtgacccaaggtcttggggtcagcctgccctaagcctgttgattgctctctagggctttctacaacttccaccacctttcaatcagtgccactacaattagctttcagtaggggaggctgcttggagctttcttgcccctcatacctcttcccagttcttgctagggagctctctggaaagctataacagaaatatagtatacattatgtaaatattccttttctgtcttgaattcatacatagttcctgccagagagatgcaaatttgtcctaaaactctcttgggccctctttggggctgaagtctttgttttctgaagagaaagacattttctgtaattttaccacacaatgagaagagcattttaataacaagagcaaaatcatctcaagctcgcatttctcccacattcttctgtctctccagtaggccctggagtggagtgatctgaagcagggtggcattcttggggtagaggatgtaatctacaatgataaaaaaggactcctgtgttagagatactataacaaagaggcaagaaacacaatcactccttttttttttttttttttttttgagatggagtctcgctctgtcgcccaggctggagtgcagtggcgctatctcagctccctgcaagctctgcctcccaggttcaagccattctcctgcctcagcctcccaagtagctgggactacaggcacctgccaccacgcccagctaattttttgtatttttagtagagacggggtttcaccgtgtaagccaggatggtctcgacctcctgacctcggaaccacaatcactcttgattctctttaaagacaaaatcattttagaatttgcttcccttttacccaccatcaaactctcttgtgggaggggaaagttaatttcagttgaaacagtgacatccctggaagataagttgctataaaaacactcttcttctgttccttctcctgtgtgcccagtcaagctgaaggtcaaatacatggaaaagatctccaagtttctaaatcagtgcttaccaagtagccatgcacttgacaggagagatgagacacttgcatatttttccaccccatttccttttacatcaaacacaatgctcctaagctggggtgtctgtcctggagaatgcaaagatagagatcctcatttgggtgacgagggaggaacaccttatcgcatgggagaaggggcagtcatcagtggagggacagaaaaccacatcagatagagagctcgtcagtccatttgcccagggctctcccaggcctacagtgaatcccgtacaccctagggccctacagattttggccacctaatttacaaaggtaacctgtgtcataattgcttaggattgcacagcaacacctcacttgcccagaggccacttacctagaacctcacttgtccagaacttaaccaagatctcaggaacaaaactggtctctgagaagtttaatgagtgcactagtacacagctcaggctctgaagtttggtttacgacactcacaggagagacctcatccaaagccaatgtcatccttatgtaattctaaccagcacaattgttagatttctcagccacaaatagattagaaatctcaagtgtttaaaaggtgatgattgacttgctcacctggcagatgatgaaaaggaaagaaaaacattataagttagtgaatgcatagccacccagatgtagaatcaatgtagaggcgaatacacctgcacctccgtagcttctcgggggtctccacagatagctccatctatcaatgaatgccaagaaggacgactgcccttggttccatcatgccctttagatagcagcttatacatcaaattttcagaaaaaccttcctccatggcttcgcttgaagcatcctgaggccctcattctgtttctcagcccctgctgtttccttcccagtgcctatcacagttcacagtcatgttcttcatgactctcctgtgttccacacttgcctacctcccgtgcatgtggcacgtggccgtgtccttcttgttcatggttggctgcccatccgagctctgtgcttgtcacatggaaggtgcttgataaataaatgttggatgaataaagaaatgtcactgagaagcatttacattccttgattacaatacatcactttagaaatactcatttcaatctacaaatgctccacagaaagatagatacaaggacattcatttatcagagggacaggaaaggtggaaggaggtaaccaacattgattgagcaaccatcatgtaccaagagctttaattttcacaatgatatagtaaaacaggagtgattaggtctcacttcactgaggaagaaactgaggttgagtaactttccagttttatgcaattagtggtaagctgagctgaagcctgagcttcacatgccatgacttggatgggtaagcttcaattactctcacttaaaggctagctcatgtgttgtcagggatgctcagtgggccagaaccaataattgggttccaaagggaataattaagattggagcaaaaccttgtagattggggctgagtcaagtctgaacgtcaaaacagagagaccaggttcaaagagcagacgtggaatcataaaaacatagaatcaaaagacaagagtcccataaaaacaggatctgagtcagtcttcagcccacttaaatctttcttccacccccaaactttcccaaaacagcactcactaaggtcactaatgacttcaacataatcaaatccaatgggtaatactttatctttctcttccgtggcttctcagcagcattggcattctgagcacttccgcctttgtgaatcattgtttaccttgggcttccccgtcttccttacctatctgtctgcttcatctcaatcttacttgccacttcatcctcctccacctcagtcataaatgtggtttccaagatcaatgtgagacttcctctttctctttctctccatctctctcctctccccctgcatcccccctccccataaactcattcattctcctgactttaaatattattgacagattgatgactgtttaaaattttattttccatcctacaccacacctctgagcttcagacttgattttcttactgcctacttggcattgcttcttgcatatttcaagagaagcccaaatgtaaggatttccaatacaaattcatcatcttgatcctcattttcttcagtagtcccaacttgagaatgagcccatctacccacttgtgccagccagaaatgcagtatgcattctcattatctccctctccctcaatcctcagatgtaaacctatccatttaaaacttctaagcttctctagactttgcccatatctctttctctctagccaccatcctggttaaataaactatctgttttgtttttgtttttgttttttttccagcagaaccacccctgattagcctctccacctccactcttgcgcccccccagttcattctctatgttgccaggagagacatctttttaaaatataaatctgattacatgatcccactaaatatagaataaaacttcaagttttaacatggtctatgtgtccctgcatgatcgacttctgccttgacccctgctcaatctatgagactggggagtgacaggtgggttcccagctccaggagtggtgagtgacccactcctggaccatcagagcactctgccatggagacagacaccacatccaagccagaccaatgggactcaatctcggttctttgcgctgagtgggaaagagaatttctccttcccctttcccctgctgagtgggccagaagctcatgtgtgatgctgccaccctcttgcccacacagtatgaaaatggagccgacacacaggaagtcagtgggggcaagtagaaagatgccagtggatgtagctcagtgctggcaccattgagcttccagggcagggccacagactttctctctaaggggccaactagtaaatcttctagaccatgtgggccatgcggtctctgttgcgactcctcagctctgttatcctagcatgaaagcagcacaatgtgtaaacaaaagagcagagctatgtccaataaaactttgtttatggacggtgacatttgaattttcacatgctctgaaaaactgttcttctgttgatttttttcccccaaccattgaagaggtgtaggaaccatccttagctggctggccctccatcaggcagaggccagatttggctcacaggctgtcacaagctgcacctgccactcgctctaggcttttagaaatggagcctgtaaattctctctctctctctctttttggcttaagccaattctggatattttgtttttctgtcacttgtaagtgaaagagtcctgaacttcttattcttcatgtttagtatctgggatttagtttccctcttttctttgcttaaacagctaagaaatctaaaacaatcaaacaaacaaaaactaatagaaatgaatgcttaagcaatcttttcacatttgctaagattaaaaaaaaagtttgataataccttagctggtaaactgtggtgaagctgggactgaatgcatgtttcaacactaatatgaacaattcatacatagaaacaccaaaacagttacttataaatttactaacttaaaagcctgaaatgtgataaaaagaatttattttaaaatgctatatttgtttgacactgtcaggttgaacacccataactagaaaatatattagactttactagtaatatttttgtcattgccttaggtggaatttattaccaatgcagaatacatagttaaaagtgttttcaacaatactttcattcatttaccccaaattcaagttgtctgtatcaactctccatttatctttctttctatccattacctcttttttggtcattaagttggtttgcagtattttaaaaactgatcttttagtttaaagtaaggaaaatgaacaaataattctgataaatttatctctatgccaataattaacctaatacaatctacaatattgaaacacatgcttaaaattacttttgataaaaaaaatttattttcgttgccacagtgcacatcctgaagtggattcagatgtgcaaactcatgatgaaaggagatttaagtcatgtactgaaaagttagcagagcattagctttagtatttggactattcctaaataatagctttaatagtatactcagtgggcccaaggatacatttttgtggatcctgaagttttttccatattggtctcaaaaatttagaaagttaccagcaaggaatatgtccagtttcatcttgacctcaccagcattatataaacatatattatatatataacatatttacatatttatatatatattactaaaaaataatttaagtttcctcttctctgtttcctaagaaagaaaaatatttttaatctctatttgttttactcctatttgagttaaacattcacactttttgtccattttttattacgatcattattatttgagacaggatctcactctgtcacccaagttggagtgcagtggtgcaatctcagctcactgcagcctccacatcctgaactcaaaccatccatcctccatgtcagcgtctcaagtatctgggaccacaggcacccaccaccacgcccagctaatgtttttgcattttttggtttcactatgttacccaggctggtcttgaagtcctgagctcaggcaatccatctgccttggcctcccaaagtgctggcattacagatgcgagcccccagcctcgtgtccatttattttgaggccgtttgcttcactcttcactgtcatttataatttggtttagattattctcttgtcattctctgctatctttttccatcatagctttttaaaatatatgaattaggctccatttacttttatatttttatattagataggtgttaaatatcttttaaataccacattgactttaagccctctcaaatagattactgtaatttatatacctaacaaatcaaaaatattaaggctcctattggattggtaattaacattgtattatgtgtgcactttttctaatctctattagtttaattgtaaattctgacatctctgtgatttttatttcaactacagctaaacatttaaagtaatttaattagcttttttatgagaaataggcagtgcaatttcattagcatttagtctccccatggttttccaagaagtctgaaaaagtgcccccatccccacccaagaagagaaatcggtatccaattttaatttactaattaataccatggtttccatcttaaataaggtgtaggcaagagacgtacacttctcataaattctaggtgacttgtattcttcatcaatcaaatatatttgactacaaagtgatagccactaggaaataactttctgttgtttcatttcatgcaggtttaggcacggcaaagagatggcagggcacacaccttcctgaggcacaccacggttatccaaccaaacctacttccagatcttacctaaagggaaactagtcaaggcccgaaacactgaagaaaagcatcactgtgccaaagttttagagtctgatgagataaaacactatttagagaaatgtgtcaccaccttcttttttaactagtggtgaatggataaacaaaaggcagtatagccacacaatggagtactatgcagcagtaaaaagaaacaaactaccaataaatgcagaaacatggagggaaattattgagctgagtgacaaaagccaaacacaaaatgcttcatactgaatgattctttttgaaatctagattctttatgaacttatacaaaatacaaactattctgtagtgacctcagatagatcactagttgtgggaggccaccggcagaggcagagagttttgcaaagtagcatggaaacctctctgggtgatggaaacatcctgtgccttgattgtagcagtgctcatggtgtcacagcacagtgaatggacactctaaataatgcagccttttgcttgtaaactataccttgattaagttgaagataaatggctaattagtacatgaacaaagcttgatgccattagacaataaagaaatgcaaaaacaagataaaaccatttcatgcctgaagtttattgcatagaaatttatcttaattttaaaggtgcagatcttttaaaaagaatataaataaaaaatttttaaactagaaacaaagcactcaaattctacttgcaaatgtgtgaaattgtattacaggttattcagttagcattgtatggaaatactttaagtgtccttcagtaggaagccaggtaaataaattagcttcaacttaatggaggtatagttacatacaataagccagatctatttagagtgtcctacatagacagatagatagatagatagatagatagatagatagatagatagatagatgatggataggtagagagagaatgtgtgtgtgagagagacagagaaagagagagaaagaaaaagagaagaaacaaagaaagaaaaagagaggaaacaaagacagaaagaaaaataaagaaggaaagaaagaaagaaagagaaaaaaagaaagaaagagaaagagagagaaagaaaaaaaatactgggcaataaataatgagtaacacttaagtattgatatggaatgagctccaggatatactattacatatttttttaagtgcagaaataacagtgtatgtatagagactatctctggaaggacccgtctatggtttgaatgtcctctccaaaactcatgctgaaacttaatttccaatgtggcagtattaagaggttaatatattagattaatgaatcaatgtgttatgatgagagagaggcttgtggctttataagaagaagaggaatctgagctagcatgttatgtagcacgctcagcccccttaacatgagatgccctgcaccacctggggactctgcagagggccccaccagcaagaaggctctcagcagatgcagttccccaaccctgtacctcccagcctccataaatgtaagaaataaattcattttctttataagttactcagtttcaggtatgctgttataagcaacagaaatcaaactaaaacccccaaggagctgatgagcgtgatcatctctagtgatggctggagatgggatggggtttttcactgtacagttttaaaactaatttcaaaccaagtgaattaagtattcaaattgtaaatgaaattaaattaataaaacatgtggacataaacagaagcaggtgacttttctcaagggtccgtctcattcaccgtttctaaggcaagccttggtagtgatgcctgccaaccaccatgttcccttcctcctccttcctggcactctcagacactctgctttgatgcccaccccttcagtaccctcactccccattgcagtcgcctgatctgcagaagcactatcctgccatcctccttccacagacacctttcagatccctggcacagcaaacttttctcttgatgtctgcctaggaaagacatggaaaaaaaaaagacatcaatgggaaggcaatatgaagatttaatattataaggaggtacagaaaatatattgtaaagatatcaacattcctaaatattccaatagattattaaaattccaactaaaaccccactcaaatcagactctttcctcatcactcccatgaatcttttccttgataaggacaccaaggatattccatttgctggaatccactgacttatctgcagctttggataaggctgattaatggcggcttttcccctttctctaggacaatcacatccctcccttttggtgcctctgctccttcctcatctcctgggtctcttcccctcgcagggctccagggctcaagactcgattctcttctccatgccctttatattctcatctaatctctttatgatctggcttaatctcaagactttaaatagcaactgtatattaatgatcccaatttttacctcttgcctggagctctctcctgaaaaccaagctcatatattcaaccacttgctcaatacctccacttgaaagtctaaaaagtacctcaaacacaggagactcttgggttttctccttccaaacctctcctccctctctgtttttcatctcagtgaagtctcatcaccaagttgctgttcaaaaccttggagtcacccttggcttgtctgtccctcacgcccctgatgtgatctgtcaagaattcatgtcagctctttctccaaagtacaagcagaatccaatcacacctctctgcctgctccacagctgcaagccagtcctgtgtctcacctgaactattgcagcagcctcttacctgccttcctttcctattggacacaactggaagaaggatcccattaagaccaacttgatgatgcatgacacttgtctgttacagtcttccaattttttctcatctattttttatttgtttgttttttgagacagggtcttagctctgtcacccaggctggagtgcagtggcatgatcatgtctcactgcaaccttggcctctggggttcaagcaatcctccttcctcagcccctagtgtaactgggacttcaggaatgtgccatcacacctggctatttttttattttttgtagaaacagggtctcgctatgttacccagacaggtctcaaattcccgggctcaaatgatcctccagcctcagtttcccaaagtgctgggattacaggtgtaaaccacctccatctattttttaatagaagctgaaaacattacaatagcctaccaaggccctacaagacccctcccctacatcatcccctttccccccctcccattcccccccccccccactgagccacactggactccctgcagttctctaggtaaacaaggtagagtcctgcacaccgggaaggcagctcctcccagacacacgcagccttctcgtttagcccttccctgagcatcttatttaggaggtatccgtctctgttccccttccttcatttttctgcatagcacctatcccataatatctatgaatactggctgtttactgacagttttttacccactggaatatgtgctgggcactattttaataatttggggtttggacagcaagcaatgccaaagtccgtcaaccatgttcacgaatgcacctaagactgaggcgttcattacacaaacgaaacggcttcacctcgaactggaacgagctaaaggccatctcccactcacttttctccctaaccccaaacaagacctagaaacaaggcaaatgtctattctgcacaggtccacaccccacatctcctgtgagaggtgacagatcaatgagcattcgcggctttcttgagtgggaccagaagagaatccaggctacctctggagataaaaaggacttagtggcttctgtgaatgaacagccttgaggacgcagcctcctgaggtggctcttgggtcaagctaacagtctgttcaaggcagaggtactactgctgtgccctgggtcaggcaacatgccagaaccagaaccctgggcttggagatgatggggaaggcggtcccgcaggggattcggcctgctggagttcgccagcgagcagagggtctgcatccccagaacaggcttcccactgttccaccccctgagcagccttcggtcctgtgcaaaatccagcactgaccagcgctggtccttgaaactgtcccatgacacagaatttatcttcatattgacctagagcttggggtctttaggtctcctaaagccaagtaaaggccttgcctgagtgaacacagccagctgagctccctgaggccctgcagtgtggagccgccagcgtgcgtgtgggcagcttcccttcccggccctgcagctcaggggcgagtgtttcctctggaagatgggagcttctcagggaaactcgagcctccgtgaggtcgccctcggatcagacgggctgtggaactgagttttcgggctcctgtggggcacttctctgaggacctcttagcactgtgtcaaaggaccaggtctgcctattcacacttcttggagaatgagttaaatctggtggcttggagggacgttggtgtgtcccctcctacgaacccaaggatggtatttcctggatgcacttctgtgagccccgcgcagccagagcagggggtccaggttcgccgcggccgcggggagcagggcgggcctggttgaggcccgcgcggaggccccgagtccgcaggagggaccactgtgcccgggcaggctggccaggcgccctcgctcagtccgcggaaaccctagctcagaaagacccattagagagaaggagaaggcgatctcagggcttggctgcggagtcaccgtgtcagaacctggccctgacagtggggctgggcgctgaagccgctcctgcgtcccggccccgagggctgaggcacctgcccttccctgccgcccacggtggggagaccccagccagattccagggcgacttgtgcgaccgctggcttctgtgccaggtgctgggcaaagccactgcagaccacctaataattagaaaaacaaattctagaaacatcccaaattcagaaaaggaaaggacgcaaaagcatccaatacccctgccccatcccgcagaaatcaacccaccctggccagtgaggcctccaagtcctcaaataagacagaaagatttaaaataaataaacaaaaaagttctggggcggggggagggggagagccaaactggtaagacaaagcagtgagaaaccgaagcttattagcaaaggccgggtaaagagccaggcagtgaactctggccacatcggaactcactgcctccccgagcacggcctcggaggctgagaggcctgggaggcagggccgcgtcctgcgggctccacgagagccctgtgaaatgccagtcagatcctggcccagtgccccaggtcctcccgcagcctcggcaaagccctcccccggcgctggaaaccttcccctgccaggcgcagaaggccgcgcgcaagcacgcagctcacagtcaccgccacctgctctgaaaccccaggttcagcgcaggatcagagtcccccatccccaccccacgcgaagggacgcaggattgacagcgaccctgaagaaatgcagtcgagagctattgtgaaagggcgctggcccggaggccccccagcccgcgcaggacaggccagttaatcgccttggtcccaggcccctattagcgtgtccatctgcgacagcaggacacgccttcccatgccagccgctttggggcccgtgcggccctttttccctcgcagctgctgcaacaaatagcagttcttttgagggaaggaacagtgtggtcctcaaagttcataatgagaaatcttggagaaaagtcatagttgctaagctgcgccattggaggcttgaagggttcttcttaaaaaaattaatgactaattctatgttttgattgttcatatgacgactaattaaaggagaaatctaatgggctggactccacttcaggctttttttgctctatctgcatatatggagctgctcacaaaactttcagggaaaggaaagaacagtaaccctttaagggttttatataggcaacctttcagctggaaaaaacgcctgtgcagaatggttctggcaagaattcaccacgtgccgggtgctgtccctgcattatttcaagccagagcaatcctgtgtacaaacacgtacgccagtccacagaagatcacacaaggctgttgcttggagagactgaaaaaatatcatgtgctcaaagccacagttaatggcaaatggccctggcatttttgggtccctgttcatttggatactccatgttatctcgctctcctctccacaaatacatagaatgagtgtgtgtacaacgaacatattatagaaatatataatgtatgataatataatgtatgtttatatattaaacaaagtaatttaatcttaagcatatataaaatataccgtttaaatatttaacaaggggttgactaccttcttgtatacattaaggtgtgctgtgatatgatgagtgacaaacaacctgcacctcccgtgagcctaatgagggggtgtttctctctctacacacccatcgttagaatgccacctacgagtccggcccaaggggctgctcccctccctctgttcccaggctgaggaggaggtcgctggccaacaagagggaggaggaagtgacctggggaggcgtggcctggttcagggagcctctgccccagagtgacaggagtcctaccatcagcaggttatgcaagcctatggcggacttccaaggaccgccaagaaccatccaccaatggggagaaaaaacagatgcttctgatcacagaagcagtctacgcttctcctttaggctacaattaactggcctcggtgagattactaagaaggaaaggcagcgcacacctgccaaatgatcttagcaggtgacaaaactaaatgctacaatgtcagaacaactccctaatctccagtgacacagcaattgccctaaatgcaggcactgaggattccaatgcttgtgtcaccactaactagttgtgtttgacatttattttaactgtggatagcaaaacatcctattttttatggtgttgagaaaccagtgaaattattgattatggaagagtagaaagacttttcgtcttacacatacacacacacacacacacacacacacatccctggttagcttaggtgaccttttgtagattgactgtaagttctgcaaaggcaggaactagtgagtgaccccatatatcctgccacctctggctcttgataaatgagtgttgagtaaatgccatttactccaactctgaattttaatcaaatagccaacaaccctgaaaactcctatgtgttttattttattaataaaatattatttattaatcctttgtctctttgtgaaacaagtaatttggacaaggtgcttaccttgtcatctaaaaaatggcgaagaactatctgtgaggtccctcccaggtttgtttcaatgactgaggctttgtaagctcagtcccttaaaagtaacaactgcaagaatttctgctgattttttggaggggccctagaaactctaattttccattcaattgcagaaatagaacaccaatttgctttggatttctctagccctgtcatttttagcctacatatttttgaccttgcagaccctccagattttctgccatctaaaaatgccacttgaaatctagcttctggagacctcctctcaaaagcgatttatttccttctatagtacatgtggaagcttcattccctctgtttatattccttgtgaaaaaaaataaataaagtgacacaattttctcagttggtgacctgccttgagtttctccttggaagaatataagcttgagaataggtctttgctccaggacctttattacataagatgagacataattacaataattaaaataatgaaatcagacatagctaaaatgcttcaaaatgtctctttagttgtgtcctaataagcactcattctcacttattacagtttatagacaaattagccagacaaaacttgctgctttgtaggattggcagtgaagttgactccagccaccttcctaaacctccatctcctacccgtgattacctgcaaagccaactcatgttcaactcatggaacatggtcattccacatgtaccataaattaatggatagatccttttttctctgttctgcaacagaactgaatttgcttccagaaatgtttaactggtttttagaaagtctgcctataaggataatcatgagctgtgataaacatttgtgcttgaatattactccatatttgaaataggcaatttaaagagatgtctatcatgatatataatgtattatggcatctggacaaaaacctgttaacaaaaacatatgtacacatatatgagatgagagagagagacgaatgaagaaagaaagataaggagaggggaaaagcagagataggaagcatacctataaagtggcactatcatgatttaaccacgggggatgagttacaaactctaatgcctacagtgacctcacagacccatgaacaagagaatcaggatggcagctccagcgtgaactggagatcaaatgtacctcctaaagaggacagttaccatttagccacctgccatcttccatgaaagcaaacacagttagccaacaattcccattttccgagagaaacacaaagtctacagtttaaatgtaaaaccttctgatttttaagtgttgccattaattaaactaaaaggaacattgaatggacttcacaaaactacatctgtaccctgaacttggttttcagaccaccagttacaatctccaggctagtgtttctagtaacatctgtccctgaaacaagctacaataccttgaacaaaattatttaagctcatttgtaaaattgtcactaggggggaagcattgtgaaggatacagaaaccttctataagatccctctgcaaagtaattaacaaacatctcaacgatgctgaaactagcattcaaacatgcagtcatgtttttttattgttgttgttaattcataaactttatttttagagcagttttaggttcacaaaaaagttgtgctaaaaatatagagagtttttgtatacccctgtgcacacacatacatagcatccccccaaaagtggtgtctttttacgactgattaccaacattgacacatcattatcacccaaagtccatagtttatgttagggttccctcttggtgttgtacattcaatgggtttttacaaatgtaaaatgacaggtatccaccactgaaatatggtatagaatagtttatcagccctaaaaatcctctatgttctgcctattcatctctccttcccgccaaccactggcagccactgatcaccttaccgtctccatagatttgccttttccagaatgtcatatatagtcatgcatcacttaacaatgaaaatatgatctgagatgtgtgtcattaggtgaatttgtcattgtatggtcataacagagtgaacttacacaagccaaaatgatatagcctactatacatctaagttatatggtatagtctatttttcctaggctacagacctatctgacatgttactgtactgaatactgtaggcaattataacatagtggtaaatatttgtgtatttaaacatagaaaaagtacagtaaaattatggtattataatcttatgaaaccactattgtatatgggtgccattgttgactgaaatgtcattacgtggcacatgactgcagcaggaatcataaagtatgtagccttttcagattggcttctttcacttagcaacatgcacataagtgtcctccatgtcagttcatggcttgatagcatatttctttttagcacagaataacaatccattgtccacatgtaccatggtttatttatccactcatccacatgaagacatcttagttgattctaagttagggaagttatgaataaagctgttataaatattcatgagcagatttatgtggacaacagtgttcaactcatttgggtaagtatcaaggagagaaatcattggatcatatggtaagagtatgtacacttttataggaaactgctaagctgcattcctaagtggctgtaccattgtgccttcccatcagcaatgaatgagacttcctattgttccacatcctcatcagaatttggtgttgtcactgatctgaattttttccattgtaacagatgtgtagtggtatctcactgttgttttaatttgcaatttcctaatgacatatgatgttgaacatctttttatatgcttacttgccatcagtgtatcctctgatgaggtgtttgtgtagggctttggcccatttttaaatcaggttatttatcctcttattattaacttttaagagtttagttctttgcatattttggataacaatcctttatcacatatttcttttgcaaatttttctccagtatatggcttgtcttcttctcctggcattgtccttctcagagcagaagtttttaattttaataaactccagcttataaattatttatttcatggattgtgcctttggttttgtacttaaaaagtcattgtcatacctaaggtcatctaggttttctcctacgttatctcctaggtgttttatagttttgcattttacatttatatgtatgatcagttttgagttaatttttatgaagtgtgtaaggtttgtatctacattcattttttgcatgtggatgtccatttgttccagcaatatttgttgaaaagactatacttgctctattgtattgtgtttcttttttgtcaaagatcaattgactaaatttatgtgcgtcagtttctgatctctctggtccattgatatatttgtctattctttcaccaataccacatagtctagactactgtagttgtatatgtcttgaagtcaggtagtgttgatcctccaattttgttctccaatattgagttggctattgtgggtcttttgcttgcccatagaatcaattagtcaatatttacaaaataacttgctcgaactttgactgggattaatctataaatcaagttgggaataagtgacattttgacattatggagtctttctgaccatgaacacaaactattgatccatttatttagttatttgatatctttcaccagagtttttttgtttttttcttatagatcttatacatattttcttatattcatacctcagtattccatttcagggtgttaatgtaaatggtaatgtgtttttaatttcaaattcccttagttctttgctggtatataggaaagtgattggcttttgtatgttaacgttgtatcctgctcacttgctataactgcttattagttccaggagcttttttattgtttcttttggattttctaagagacaattacattatcagtgaacaaacacgatttatttcttccctcccaatcagtattcattttatttatttattgtgtgttattgcattagctaggacttctaatacaatgttgaaaagcattggtgaaaggaaacatccttgctttgttcctgattttagctataggtttttgtagctgttctttattaagttgaggatatccttctctattcttagtttgctgagaatttttatcatgaataggtgtaggattttgcctaatgttttcttctgtatctattgatatgatcatgtaatttttctttatctattgatatgatctgttgatgtgatgaactacattaattgagttttcaaatgttgaaccagtcttgcatatctggaataaatcggagttggtcatcatgtataactttgttacactttgttgcatttgattttgtaatattttcttgagaatttttacatctatgttcataaaagatatcggtctacagttttctttcctttcttgtaatatctctgtctggttttgctattaaggtaattctggcttcacaaaattaattatggagtcttccctctacttctagtttctggaagagattgtagagaatggatgtaatttctttcttaaatgtttgacgaaaatcagcactgatctcatctgggcttggtgctttctgttttggaaggttattaattatttattcaatttctatagtggatataggcctatattgattggcaatttcttcttgtatgacttttggtacattctatttcaaggaattggttcatttcatgtaggttgttaaattcgtgggtatagctgttcataatattcatttattatcctttcaatgttcatgagatcagtagtgatgttccttctttcatttctgatattcataatttgtgtattctctctttgtttcttagcctggtgagaggcttataaattttattgattttttgaagaatcactttttggttttgctgattttcttgctgggattataggcgtgagccaccacactcttgctcattttttctatttttgttttccacactttttctgcctctgtggattttacacagcattttgtataattcgatttcctctttttagcatagcaattattttagtctttaactttttaaaatcagttgccctagatttttttctcccaacattttgggaggccaaggggagaggatcacttcaagccaggagtttgagaccagcctgagcaacatagcaaggcactatctatacaaacataattttaaaaagtccaggcattagctaggactgtgcctgtagtcccagctactcaggaggctgagatgagaagatcaccggagcctagaaatttgaggctgcagtgggctgtgatcatgtcacttcactcctgcctagaagacagttagaccctgcctctaaaataaacaagcaaataaataaaaagaaaggaagaaaagaagagcaagggcagcaaatagaaaatagtaataaatatggtagctattaatccaactatgtcaataattaccttaaatgttagtggtctaaatatactgcaatggactgaatgtttatgtctcctcaaaatgtatatgatgaaatgtaagctcccaaaatgatgttatcaggggagagtgtttttgggaggggattatgtcatgagggtggaggccttacaaatggggttagtgctataaaagagaccacagagagctgccttggtccttctgccatgtgagggcactgtgaaattatggccatctatgaagaagtgggcccttattagacatcaaatctgcaaataccttgatcttgaatttcccagcctccagaactatgggaaataaatttctgttgtttacaagtaaatcattttatgttattttgttacagaagcccaaaaagatgaagacatacaccagatcactccattctcttcttgcttgcatggtttctgaggatacgttggatgtaattctaatattctctataggtattttctttatggctcctctacaggtaaggtgttttttccctttggcttcatttaagaatttttcgttaacctttgattttctgaagtgtgaatatgttatgcctaggtatcatttgtttgtttgggttttcttggcatatatcttcctgatgttctctgaacttccagaatctgtgatttgttgtctgacattaatttggaggaatttttggtattattgctttaaatattgcttctgctcctttttctctttctttgacttacagtattcccattacatgtaattatctcacagttcttgaaagttttgttttgttctttttgttagtcgtttttctttctgtttttcagttttggcagtttctgtttacgtatcttcaatctcagaaattctttcctcaagcatgttcagcccactaatgtgtacttcaaaagtattctacatttcttttacagtgtttttgatctctagaatttttaaattctttcttaaaactttcatctctcaggaattcaagactagcctgggcaacatagtgaaactctatctctacaaaacattagccaggtatggtgatgcatgcctgtagtcagagctactcaggaggctaaggtgggaggatcacctgagcctgggaagttgaggttgcagtgagccaaggtcacgccactgcactctggattgggcaacagagccagaccctgtctcaaaaaaaagaaaaattccatggctctgcttacattatccatctgatcttacatgttgcctattttttccattaaaactcctagcctattaatcatagtttttttataattaatactccgatgtgataatgtcttagtccaattactgtggttataacagaatgccacaaactgggtgatttataaacaaaagaagctgatttaggctgatttagaggctggggagtccaagagcttggtgctagcatctgatgagtgtcttcttgcttcatcataacatgggagagggcatcacgtgtgaagagagcttactcttataacatagccactcccacaagaattaacccaccgccatgagagccatgtgaattcattcatgaggacagcgggttaagtttccaatatatggacttttcggggacacattcaaaccacagcagttagttgtaacgttcgtgtcatgtctcattctggttctgatgcttgtgcagtctcttcaaactgcgtctttgccttttagtgtgccttgcaatgtggaaatgatatactgggtaagaggagctgtagtaaagaggcttctagtgacgtagtgacaagctgtggggagagggagtgttgcacagtcctgccgcatgtcacagtcttccagtgagcctgtgtccctggactgtgaacttcatgcttgcttctcagcttccccagccccttagatggtacagaactgttggaggggggtggagttgtatatttcccttgctctgggtaggtcaccctctgataaaacaccaggttaggcctctggtgaaataatttctcctgagggcagaccttctattaataatagaatgttccaacctatttcaaaatggttcctcttctccttccactgccagaagcataatgagattttccccctaatattcgtggtaaggacctagcagagctccaggaggtaacactctcaagtgtctcatactaccctgcaccatgactgggctctgctggagttcttaatttgcagaactgcccacactgagcctcccgcaatttctcaattacagggcaaactttcccagccggcactgggtccttggaggtttctgtctgctggtttcttcctctggaggttgtgcttctgtgtttgcctgtctctccaatttggggggcagtggtttgcccaatgacctcaattctctgaaagagctaagaagaggtgttaatttttcggtttgctcagctttctacttgttgctagaatggagcgccaatagtgcctcctatagtgacatgtaaccctcaactctagagatgatgaagcatactaatgacaaaggagaaatgcttcagcagttttctgtcagcacattaccccttgaaaaagctgcttcttccacattctgcaagagatgggtctcaactcagagctcaaggcaaatgacttccttcaaggagaaggaataaacagtctcagaaaccatgaaagcctgcccccaggagtgtccctgaacctcagcaggggccacacttaccttgcagaaataggtgaggcatgctcctggtacaaaatcccaatggtacagaaggacaaattgaaaaacaagtctccctctaaacccctgaccccgagctacctagttctcctccctagaggcaaagctgttaccagattcttgtatctccttaacatatatccttagaagagctgtcaagtgaacacatgtttaagtgaaaacctattttagaagtgcattttcttaaggaactttagggttggaaggaacctgtgtcagtccttaattcacaacctccattagtacttattgttcttgcacaaaaatctttctcaaaaaagccctttccactctgacatagcttattctacttttacttagctccaataacttataaaacatatttttgaaagtctaaaatctgccactatgtttttttttcctaatcaatctttactttgacctctaagccagagaaaacaggtggtcaaatgccttttgcctaagatggaacttagaatatttgaagacctcagatcttcaccctgccaaataacgtgtttctcctcccctttcacagagcatttggttttaggaaattcagagccacattccttatagacaagactaaactcttattcaacatactcagaaacttcttctaagaggataaccactcatcagaggaaaaaagtttctcatgtacagctggcaaagggatggaaccatctgtgttattaaaattgacagacgcttatgagatttattaagggaaatactagagtcttagtacatacttgctaatatagcatacatgaaggctttatctataatttttttggccaagcagaaattttggtattactcaccctaacaaatttccaagacattatgaaatagaattttaggtcctgacatcaccatttgtctcaggttttgaagcgttgctggacaagaggggtaaaacacggctctgccttggattcaaagttggcctctcatactagcaagtataccttggtatcctggtcacttctcccggccacagcatcacattgctataaaaggcagatacaagtattaaccagctcacaggttatcagataagcttagtctgaccaatgcttaacacagcaactgggccactattgtcattcctgtggtggtggcacacacacccagcctctgtccgggccatggtctaggaccaccctccacagaggctgtgagctagagccctaactgtgcagggccctaactatgccaggctacttatctctcttaagaggacttcattagtgcctgctcggccatacagttttttacttaccaagtaacacagttatcagcacactccaggtactagccaaggactacaaaatcaacgtgaatgtcagcttttgtatcaaaagctcaaaggagaaactcaaactttacatagatgtcccatgaagatgttcagcaaacccattcttctctgttccctggaatccatcccagtattgtgctatgtgtgtgtctagtaattctttacaaaaagctctgtttcttgtgatgctatcagatcacattgaagaatatacaagccgtactatgaaggctgttgtctcatatagtcctaacgtagtgagaactgatgttcttacatgctgtctttttgggcactcaaagaaattcctgtacagtcttacaaatcagttgtagcttaaattgatttgtgttgtgacttgtacacacaggtcacattcccttgacagaaaatatagtttaaaaccaaatttgcagcccttgttaagtgaatgcacaggactttattgtattcaggtcttttattgtaagactcactcctgtcttcattttatgttccactgttgtgcttcccatttgcctttctctagttttgttttctgtgtttctacggactgctctcagcccaggtgtgcaggaagcacacacatgcctgcagagccttcatggcctctgcattcagggcatgacttcaacgcacagtggctgtactgatttgttaaaacaaaggaacagattacttctcctaattcacagggaagttccaggttgtgcgggcagtgagcagacctgtgtctgtctgcgcttgccctggtgaaaaaccccaccgttcaggctgcagggtgcgagacccaggcacaaacattttgctggatgaggaggaaagatgtaaggttgctccccttcagagacagcaaagggcaggtctgtagcttcacttacttcaggattgtgatttttgacagagccgagagatcagggttgttgaaccaggcctgaaggtcctagtgaatctcgtgaagagaggaggggtctggctgtaacatggacctagaggacatttttactgcaggagaaggaacagtggggatggggtggacttgccaaaggaatatagctcaagttcctgcagcccaaaaaagctcagtttcttttggccaaagcttccgcgagtttccctggcatttctcctgcgggagctacaggggcagtgggacacttagcctctctaaaagcacctccacggctgtttgtgtcaagcctttattccaagagcttcacttttgcgaagtaatgtgcttcacacattggcttcaaagtacccatggctggttgcaataaacattaaggaggcctgtctctgcacccggagttgggtgccctcatttcagatgatttcgagggtgcttgacaagatctgaaggaccctcggactttagagcaccacctcggacgcctggcacccctgccgcgcgggcacggcgacctcctcagctgccaggccagcctctgatccccgagagggtcccgtagtgctgcaggggaggtggggacccgaataaaggagcagtttccccgtcggtgccattatccgacgctggctctaaggctcggccagtctgtctaaagctggtacaagtttgctttgtaaaacaaaagaagggaaagggggaaggggaccctggcacagatttggctcgacctggacataggctgggcctgcaagtccgcggggaccgggtccagaggggcagtgctgggaacgcccctctcggaaattaactcctcagggcacccgctcccctcccatgcgccgccccactcccgccggagactaggtcccgcgggggccaccgctgtccaccgcctccggcggccgctggccttgggtccccgctgctggttctcctccctcctcctcgcattctcctcctcctctgctcctcccgatccctcctccgccgcctggtccctcctcctcccgccctgcctccccgcgcctcggcccgcgcgagctagacgtccgggcagcccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaaggtaagggcgtgtctcgccggctcccgcgccgcccccggatcgcgccccggaccccgcagcccgcccaaccgcgcaccggcgcaccggctcggcgcccgcgcccccgcccgtcctttcctgtttccttgagatcagctgcgccgccgaccgggaccgcgggaggaacgggacgtttcgttcttcggccgggagagtctggggcgggcggaggaggagacgcgtgggacaccgggctgcaggccaggcggggaacggccgccgggacctccggcgccccgaaccgctcccaactttcttccctcactttccccgcccagctgcgcaggatcggcgtcagtgggcgaaagccgggtgctggtgggcgcctggggccggggtcccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcctcgttggcaaaaggcaggtggggtccgacccgccccttgggcgcagaccccggccgctcgcctcgcccggtgcgccctcgtcttgcctatccaagagtgccccccacctcccggggaccccagctccctcctgggcgcccgcgccgaaagccccaggctctccttcgatggccgcctcgcggagacgtccgggtctgctccacctgcagcccttcggtcgcgcctgggcttcgcggtggagcgggacgcggctgtccggccactgcagggggggatcgcgggactcttgagcggaagccccggaagcagagctcatcctggccaacaccatggtgtttcaaaatggggctcacagcaaacttctcctcaaaacccggagactttctttcttggatgtctctttttgctgtttgaagaatttgagccaaccaaaatattaaacctgtcttacacacacacacacacacacacacacacacacaccggattgctgtccctggttcaagtgtgccaagtgtgcagacagaacatgagcgagtctggcttcgtgactaccgaccataaacccacttgacaggggaaacatgccttggaaggtttaattgcacaattccaaccttgagctgcgcgggttccaagagccaggcccgtacttgctgttgatgtcattggcttggggagttggggtttggtgcccagcgcggtcgttgggggaggggcaaggcatagaacagtggttcccagaccttgctgcacattggaattacctgggattaaaaaaaaaaaaatcaaaacaaaaaccagtgtctggctcccgcccccagacattctgatttaattggcatggggcaagacctggacttgggattttttttaatgctcttcatgtgatctgttgggcagccagatttggggatcactagacggaagaaggattgttaaagtctccggagatgttacttgccaatgctaagagctctttgaggacatctggaattgttacaatattgccaaatataggaaagagggaaaaggtagagtgtgattccaataataaaggattccgcttttcattgaaggaactggtggaaaggtttcttctctgctgagcctgcaggcccgtcctgcctgcctggggtgcccgggagacgcgggcctgctccggagactgctgactgccggtcctgttagtcaggtgtcagccctgtctctgccgaagagactcttctctttattttaaattaaaccctcagagcaccaccaaagcatcacttttctccctccattggtgttctcattctttgatgttacttgtttgaacaccactattagtagttggagatttgttcctgagaaaaatataaataccacttaatttgcctgtttgtcccgcattcactcaaaacagaatgctcctgaagacaagagagagagtaggagaacagacgctattccattacagtaacataaaagactggattttcaggggcaaattattaaaataggagatgagctcttttaacagaaatttgtttaaggcctgtgtctatcaaattcagtggattttattcaagatgcactttgtttagtgggagttttgtttggttctgggacatgctaacttctagacttgctgctcttagaggtaatgactgccagacaccatttcatgagtcctaatccccacattaagcataagaggtgcacactctcctcctatgggggaaactgaggtacgaagaactaaagtgactttcccacagctggtgggaggcagacgggaaattcacaccaggggcttccaactccagatccctctctcaacttccaaactccactgccttgtccgagttctggtttcaggagatccaaatcaggtgtgtgcaaatgtctaatgtcagagctggcaaggggaaagggcccagggagccggctcatgacgatgagcctgtctgaagcttcaacgcgggctgtccggcagtctgcattcctgccgagttcctcagccctctgttgggtcaccttccatagaggcagcttagtcctcagttcagtgagcatggagtggagactgcttgaggggtgctgagcaaagccctgcctcttacaggatgaaggtgctctccagaagggacactggaaagtattccaaggcgagtcgaattcccaactgagggagctttgtggaaataagcccgcccagccccacttctggagacgttcccattcagtaggtccgagctgtcttaaagagaaaccaaagtggggatattaatggtatccaaagtgagatctaccccaccctccctcctcaaaggaggtcagatcaagaaagcccaagcccggcctggcaattgggacctttcttctcactccagcccagggtgaaggtggacaagtcactttgacccttcaggcttctgagctgttgtttctgaattcagtgaatatttactgagtgcatagaatatgctagatattctgggctaaaggttgaagggggggtgagttttaagggtttctgctcttgcttccagattgctttcaaatctggaaaggacaccagtggtttgtgtgttagacccacactgccgtagcacagaatacaagaaactggctgagagctccaataggcttttaacagtaatttctggcttcacgtatttagtttcataactcatgatttttcaaaaacttctggtttgaagacaccgattgccgaaagtccattgtgctgcataattacacttggtccacgtgacagcactaacatgttctgaaatgtttttagaagtagtctcagcaaagatgaaggattcctccctgtttgaaaagaaaatattctttgttttttctttgatctaagctctaagactagcagctagcatctgaaacttttttgacgagagtgacaaaccaactctaatattaaaggcaattgatgattatgggcactgaagggaaggtaaccccaggctggtgccccggaatagggatgggtcacaatgttgaggacatttcgcctgttgcagaacccacctgcaacacagtgtggcccttgccatgtgacttgtgtgtgtgcctgtgtgtctgtgtgtgcgtgttttaattttgacttcataagtactctagttatgagcttatttaacattgggttttactaataggggtatgtgttgagaaaatttcaaagttttagaatatggttcacccacatgttgcttccctgtaaatataatttttaaaaccagattctgggccgggcatggtggctcacctctataatcccaaaacgttgggaggccgaggcaggcgaatcatgaagccaggagtttgagaccaggctgaccaacacggtgaaacccagtctctactaaaaatacaaaaaaaattagctgggcgtggtggcaggtgcctgtaatcccagctactcaggaggctgaggcaggagaattgcttgaacccaggaggcagaggttgcagtgagccaagatcgcaccattgcactccagcccgcgcgacagtgtgagactccatctcaaaaaaaaaaaaaaaaaaacagattctgttcctcagatccattccatttttgttttcctttatcacttatggacatttgaaattatggtaataaacattgttagtctcagttaattattactggtttattcttgaaccactaatccatagagaatagagtgtaaatcttaacttgttcctgtaggccatccccattaaacatcatagtgttttctcattcgttctttttcgttttcctcctacaggaatgaattttctaagaaaattccagcagttggctctttggacgacatctctagattgtcctccattgggcccataggcacaagctggccagtttgaatttgggcaagaatccaggcattggaacttattcaaataactagtttgcctgtaattttcactttttcagagtcatctgataaagctttcttgctacacatttagatagatacactcaatccagttgtctagaaagttccctgagccagctgggagcaggaggggtagttggggccaggaatattgggggtgtgtttactgagcccctagaaagtaagtgctagatttgacatttcaatccctgaaggccctgaagttcagtatcaaatgactggtcctgtggactgagcatctgtgaattgcatatgcttagagtaaattttactcctaccagtttcagcagcttgctttagcaagcagtatggaaacactaacatgggggagtagaatttctctctctgatccaagttttatctcattctggtgggttttcaaggagagactcggagtccaagtgtcctttctgaatatatctggaacttctcattaacaaaagactcaagttataatttaggggacaaggcacccaatgagaatgccttgcaggcagccctaagtacacctgcaattacaccattactagcgcggcagcacacatggccctgacttagtttaaataattacgtaagtcaaccatgattgtttgccctttgcatagaagggcaagtattggtacctgttacaacttaggcttttttttctttatgtttgagccatgatgagtgatttacactgttgcatccatatgttgagatgtaagaataaattagacttggtaattgcccttaagtgtctggaagtcaactggggaaagagagctagagataataagtgtgaaacaatgtcacagaatcaatgacggaactcttcccaggacaaaggatgacttttgagttcagtctttgcctttaattctacatggggaggagagcacgtttagccacaaatggaagggattactcatttgagctatttggttatatgattatttccccagagaataggatgtgcagggcattacacaagcagtgccaatagcagcaaagttcttgagagtgctagtaattcaaatggcaggaagagaaggaataaatggtaaggctacctacagttcacagagagctccatcctcactgtggctttggattttgtcctgtgtgaaagagaagtgactgtgaactgacatgctgtgtttggtgttttagaaagatggctgcagcagcggtttggggaatggactgcaggagtggcattggaaacaggaaggttcatgactattgccagagacagaggatgaagcaggagcaaggaagattcaggacaggggactccggggctgatcaggaggcagaactggttgataagtatatgtagcagcataagaaagaaagaatcccagattgacacccaggcttctcacttggaagcctggatagatactgaatgcaatcacaaaggctgggaagtcaatgggactgcagggaagggaagggaagggaggagaagaggaagggcaggagggtccaatatcaatattcagcttttagatgtgttgagcttgaagtgctcagatggagaagtccaggaggcagtagaatacggtggtccagagcacaggagagcaatgtggcttgagttgtcatttgctcacatatttccgtgtcagttacttgtcttagatcacagaacaagttctcctctcacagtttcctggctccacctgtctcatgctcaccgtcagcatcgaaattgagccacaccaggggttctggataccagcttctctctaggtgaggctgctatagtcagcagctgattagttgcagttatcagcaactggtaatataatatattgtgcatataagtgtaccagaagtcatgtttatatattgctgcaaatactcggaatggggatctcttgttccctgcttaagaccacatcacattacttggttttgtacgctagtggctgaaccaaaaaaagtaggagatgattttttttcttttttcttaaagcagtagcttttgaaccttgaccatgctttctaaccagctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagagcaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcgaccagagacatgctagtcccgagataacccccctccagcagggaagatgccagtctcgggataacctctctctggccggaaagatgcctgccccaagataaacttgcctcctcccagagatattccaaccctgccataaaacttctccctcaaacaggaacattccaaaattctgataatctccctcaccctaaaaccaatatatactcctagtctgtaagagaaagcgctcttgaccaaaattcaccaggagtgcctcccaggttttaactaaagaaaacctctctttaactgccaaaaaaaaaaagggaaaaaaaaaagctttctgcagtggctttcagcgggcccagcatggcagcagcacctgagaacctgttggagatgcacactcttggaccccaccctggcctctgagtaagacactggaagggcaggccccggtctgtgcacacaagtcctcagggagattctgactgatgcatgccagattttgagaactgctgatatactccaggcacatcgcatgctgggatctagatacaccaagggaacaaaataactgcacttgtcctctgaggaccgacttaccttttggaagggctgagaaagagagacacatacaagatcactccctgtaatgcaatgttttataacagatgtgatttgggatttcagtgggagcccaaaagagggactgactaattcagcctctgtgacaaggggagtttctcagaaacagaatgcttagctgggcctccaggcacagggacaggaatgaggaaatacttgtaggccctgtgctccttcagcaaaaccctcagtttcttgttatttttataaatgcaaacatcttattaaagtagatgctaaggcattagaatttcctgctttatttttctaaatgaccatgaggaaacctggaatgtcaaagataaagtgcaacacattctgcatttaaaaattaaaatgatcctttttaaaagtagcaaccagatgtgaaaaattggactggagtccaggttatagttgatagctttaactttctccccaacagcaacagcacaattttccctaaaatgtgttatgaataagtaaaatgactacttcacatcctttaactcttcctacagaaatctaagagagaaatgaaacaaaagtttgcacagttctagacacgataaatacatgtgaaatcacacaactcagaaaatgtcccttaaattaattgagccattggtacttgtgaattagaagagacatctatgttctgatccactgttgaaagctgtacaatgttacctatttatttgcagacatcctttggaaacaaataggtagatttgcaacaaataaagagtggagtacagctgctgacattaccttgtatattcatgcctttatgtaaaaaaaaaaaaaaaaatatatatatatatatatatatatatatatatatacacacacacacacatatggaggtaaagaccactgcttgctttgcagttgttttaagagcattcatgaaggattttattttataagcagaaatgtgatatctgacgattttaccactacatgcttgcaggccagtgcacagcagatgacgtcatgattgttttagcagtcctatcgttttacttatgatgtcattacaaccctttgctaaaatttctttcctttactccaggttttggataaaattgatgcattgcacatagtctctctgataagacaaactggcatttgtatgtgaaaaactgtgcatgttttagtgtctctgctgatactcaaattatccattattttagtgctggaataaaaacaaaccacttagtgaatttgtgcaggtccttaaggacaggcaaaggtgtcctgagattttctgatcattgtataccaaattttagaaactttttcaaaaacatttttttaatttcaaaaacctggttttgtttatttaccagcaatcattgaatacctgaaagctttcaggagattttattacaatggtttctattcacttacaaaattatctcctagttcattctcatacactgtaagccattgtaaatgcttcaaattgtgccgaacaagataaactagacaaactattttaagtttgttctagtgctaacttgcaagatctaatggctccaactagatttttaaaataaagtatattttaatatattattagaaagttaagcaattatctgtttataggtaacaaaaaccctggaaccccaatgtcagatgtcatccacttttgattaagtccaaacatatgacagataaacaaaagatggttggctgggctcagtggctcatgcctgtaatctcagcactttcagaggccgaggcgggcggatcacaaggtcaggagtttgagacttgcctgaccaacatggtgaaacccgcctctactaaaaatacaaaaaaaacagctgggtgcggtggcacgtgcctgtagtcccagctactcaggaggctgaggcaggagaatcacttaaacctggaaggcaggggttgcagtgagctgagatcacaccactacactccagcctaggcgacagagcaagactcagtcaaaaaacaaaaaaaaagtggtcattggagaattattgtgtcacctgttgttttttaatgtactaattttgagaggcttttaaatagagtgcactatagaactttttcttggcttcaatttgctacaatgttaatagagaatcagaaaccttatccttatagatgtttcttgatttttttaatttctggtgacatttatgagtgagaatagtgtattgccctgttttctttcttactcccctttcttcttccttccttgctttctttcttcttcccttccttctttctcttcctcgctccttcttttttacaagctgttatgaattagccttcacagagaaagaaaaatttttataaataactggaaatgaaactttgcaaaggactgcagatgaaaaactttgtcaaatgactgtaaaaatatactatataattttcaaaagttagaaagtaccaaacacactcagtattcatggttatacaagtatgcatacacatgtattgctccctgaaaagtggtgttgttaagggagtttttcttagtacgcggcttaacatatttttttctgtaatttgttgttagttataatggggagagaaaacaggttagagtctcccctctcagtttcaccttccataaaacagctaaactagacgatcgtcagactccttccagctgaaaacatctgtaaaattaaaaacaaatctaaatgtatgcaagatatgtatttaaacatgctggtaataagtgtgctgtccctataatttagatgctaaaacattgatgtcataataataacaacacctcgcatttgtacagcacctcatagtttacacaatgccttaacattcttctctctcagcctcctacaaccccacaggattgggatagctttccagattgggaggtgagggacccaggctcagagcgattctgctgttgtccgtaatcaccaggctggtgatcagtgggcactgggtgctctcctgctacacagcactgtctctcaacatgcaggtcaaggttacttattcctccttcaagacgtcattgggttttttagctatggatgccccatcacttttagttctatttgtgaatcaaaggctaaataaagtattcctcaaaatttgttatacttctgttactaatgcttaatgtccctcacaatttctgtatatttctgtgtatttctgctctgttttggttcctttcccaggtttcttttttgttatgaagtagtttttagactcaagtctcttctgtatgtgttataactgcccattccataagatacagggcagtgaatttgtgagccttgaaaatatttactttagaaatgagaagtatgacttttcaacgttgtgtcatcaacttctgtaaattttccagacctataaatacttgcagaaaaaaaatgaaaggagaaggcaacttgatttagcagttgggtcagttagcaatgcctatggcaagctgtagtaattcccttacatagatttgtaagactcatttctatgatttaaatgaaggcatacacttaacctctttagggtgtgaaacagcttttacaaaaagagacaaacttaagaaacagtgtggccctccaagagtgttcattttccatatcataccatttgtaataagctattctggctgggatttacttgcaagcattggcttttaagaagagatggtttcacacatcaaattattcacttggaggcactttctgggttgaaggaatggaatggagagtgcggcagtgagtagatctctcagtgacggtgatgtgcctctcccagaagaaatttcaaaatgcagtgttcattttcctccacaagaaaggaagaaactgttttgttattgtttattcctaacatagtggaaacttttcagtactctggcagaaatttcccaaaagcaattttctatttcatgattataaagtagcaaaggaaaaagtcctgcactccagctgagcaatggatctccagttgttatctaggtgctgcaggtttagagaggattgccaggagaacacatcgatttttcaggcctgtgatgacgtatctcttgttgaataagtaaacccttccagtaaacagacagttagtatattgatttcagggtggctttagccactgaacctgtaagtcttgcaaaggttacttgggcaaaagcatcattattttaccttcagtcaacaaaaatctacctggccaaggcagaacagaaagttcagcaatttgatgaagtgggacaacatgaagaatcaggtgagttgcctactttttcacttcactttccacctttagagattcttgtttagatgcagagtagtgacgtgcctggtgtcagggagagagttgaatgagaaaagtcccagaagggcagaagacttgggtgattatctgagtccatctttccttatcacatgacagagttcttgaagtcttggctaggaattctaggcttttagattctttgggcaatggctactaaatgttcataatgttgctcagttgcaaaaacaagacattcaaactatagccagggagataagtagtcacgaactcaaggcctaaattctgctgatggagccgatgagaattgggtgctaaggcaaagagagttgccaatattatattcttcggggttttttgtttttattcgcattttggaaaaggaaaatattagcattcctctgacttaatattgagaagacattgggcactctttttcctcccacacttgtcttctttcactaggtgacaagggaagaggtagcatgaggtggtggtcacaggtgagaggggctgttgtgagcacaggcatgttgactgcacattggtcacctagtagaagttttgcaggcttggtgacttctgaacactgttttcaaggttgatttttagttgagagaacctctaggtaccacgtaatgttattaacagtagtactgatctcacaatcgccctatgtcccattcacaagatgttctgccaagccataaaaggcccagttaagtttaagagaagtctcaaaagtaacagatgataactaattaatacccagtgattttgaaatgtagacatcaaacataccaattcagtggtatcatccttagaggcagacagaggatgattaaatcattcagcccatctctgtctgaggacgcagcttagcacagcatggtggaggctaaatgggccttaagggaaaaaatgatatctgaagatgcaatttatttcaaaaagagtttgctcccgtgaattttcactctctatgtagaacggcaccagcacacacttttcctgagcctttgcatgtgtggcaggcagcggcctggcatcctggggaactgaatgaggacgcagatgacccggacgtgttcacagtttgacacatctgactcccagatcagggacagctagctttgctggctggttaagttgatgattccatctttgcctggttctctgactgtctcatgctttctgttattactattttgcagcagatatttctgctcatttttcaatcatatatgcatcctggatggcatagagttgattctcctaacaaatcagtgtccctttgtatttttttctggccataagatagaatatatatgtcatttattaaaaatggagaaaatgttcaggagtttcttgactcagagagggaaaagggatactcagggcactttttcagccaggaatttactacctttgcagggtaaaggggactcaccacgctggaagtcaaaataagccaccagtgccaagtgttcaaagcccttagaatcacaatgctcttaaagcaaagtcttcaacaatgcttgaaaacttccactggttctcagtatgtccaaaattgtcatgtctatgaatgattttctcaatctgaaaatttttatagcaggctaaagaatgagataggtcagtgtgattctagaactaatcattaacattcaatagatgactattttattctagaaaaagcagcaactttctatttactctctattttgagggtaaattctctgtaagtagaaaaagcaaaatgtggacatgggactaacatatgaatatacaaagcaaatgtaccgaaaaaatcttaagacctgccttgtggtgttttttgttttgttttgttttcattaaagtgacttgttagcctcttgctccctgtgaagcacagggaggtgacgtgatgtgcacagggcagactctgccatatgccctggccttgaactcagggccccctggggactgcaggggatgctggccatgctgagcaatgcctgtgggtgtcagtttcctcatctgcagaatgagggtaggcctggtgcttatttcatagggtcgcagaggggattcagtgacagggtggtgtagaggctggagcgtgccccatgtgtgcacgacagccttccaactaggggaggcgggcctgggctctcaccagagagcctgtgttctccatggctacatgactttgccccagacgtccttcccgtggtctggaccctgggaagtcgccaagagccagacaggagaaaggctccacttggctctcctctttggtgaccatcccttgcctccatggcgggactctcaggtgacatcccaccaaccctcactttgcttccctggtgggtctcactttccctcaagagtgttgcttttttgtttcctgcatagtcctgggccagttttgataaccctcttcatttcacttcagaaaccctgatgatttcttcctgtgctctttttaccttaggacttttactatgacgactgtgactggcccatttcttgttttttttctcttgctctgctttctcccccatcatcactaaagcagacatggcaatgatggccatgcacactttccaagggtccagctgtagatcttcatggttccccaggtgcctggaccatcttgtgaggagggaggcaaacacaccctgcctggagcacttggccctttcggcaatgttttggcttcctcaagtgagaaaagaatggatttgtattccccctctgcattattgtttttgttttgtttgtttgttttgttttgtattgagacagagtctcacttttttccccaggctggagtgcagtggcccgacctcggctcactgcaacctccaccttccgggttcaagtgattctcctgtctcagccccctgagtagctgggactacaggtgcccgccaccacacctgactaatttttgtatgttttgtagagacagggtttcaccatgttggccaggtgcccattattatttgatctggaattaactgagctactgcaggaattgcttgattcactgatgactggtgttgagccagtacacacccacacccaaggactgtgactgtcttctgaggtccatcctcagaaattcctgtctcttcacctagtgtgtaataaggcctgcgcgtgttatatggaactgtaaaaaatgcgccaaccatctgtccttcctctttatctgattacttatcattgttctctaagttgcaagttaatagactgatcataaattaatgcatgctggagacttgctgtttcctactagcagcatataaaagttatttttaaagttgttttaaatctgtgagtaaaaataaattgctttgctgcaagaaacaccaaacatggaaaagctaacggttcaaagttaataatttatcttatggacatcactagtggcatagttgctttaaacagtgagaggatttaatagatatttgatttgcaagtgggatgaagggtggtctaacctttgtcctgtgtttaccttccatgagatcctagaggttgtacagcacagtagtggcatgtgacacacttgagagtgcctgttctgtttggaaacctggaaactatgaagggaagtggccttcgagcttaacacataagacttgggaggcaaaaccttttattctctttaaatattcactttaggataagcatttttttaggtgttaggaacagggaaaactgtgtggttaggaaggaagaaagaagaaagttaactgttgtacattccctaggtaatgtttttaagcattgttattcactttcaaaacacattttatttatttggacttaatattttgatcttattttttcaatttcttttaatttaacagacaggatgagtttttttatagttgtattacttagaaattatactaaaaatggccgagtgtggtggctcacacctgtaatcccagcactttgggaggccaaggcaggtggatcacttggatcacttgaggttgggagttcaagaccagcctggccaacatagcaaaaccccgtcttcactaaaaaaaaaaaacaaaaaaaaaactagccacgcatggtggcaggtgtgcctgtaaccctatctactagggagactgagacataagaatcacttgaatccaggaagcagaggttgcagtgagcagagattgcaccactgcacttcagcctgggtgacagagcaagactctgtctcggaaaaaaaaaaaaaaaaggataaagaaatcatactaaaaacaaaacagaatgctgaccaccttatagaaatagaaatagtggtttgctgtgatagcaaattttcttgttaactttttatttttaaagaattgcacattcacaggaagttgcaaaaaatctactgggaggtcctatcccccttcccccaacctcctccagtagtaacatcttagtagcaaagttttgtatatttattttgatatcattatctaagtttgacatcattatctaatattaacctaagccaaaagcccactattttaattatctagtgatgcagtgttatagaactcatagcctttcacagcattatttggaagttaattttcttaagtgaaatgtttttggtctttaaggtttggaggccatggaggcatgaggagaaatgggatgagggagagagagctaagatagataaagacagagatggggagatccactgattcgttgaacaaaccagatacttccttatagtttttggattaacttacatgagctaagtttatattctgttcagatcacaagtggtcaagtttgtgtgtgtgtgggggggggggggtgggtgtgtgtgtgtaccactctacccatcctatatttattgtcctgtatttggtctgttctgccttctttattttcaggataggtgtcctaaatgagggtctttggaaagctggtgaggccatgttgcccgtttcaggtgttccgtgctcaaatgtattcatttcttgaaaaattcagggagtgcacacttttgtacattttcctatgtgtatatgataccattatataaatcttaaaaatatatatggttcacctgaatccccagccatttggtagagaagatagaaaacctacagaggaggctaagattttattagaaaattcagcttctcgacggaggtattggctttaaagtcaaggcaatgcatctattctttcttttgatataactagctaaaagatctcttaaattcaaagtggccctcatcttactgttactgcaatttactcttaattacaaattatataaaaataggttttgaaatactgtagcgacaaagtaacatacctctgctccattacacagataaaacctctaaggaacacctcctctcttaacaggcattaaccaactgcagaaactgcagaaggacagggctatttgggaataacacagctcccttccttgtctgttccctcccattgtcaggcttctgtggagccatattcagagcaacatagggagggggaagagaaaatcaaccccttggtgaaggaaagctcccaattcacagagcaaacatgggtactcttgtttgtgggagctcccagggcctcccagctcaccgagcattctgagccctgatccttacactaattgtattatgcaaccataaatgatgtctgctgtaccagcggggacagtttattttaatagattggtataacttggcagaatcttatctgcatgtttcatcttggatttttagctcaattcaactcaataggcatgtgtcaaatgtctactgcagactgagcactgaaaagctgctgggtacagggttacatggatagaaaacgtagcctctgacccctaaggagcctgtaatccagatccccattctttccatcccattctcccaagcaagaatttacctaatgtggtttgcgagaatttaagagctggaaaggtggtcacgagaagccggaatgggttcgctaaaatgtgtctatatgattaagcataacgtagctttgcagcactcttcacagcttcctcagagccttccgcacgcggtgtctcatttgaatacttgtgtgaggatagcctcatacccctcagtgagctcttcatggagtgatgcagtagacagcaagcctcacacttctatgctcacggaagaccaaatttgccttgaaaaatctttatagtctcttcacatttctaagttgacatcaaaaatcggttaccataaaatcctaatagttgaagagatgtaatttcaattatttggtaaacctgaccttcattgtcaaagcaattagtcaactcagatttactttctcccagataatagattctgacttctttttttctgattaaaaaacttaacaccttcctcaggagatctatctcagttctgaatgctgattctaactaagaaggatatttggctacatgctgggaagaggggtactgaggcacgccgcgattccactccagcatttccagttagtcgggtgcctctgcactcccggtgttccggcgcccagttagttgtgtactctgggctgtccctatactggagtcctaaaacacttacgactgcagatagggggaggtttttcaaaaccttggtctgaaaagccatagaagggagataggaaagcgggggggtggagccacagtacattcaggtggatccgtttttggaaatagtacaaactggaggtgaaaccctggaaattgatctgtcgttcacatgcttcatgccgagtccttgtggacccacagagacacactcgccccagtttgaaggctgctaacttgattctgaggacaccagtgaggtggtagtgtgcaaatgatgtgtgaggaaactttggaggagtctcaccctgcctggagcacgtggcccctaaaacagcgcagcctcccaaagacagaagatgtggactagtgagaagccaggtatggtgactgctgctggatgaagcttgtcccaccagaggctcgcttgtttcattgagcacctactgtgtgcttgtgggatgcaaacacacgtgtggtccctgccctcaggttaataggcaggggtggaacagttatgaaactgctctaaagtcattttctcaaactgggagtgacaaatgtatccacttggaaaagattgagaattttataagatttttaaatttttgtttattcacattgaggagaatctaaattcttttgaacttatgtatagatttcaccattttatagtaataaatcagtcctcctgtgtgtgtgtgtgtatgtgtgtgtgtgtgtatgtaaacctcaccttgcaatattattattttaaatagccacttgcatcttaaggaaattaagaggacaaaagaaaagctgctgttttgtatgtatccacatatttaccagctgcttccctgccggcaggtgctctggttctgcactgcctgttgtcccttgcctgaaaatggttgcctccaatattttgctcagttttctgattgtttacagtggcagaggagggtagatctggtaccagttagtaattgccagaggtggaagtctgtggatgaaatttgtataacatggaacgttagttccacagttaatgctactcaattggaacccatggaaattattttttggtgaaaagggcccatgcgttatgaaatttgagatccatcactttaagtgaatgtaggccctggatacagtgggagctcagaagagcaaatcagttggtcaccttgctcaacgtattttactaagggcatcagtaaggctttctatgacctgctccttcaatgcttggttgacatttggggagcaaagataaactaaggattctaagttctgtcctgtgatgctgtaaggggaatctcaaacctctaggtggaggagtgcagagatgaccaggatggtggaagcctgcaggagagctgaacacctgaagacacccagtgggaagaccaggacctttaacgcccatatctgctgctcaagactggcagagagaagagggtttgtgatgagaaaaggtggtgaaaggcacaaggaggcacagagcatgtcaggtcccatatcccaaaaggaatgtgcttgggtgagggagagctcctccatggctggaggcattcagagaccaggcagtcgcttgtgggtttgtgattagagtgaggttcttttataaagggagtgagaagagaaggtctgtggatacttgagtgtatcggtaattaagaaataaattgtgtacatcccatttctttccacattttcctgggctgtcacagtggctgcaaagaaagcagtccgtgaactgaactgtgatcccagacaggcaagcacaccaggaatctcttctcagctgttgataatgagggagcgctggggagagaaatggggtcctctttgagtttcctctgtgccgatacctttctctttgttaaaacagctaattaaacactgaagcagtatagctctcttactatacactggtagtcatagttctcttactgttctcttcactgacagttctcttactatacactgatggtgacgcagaaattcagaattccccgcatgtgtcccggtttgaaagccactgtgctttgctgtggattaggatcagacagttgagtcttgttccaacaaggaaagttgcttattggaaagttttgctgcagggagccttgagttctgcatcaggcttggaagtgggctctgtggaggtcagaaggaggatcccccacccgcagcctcaagaaaaatatgaaaagtggattatgcctctgtagctatattgcctataaactttctgcagaatgacagtattcatatcctacattttttcaaagcgatattaatcctgagacctgcagctaaagtcaagtagaatttagggataattaataggaggaaggtggggttggaagatctgcatgattatagtcctctgatataactggaaaattctttccattagcaaggagctttggttaatataaaatggacagattaaacctaggcaatttattttactcattgctgtatttttatttcagagctggttgaaaatattacaaagtaatattttaaagtgcttatctaaactcttactctgcattttatcattgggttatgaaatgactggggaaagacttttcttgcttttatttctcagtgtctacttataaacatgttttttgaactactgtttttgtgacaacatgcctttttcccagaaaatctcaggttaacattaaataggcactggatgtttatctgatcttgtttatagaaacacaagaaaattttaaccttgtatatactttactcaattaactaggtaagaggtcattgaaacatttagaattccactctacatttcaataattatcaggtgaaagctactgcatctacatcagaagatgtttgtaatttatttaagaataaaattagctatgcaagaaatagtatgtggagtcctatgtggaaatcacagaaaccctgacaacttgatgatctttccgcaagctaaaaatatcactctggatcacagcagtagaggactctgtaaatttaatctgtgtgtctcctgtaaataagtgcattagcagtacacaggtggtgtcagagtcagtgatgatggatagaaattctacataaaatccaggctcagtggctcatgcctttaatcccagcactttgggagtctgaggcgggtggatcacctgaggtcaggagttcgagaccagcctggccaacatggcaaaacctcgtctctactaaaaatacaaaaattagctggatgatggcacatgcctgtaatcccagctattcgggaggcggaggcaggagaatctcttgaacctgggaggtagaggttgcagtgagccgagatcacgccattgcactccagcctgggcaaaagagcgacactccatcgcaaaaaaaaaagaagtaagaagttttacataaaaacgtggagtgagcccaaggtgccatttatccagcccatacacatcgtaccatgtacagagtggacaccagataaatacattgactgcatgccacaaacatatatatgtaggcaccgttgcattcaaatacacatctgcagccctaacacatctttatttgctaacgagcatcaatgtatttaaaaacaaacatgtttaaactagtgaatgattagattataatgatcttaattcataagttttctcattggccttttgtatacttcaattgtaatacctagaaaaacagttatgtccaaaggagtgaataggccttatctgaaacaggtgagcgtgacaagtgttttcttacttattttacttttcagataattcatccttaaagtacattagtttaaaagtactgtttaaggaaacagtacttggattaaaacttgaatcattgttaaggaaaactataccttaacttcatgtaatcacaattaaacctcttcatatagaaggatctaagaattttctgcagcattcaccagcaccaaaaagctcagagacatatatttctttctctgtatatgtattttaaattcaagttagtataaattgacaggcaggtcagagtaatatatgatcttctgagtccccttagtaattaaaagaaatgattatttttgcatgaaatatgataaagtgattttaagtgcctgataaaaagtcttaaccatgacaaccattaaagattacatcaaagaaaaataagtttgactttcatttaccttggaaacagctattaactggtaacctcaagaaacaccatgaagagtcagtttgctccacacatgtcttgtaaaagtcaaataactggtggttatccagtaatgacaagaggtagaagttacatccttgctgtctgattgaaccttcccagagctggcacaaggctgggaagaccataggtgctaaatgaggaactacttaaagaaagaaaatggaatttcacggacaagaaaatccatgtccatttggttctgtgacccacatcctttgtatcctatgcttttttacacttggtacatggttgcaagattgcccctgttttctacttatagttccatgcagcatggatgtgggaaaaagtctcctctgcaaagggggttaatgcaggtcactctacgtatgtgcacgaggtcgttataaagctcgaaaatatgggctcaccaaccaggtgatttttttaattatccaaccagaagacataacatataggggaatcaaaagaaatctctgagtaaaataatgataacaggtcaaactttgcggtcccacgtgaggctggagatgcgtattgtcttgactttgcatctacaagtttaacaaatgatgctttctcagtttacctctggaaatggaaattagcattgcaaatgacttcatgaggaggtagaagctatctgtgaatttcctttcgctgtgtttacgatagactctcacgtctagatgtgtcatgtattatgttaaattggtatgtcttgaagttataaagcacagccctctataagtatatatattccacctctttcaaatcggatggtacctatccttcaaactgctatttaatgactgtctgctatgttcaaggcactgctctcaatgttaatacttgatgagatcgggcgcgttcaaggtggcatggccgtagactcaatgttagtatctgaaatatggcctacgagctgagttgtgaatcaagttaatagattttcggaatgttaaggtctaaaccagtagctcttaactgagacaatcctgtcctcatctcacctgggagacatctggcaatgtttggagaaccttttggttgtcacactggggcatctagtgagtagaggtcagggatggtggtaaacaagtttttttgtttgtttgttttgtttttgagacagagtctcactttgtcacccaggctggagtgcagtggtgtgatctcagctcactgcaacctctgcctcctaggttcaagcaattcttatgcctcagcctcccaagtagtagctgggattacaggtgtgcaccactacactcagctaatttttgcatttttagtagagacggggttttgccatgttggctaggttggtctcgaactcctggcctcaagagaaccgcccccttcttggcctcccaatatgccgggattacaggtgtgagccaccgtgcccaggctaacattctttaatgcataggacagcccccaccatacagaggaatccccagcccagaatgttaatagttctaaggttgagaaacccaaggttaagccaagtcaacttatctatcttctttaaaattgcataagaatgcagtcctgttcttcattcctcttgctttgcagttaatgatcctttgcctggactttctaagtgcccagaagagcaacagccagcatgcaggatggcattcctgaccagttgcacttggcctagcattccaacctcacctgcctcagcttgttcaacctgaaaacctaccaagtgaaagcaagagccacgtgaagacgccttagttatatgcacccacccagacacttgctcagaaaggaatcagtggggccctggccttagaaactggctccttcactgctgtagaaacaacataaatttaacataaaacacgtgcttttcttttttcttcttactttttcctgtcttggcaatgcaaggatgccattaggtaaagaaatccttcaccacactaatcctgcagagccagaagagaaaccagcttgttctaacccagctttgtcatggagagaaggcagctgctccagtctgaactattctttcttttggtagcagcctgcccaagggtgaaagtgtgtttaatagtttgaattacacaagtgaacagtaaatgtatgcctgtttctgctttatgggactttgaaataatgttgtttgtgccaaggttttagattactatacctaacaacctagaaaaagaaatgaaaaggaagccttctgccaggcagaggtcactacgggcctggagctgggcacctgactcagcagctgcccagatccccagagctgagaagtcaccatgcatttgtggtgcttcgagcgagttaccagagtcctggaacagagcagcacacctgcggggtgtccccttggcatttgggcagggcaggtgaccaagggtcttgttggaactgaagtccagcttgaaaagcaaatctggttgtgagctagagtccagtaacacttgtttcccgccgccccccgcataactcgtgtgtcctaaaatacaataatttcttgaacttcagtcacttatgcctataagcgggcatacaacaggggcacaataaatgtttgttaagtgaatgaattctttcagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagctttctttaaaagagcttccaaaactgcttaagctttgactgcacaaaacctgcatcacctccagttgagaaactcaagagaataagtaagttatggagttggagaccccagcttaactactagttttaaaatagtgaaatcaacattttcaaatctttgacttcactaagatttaataaagtttattaatcatatattatgagttattgctctctctttatgtctgtaatgcagttgctcctctctgtataaattaataagttttagagatccaaaatgagaattttaaaataaattacgtatattttaatcaagtttaatttgactatatccagctaaacaattgattgaacttcacttgcttttctatgacaggttttttgttcttagtaaaagaccccagttttctcacttgtgaacagaaggggttagacttcatgacagctaaggttccttccgtctctaacaaaagtggcctgaagagaggcttctagactatactcacggtgggttcttgggacctcagagtcagctccatcacttaagtggctgtgtgattgagtggagacacctcaatctctttgtgcctcagtttcctcacctgtcgagtgtcaacatgatggcacctaaagctgttgagacttcagaaaggtaatgtgtgaaaagtgaaaagtgcctggcatccaggaagtactcaataaataccaactattttattgctgcagctgttcttatagatgtgatttctagaacattgccttctaatagggtagccatgggccacaattgttggctgttcggtgtttcacatatggttagtccaaactaagatgtgttgtgagtctcaaatacacactggattgtgaagacttaggacaaggaaaacaatgttaataaaatctcattgataacttttaaattaattacatgttgaaatgaaaatatttgggacatattgagttaaataaaacaggagattaatttcttctgtttctttctactttttttattagtgtggctactcaaaaatgtgacattatgtatgcatctcgtattacatttctattggacagcagcgctctagacagtactatgggtagtatctgtggggaggttctcagaaacatgtcgcatgctcttttagaaccttaaagtattcctagtctcctctacttccagcccttggctcttgggcctcagtctttttacttttgcggctgtgtttctctgaaggcttggcattagtagattgaaaagaataaccatctagggaaatgtgaattcagtttctttctgacattctgctctctacaaggggatattatgtacacataaacctacttccaaaataatgaagtgaggcctaattccttactcttcagagagcccactgtggaagtgtcactgaccttgtgtatgggctgcccttcatggctctgggagtcattataaagggcagcatttggcgtggtgcgtcctaagccagtgtttctcggctctgttccttagacatgtgttagtgttaatagatgttcttggaaaaaaaaaaaaaaaacagcattctgaggtcaaacatgctcagaaagcttggaatctgcactacgcttctcgtacacatttcatattaaagattttggaaagtcctgcaatacagagccctgtctaatattgccacaacccacaattgctcaaatgtaaatagatttgagtttattcacattcagatcacctcttaaggccccacctcccaatgctgtcacaatggcaattagatttccacatgagttttggaagggacattcagaccacagcaggggaaagcagggtacttgctgctttgcaagtgtgtccacatctaattaatagtacagttcttactcttggtgtgtccggtgatattaaaaattaatgtgccttatttagataagtaacataaaaatcacaaaatgtatgccttagatttatatgtatttataactagtctatttcctgaaaacagttgagacaccttgtaaaagttaccggtacgatagggccattccaacaaagctgtaaagtggtgataacacagtcataaagaagaggagatagctctgggagaaaaggtggcccagaaaccagctctgagcctcatggctgcaggcaaggtctgcaggttcctggtcctgattgcaggccatttgctgccttgagtggtggttacacaaggccagccctgggggtatcacccagaacacctagtacacgaatttcagtttagaggacgaagcattactggagtattgttatgcaggaaaactttttcctaaaaatgccctgaaaagagagtagcctaatgcattcaatcaaaatgtttttaagtggaaaacatattgtgtgtacttgatctggcctgctgcttttaaaagattaaaactgggactgggcatggtggctcacacctgtaatcccagcactttgggaggcagaggcaggtggatcacctgaggtcaagagttggagaccagcctgaccaagatggtgaaaccccatgcctactaaaaatgcaaaaagttagccaggcttggtggcgcatgccggtaatcccagctagttgaggggctgaggcaggggaatcacttgaacctgggagccggaggttgcagtgagctgagatcgcatcattgtactccagcctgggcaacaagagtgaaactccatctcgaaaacaaacaaacaaacaaaaaaacactggggccaaagaactctgtgtgctgtatcacctaaccacatttcatgacacggctagagaagaatcatgcaaataaaaatttccaacatgttcgtaaactgggaaagtatttcactggggagtgagcagaaaagtaatactataacctctatatctagacaaatgtgaattcagtttcacatataaatatataagtgaaaaaatatataaatataaataatatgaaataatggttatctcaccactttctacatcttttgtgaatattttatagtgctcaaatatattagtgcactagtatatgtacattacattaaataactaatcatttattaggaggatgtgcttgttttttgctaataaagatgataataaaaaaatccttagaccccccctcggtttgttttcagttaggaattagggatatttataagaatatctttaaatgacacatgccttgctctgggacgaggcatctgcatgggtgacacatatgtgttgtgtgtacaggctcccagcatttccagggccctgctcagaatgtaggccttactgattcttacagagttacaagcgctggtgaggttggcgaagtttaggtaaacacagctgggaatgccccatggcctctgggtgactttggacatcactgaactttacccttagagatgcatacctgcatcttttttaccctgatagggccttccatgatgctttcaaagtgtttttgtctgcttttcggttaatagactttcacagtagccaattgaatatattggttaaatgcatctctttatacacagactggattcaaactgaggttgtgtctctccctggctgtgtgacgttgggtatgatccaagtgtcagattactcaacttcaaaatgaggacagagcctttcccttctagggctgccaggaacattgaatgagagagtgctggcagcttagtacaggtgttcattgctcttgtatggtactgtctgtggcacggctagataaaatacagtagccactgattcaaatttcaactgaggagtaaaataaactgaataacttagaaaagttttcttcttttgaatgactctaagaatttaaggagcatgtgagtgttgatggctctaaaagggtaacagagcccaactagctcagttctcagcatgaaaatagtcatatggcacagactcagtggagtgggtgcacttcaataactggaagcacagatgccctacagcagcatcaaagatggcactctaaactactttcaatcctttaaaataaatggaaacgcacatttagtatgcatatgacaacacgaaggacttcgattttgctgatgcaatacagttttacaggattttttatactcaaattagtaaaattctgtattgcatccaaattataaattataatatcatctagattggacataggaataacgaccactggtatctgcccagaaagctctaccgcctgtttataagctcctgcaggagacacaaaaagaagagaatttgaatataacttgaaatgaccgtaatctcctgccccaactcatttcattaccaaaccgcctctttcttcattatttctcctgaagcacaaatctatagagaactcagctgccagtctctcccactgcactcagcagtgaaagggttaggcctaggcttttcaaacagaccagtgcttgtatcagcccttaaacatctctggagaaggaaatgggatccttctttggtaattcatttttgacagttggggattaggtgttctgtatctggggggccttgctgtcttctctcctcctcctcccactgcagaccctctcctcccctcccctctccagctctctgatgactgcttcatgctccttccacctgaggactgccagcacagcctattgcaggaacagccaatgaggggctggctgtgctcttttatttataaaattataaactcaagcaaaatctagactatgtgtccccaagatcagaggagcacaaatcccttgcttacagattgcatggggggcacattctttaaaattggtccctgatctagactctagcctgagaatcatctttaagttcagaatttccactcatgacctcacatctgtgggctcccacattgtcttccaaaacacacatggcatctggcatcaccttcacccccaccctcagagcctcatctccctgcaggtagatagtcaaggcaacctcttcactcttctgccaagcctcctctcctcagctcttcccttcctctctctttttgaaaatatttttaattgtggcaaaatatacacaacataaaatttaccatcttaatcatgtataaaagtggagttcagtggcattaaatacattcacgttgttctatagccataaacaccattcatctccagagctcctttcatcttgcaaagctgaaactctgtccccattaagcaatggctctgttttcctccgttcccccagcccctggccaccatcctcagttttctgtctctgtgagtttgattactctaagcacctcttataagtggatcatacaatgtatctgtctttttgtgactggcttgtttcactttccataatgtcttcaaggttcatccacgttgcagcatatggcagaacatctgtccatttccaggctgaatggtactcttttgtacgtgtggaccacatttcatttatccattcatccacgggagggcacttgggttgcttctgctttttagctattgtgaataacgctgctatgaacatagctgtatgcctttgtcttttaaagcccaaatctgatcaagtcactccccagcttaaaaccttccactgctccccagcagtgggataaaggccagtctcccctgtaggtctctcccgccagccctgctcagtcttcttgcttgtcatccttggctaggccttgcattgccatagccctctgcctctgttcacgctctctcatcttggagcatgagccttccatcatctctaccagatgaactctcatttcttctttcaaaaaataaaaaacccaaaaaacccagagatcccaactgtcctggtgtctgcatagtctgcagcacacgccccctccatggcccttcctccataagcagaatcactcctcactgttcctgcagcacctcctgtgtgcccacacagctgtcctgcggtgggctgtgtgtgtgagtgtgccccctctaggacctgagctccttctggagggtgggcacagcatccattcattctgggaatcctggtcggcaccatgctagaacttctgcaagtgagtgcctttggtgctggcccatgggagagctgttggtaaggcatacttttgcagattccagttgctgctgaggttgttgctctttgcacaagtttcttctagtcaccagtgaagtgacatgtgtggcaggcatggcccagggaggctttttcataaagaagaggttgaatctttggggctgtggtttgaatatgtccctcaagcttatgtgttggaaacttaatcccaaatgcaatagtgttaggaggtggggcctaatcacaggtgattaggtcataaggctctgccctcatggatggcttaacatgtttagtgaggcagtgggttagctattgtgagagtgggcttgttagaaaattgagtgcagccccctcttgcttgctggctaccatgctctcttgcttttctgccttctgccgtggggtgacacagcaagaagaccctccccagatgctggcaccatgccctgggactttccagccttcagaaccacgagccagacaaatttcttttctttataaattacccagtctgtggtattctgttatagaaacacaaaatggactaagacaatcttctttcatcaagttagggtaccaacctttaaagactgccagtccaaggttaaaggaaacttttcaagagcagtccaaacatgatctggccctcagctactctccagggtcatgccaccctatcacccactggctcacacagacgctgaccactgcttagtttctcaaactgaagttttcctcctcagagcttttgcaaaaccttttctttgcctggaaaactccccccacaaatctttagttgtaggttccttctcatcttgcagaattattagtttgctcttcaaatagtctctccagctagactatcaactccaggagggcagagttcttcttcgcttccttcacccatgtgcccactgagtccagaactgtatagcagtttgattgaaaaaatccacagggtggaggatgagaggaccctggatcccagcctcacagcctcttacttcacctgtgtgattttggtcaagtcctttattcttcctgggctttagttttcccttatctaaaatatgagaaaagttcccctctcctgggtattctgggagactcatgtaaaaggcactgagccagtgcagcacatctatgaccaggaagggtcagcttcctgccttgcatgagacacacattcccttcttcatgcacagttattcatgagttaaatatgtattgagaagtgggttctcaggagatgatgcatccacagcattgtttgtatgcctctgtctttgatgtccctgcctgagtcgcccactttagagcccttctgttcttcagaaaccagacttttctttcaatagtttcagtaatcaatcgatcaatcaatcaaccaatcaacagtgataataatcatgagtgagcccctgcccgtgctggctgtgtcctgctgaaggcacactaagtgctgcccttcccagaagcctcaggaagcttgcgaagctcaggtgcatggatgcctggtggaatgaggaagggatgcagccaggtagagaaatgccctgccatcacttgcatcagcatctgtgaagagctggccaggcttttgctcacagtggttgacacagtcaaggagcaagggccccgtaggagaggggagtcaagggctccgggtgggaatggagctgggggctgatgctggcttctggagcactgtaatgtgactgagaaaggtgaaggagccgttctgaaaaagaagaaggcaggagctcgcacagctcttgactcatcttgacttctttttcctgcttcatccaagcaggtcgactctctcgtgatctcagagacagagtgaagtcatgagtgggaggggagcacagaaaataagaccttgattcccagcattgggagactccctgctcccctgagtctcggaaaatagcacccttcaaatgttttagggatccagatttgatgaagagatgttattttggcttttagattcttaggagagatttgtctttctcaggtcaggaagaaaatgctgcccgctgcacattcttcgggacagactcttttaattattactagtttaatgtatgttttgcttagttaaggaaaacccctgtggtttcttgacgtgcttcagtattctaactcacagctgattcagttcagggggctggggagatgtcctcgacctctggaaaggagggtgcatctctagaaataaggctaagtatgccactgacactgtctgcataaacgtgtgtgatctcaggtccaaaggatggggcctggtctaagccagggacgtgggaaatcattttcctgtggcaacttgtgaagaccattctgtgaccttggtgtctctgggccttctcttagattttctaagttggctagtcagtggagctgccatccctcctttgcccatgttctactcccagagttcctccaagaaattgcggagcaatgcctgtttcatgagagctgagtttgctgtgtcttccacttagaaacaacactgtggaccaggaggacacacagctcccagggccatcaccacacaaagtgaaggctggtgaatccgaggcttctagcccttgccgggccaggcccgcagcactccgctccccaacccagccgctgctttgtcgcaggaacctcagcagggcagggtgtttcctaggaggacatccgattcccagccattcctttcagtgaatcacctgagctcacattcttttttcttttatttttgaagctcttagccaatctgcttcgcgatgaaccagttttgcttgaagcagacaaacccgattgtcaggagacagtgatgatttcttcagtctctgaggaagagttttcattttccccaattcgcaaaaaaagtcaggtccctccctccctccctctccgtagaatattttccatgtgtgttaacaatggctgagcgtggtagatgccaggaatttctgtcaaccctcaaagaggaaagccctgcctaatggtctgcccgttcttgttcactccctgccccaggctccccacccgccttctttctggaaggtataaaggctcctgcttatacctggcactgcacgcttcgctccctctgatctcctgactgtcatgcccagtgtctcagcctatcattctacctctaactcgaccttgagtgaccttgagcaagtttctcaggattccacctccaagtcactctccctttgggatatgcagcactaagttaagcttgcctggaaaacatcacttgaagctggaaaaccacttttaacacagcgggaaaagctatttgttcagacaggagtggggtgggtctgggcagagcactgctctaacttggccatgccgtggcagcagctcctttaatgccactttttcctggcgcgcccgcggggcctggagctcagaaagaggggaacgctccctcgtctctcaacagttgctccagacaggtcagcaaacatggaattcagaatgttcattaaacactggctgtgtcttttgtgttcaaaagcaagacactctctctgaaccatggccccacagagagtgcagaatgtgtgaaacctgccgggaaggtctggaccccttgcggggcagtgggcagcaccgtgcctccgttcacaccactcacatggctgtgcctctgcttccttctggcatggctgcttcttcctcaggtctcaaccatctccctcagatgctctttcccatgtttgtggctacaggtccccgtgacctgcagaggcagagcactcaccagcagcccagcctcgttgcgcacccatgtttgcatttgcaggccctagaaccactccaagctccgtgtggcgagatgcaccctcctgcccttcactggggagctgccctcctgttcacagcggcacctgagtcacacatctggagccatcctggactgcctcatttccccgatggggggtttccctgacttcatccatcctgtcttttgggtccccataataactgacatgggtcggcccgtaccagcccctgtgagaagggctttaactgccttcccaccccctgctcatcttagagtctctctatagtgctgctgaaagaatctctaaatcagtggttctcaacctcagccgcacattgagaatcacctgggacccttaaaaaaatcttaactcttggtccaagaattctattacaatcggtctgggatggggccctacaggtatttttttaaagctctccagttggtaatgcatagctagagttgagtatcgctgttctaacgtgcagatctggtcatgttaccagccttttaggtggtcttctttggctttctctatctaaagttcaaaaccgaacatgtgcgcattcagtgcacccattttcaactgtgcattaacacattcagcccaccagcaagatttatgaaccattttctgctgttgtatataacatatcatatgcataatggcataggttattgttttcttcaaaatatatgagatgtgagtccttctacgaactgactcacactgattgcccaacttcctctctcgaggtctcatcctctttccctgcagccgtctccctcttgcacgcacacacacacacacacaccacacacacacacacaccacacacaccagggtcgatgccatctaccctggacttcatcttgaactccttcgagtgtgagtcattactcctttgtgcacctctgctttctcttctcaagatgttcacctgcttgaggtcagttccttgagcgtcttccacttgccatgttcaccacagtgctcaacatgcctgaatgcatggatggcgacttctcagatcctcagtctcctcatctgggtaataaggcattgggttggcgggtccatctggtttcttccagctctgagagtgcatttgctctgtgattcattcgttccacaacacttcaccaattaaagagagggtacaaaaggtgaacatccttggctcccagcagatgctcctcaaaacctgaaaaatcagataggtgagggaagattgaatgaaaggcctcttatgattctgcagcaattttggtggtttaagaactctatggaaaaatcatcagtatttctggaattgaagtaaaatggatagtgagcctctgtgtatgtgaaggcccgcatctggaacatgaaagaacctgtctgatgtgttctagtcaggaaagcaggtagccaatactatttatagaatttacagaaactgaagattttgtttctactgattttcaaaatagtattatgtctgatttttttcctcagaaatatacttcctgctcttctcaacaaactcatttgaaaatatgattagaacatgatagaattttactcatttgccaactgcggttcccatttcacatattgttagaattctgcatggtggctttgccctttaaccactaactgataaatgatgtagttagcttttaaatgtgtggaaaaatataatttcaggttcaaccataggtcagaagtacacgtgttttgttagtctatttgtctctcagtcatctcatggaaaattctcagcttttggtatggaaataattttcttgaaggcaatatttgttgagtgactgacggaatgaaaaacgccagttgcgtaagtgtgaaaaagatctgggtgttttcattggatccaaattccacatgagccaacaacagcgtggtgtggaggctggagcacattaataagaacagtgtcctaaattcaggaggtaatgctctgcccatgccctgtgcagctcagacggtgtgtgcagtgcagtatgtaacccagggcacatttcaggggcccacagggagctgcagcttgtaaggtggagtgcagccaacagagcagagagtcagaatccccgcagagtggttgaaggcacaaggatgcgcagcaaggaagacagacttataggtggtgcgactgccatcctctggtactgaaggtgctatcatggagggagggaagtagattgaccctcctggctccagagtacggaactcagacaaacggtcagaagcttacagggaggccaattttggatcaactttaagaagaattttttaaaagctagagcaatcctaaaatggaatttgctctttataaagttgcgaatgcctcaccctggaattgcttaagcaaagttgggacgggcagttgtgagtaatctcctttccaatccatacccgcaatcaccagaaacgtggacttccctgacactgagcacctcttaattaagcatctcataagtgaacaaaacccagcccttcaaagaagtcactttatttatgtgtgggtctgcagcttggatttcttgataatgttaaataaaactccatctactcttccacaaacacttcaagaaacctaagacttttggccagagtaacaccgaggtttgagagaaaggatatgtgtgtgagaggtgtggtttcattagaacatattatttgacttcatgttgaatcaacacttttgtgcaaaatgcagttttaccagcctctttccttgttttggtcacataatttaacttaacattctcggtacttgattttctaacataaaatgggattgagaggggaattttgaagttcccatggtctgtcctctacattctgacagctcattatctctgcggtattgttctcacatttaagtgaggttagcggaggcagaggcctctcaggcctgaagatagcctctgttttcagggaaatactagactgtgagatctgtgacactgaagcactaagttcatctcacaaaagcaacgtgctctttttaaatggttgatcaaagttactttcaaaaggaagtgttagtttttgttattagccgaaacaagagctgctttaatgtagtatatttaaaatcatatctcaattaagatgttattcaaatactatttgacccaccaatctcattactggatatatacccaaaggaatagaaatcattctattataaaaacacatggctgggcacagtggctcacgcctgtaatcccagcattttgggaggccgaggcgggtggatcacgaggtcaggagttcaagaccagcctggccaagatggtgaaacctcatctctactaaaaatacaaaaattagccaggcgcggtggcaggcacctgtaatcccagctactcggaaggctgaggcaggaaaattgcttgaacgcgggaggcggagtttgcagtgaacagagatgaagccactgcactttagcctaggtgacagagcgagactctgtctcaaaaaaaaaaaaagaaccacttgcatatacactattcacaatagcaaagacgtggaatcaacctaaatgcccatcggtgatagactgcataaagaaaatgtggtacatatataccacgaaatactatgcagccataaaaaagaacaagatcatgtcctttgcggggacatggatggaactgcaggtcattatccttagcaaacgaataagaaaagaaaacaaaataccgcatgttatcacttataagtgggaggtaaatgatgagaacacaaggatacactggggcctacttgagggtagagggttgaagggagagaagcagaaaaaataactattggggtactaggcttagtaccagggtgacaaaataatctgtacaacaaactactatgacacaagtttacctgtttaacatacctgcacatgtacccctgaacttaaaaaaatttttaaaaagatgctatgcaataaaattctcaattaagaatttaacttggtaaatgttcatttaatgatctaaaaatatgtgtctggatggctctagcaaaaaaataaataataagtttctcagagatggtaaggctgaaataaatggggaaaaatctgaattgtaatcctttttctgttggacctggtgttggggtttcacacttgtgggtgaatgtgggcctcctgtgagcaccagcacaaaagactaaactgaacaaaagattaaatgtcacctctaaaattctgtgcaacaagacttccagccacagaatgtgcaactcagatttccaagtaaaaacacaccaggaagcagatcttagatctctgttatctccttggcaccagctggtattcatcctcaatgctagctagagttgaaataaagagtgaaagaactttctcttttattacttaataaacttccttttttgagctgttttaggcttacagaaaaattgagtggcagtttcagggagttccagcacggcccctgtttctttctcatggtccctgcaggtttcccctattattaacgtctgtcattagcatggcacatttgttacaattaatgagccaatattgatacattattcactaaagcccacaggttgcgttaggggtcattcttggtggtgtacgttcttcaggtctggacaaatctataatgacatgcattcaccattactatatcacgcagagtcgtctcctggccctacaagtcccctccttccccacctgctcactcctccttcccaccctccccaaactgtggcaaccatttaacttttgactgaatggatttattcttattctgccttattgtatgtacaccatattttaataagataaaataatagtctatagtagacttctgtaaatactcaatgaataaatacttgcatgaatgcaggaaaaatcaatcagtcttgcaggatttcttatgcgttacatcgtccttataagaaagcagtcattctcaccgagatgtgctgagcagatactggacatgttctgacccagataagggctgggtggaagtagggctggagacacagagacccagtgccaacttccaggacctcggaagaactgaaggcagagaggtcctctcagtgtggactgggcctctgctggcagccaccagcgggcacagagctgatgtgtgttatgccacgtggggaaaacctacagacgattctgagaaaggctcacagggacaccctctgcccctaaaagaacaatttaactctaatttatttctgtcactctgcattttctgacctttcccaagtgtacagttttatatgcatttaactgccaaattgtcatgtgagattatatggttatatttcattaatatattctagtttgttcagctgttcttactgggtgaatttgtgtggtttcctgacatttttgtttttagtagtgcctcagtagttttatacataattacgtttcccttctggattatttccttagtatctagttcaagaagtgaaatcgctggattcttgtggtaaatttttgaatttcacagtataatgctgattttctcaaagtctcacattctaagaaagtataatgaggcaaaacaaacaacaaacatcttaagttgattttttcctagcatcttttccttccatctttgcttgtagaatctagactatttcatgaacccaagatataatcagtatccttcttcagtatggccaaagtgagtttctcattattttacctccccttcaggaaatgacttttcatcttgtgttttgggagccatagatggttctgggcaggaaactggctttggatagacccagcatgtagatggctatttggccttgctcccagtataacgatgcagttccctgtgaaagggtatgagtaggttttggggctctggataccgtgtggcctgaagagacaagggctcaatgccaactctgcctgtttccaactgtgtaaccatgtgagcgtcaaaaatcatggacgtgctctggttaacactgagtgggagctcaacaaattattatttttaattgttacttggacatggccaagttgactacactttatgttctgctacctgccagtctgaaagtgacgccacagaaggtgaaccgcatgttgggagatgctcctcatctgcttaaatgaggtgcaaacacagcccatgcgcctgctcttcatgactgtatctgtaccagcaatatttgtattggcaaatcacatgccccagtgggaactacttaaggggaattcaatggatttcattccttttatgtaattggccacttagtaatagacgtgtaggtctcttgtgtggataaggattctgccttttatgtaagatatgtgttgcaattcagctttcaggtcccagccccgggaaggctccaggccttcacaaactggcccacccacgagaaggaaagcaattgtccaaatgtgggtagcttttcttcccactgttgtcagctgcttccaattagcccccatatacataatcccagtttgtgtctgtatcagtacaattctcccatgtcaatgtgaattttaagccacagagggaaaggggacagagaatatgctttcattcagctctcctcgtctcacacctcttgccctgcatgcatttctttgctctgattaaacgagcattttataagccacatttgctgtgtgaaaggcaaagtcttccctcccacggatgacggtctccagggatgtgtgtgtgtgtgtgtgtgtgtgtgtgtgtgtgtgtgagagagagagagagagagagagactgtaaacatatatctctgtgaaacttcattttccatatgtgaatttttggaaccgagacaaatggaacttagctaaaagatgggaaaggtagactgactctgacttaatctacttaacctaccaggcaatttataacttgatggcctaatttttgcagcacccagaagcaagcctgtttcagcacggcaaaggctcagctgctaagtgggcagcattgttggaggtgagcagcttaggctgactgttcatcaaaggaccaagcgcttgaggttcgctcatcgctggaggccagagtggggagggccatttaactgctcaaggccatggaactctactgtcagtttcagggaaatttgggaccctggagcacaaaccaaaactccaattaaccaggagaggaactcgatccccaggagataagtgaagagtaagaagtctatctttagaaacaagagatgtccaaggctagaaagatggggaaggagggtggaactgttctggaagtgggtctcaatctcagcaccagcagctctcaagactttctagagaaggaaacttcatttctgaattaaaattagtcttcaatgacatggcagggatttcggcacactctcttgcgtcataggccactgtgttggaggcaggagtgttggctttggaggcatagagattaaaattagagtaacacgtgagcactgaaaaggttaaacagtagagacatggaggactcccgacccccatgtacccctttcttaaccctttaattaagatcacagccctagaaatagcttgcaaaataattaactactgatcatttataccttagtgcttctgtgagcatgttttctctttcattgctgctcatctgcatggaaaaatgtgcatgggtttctgaatataactccatggtgcttgcttccattatatttgtgccatttggatcataactgataagcaaccaaagagtcccatattactgcacgttcccatcgctattttatgtgaaggtggtcctgggggctgttctgaattctcagtttccttttttcccctccccagttctttgaaaatatcagaaacggacttgtggcatctttgaaaagctacttaaaatgtgctgctgtgctctgaacttgaaaatgtgcttttaatacaaagtttgtgcagcccttgctgctcatacgagatgaatcttaccatgtggtggatgcccgtctcatgccaggcactgtgctctaagcccattggtttatttcagtgcttgaaattggctttcgagagaggcaccacggttccctttttacaggagaggaaacaccagaggatcagagatggagagtctttctccacaaactcacagaccccaaaggcaagctcagggttgtcagcttccaaagtctgcctgctccaggacctcatgttgcatctccattctcttcactgagggtcaaatggaaagaacacatgggggtcaagtttcagaaaataagagaaatgaagaaatatgtgcccggaagcaagaacgaccgacctcattaaactggctcccttcacctcctctcacatctttttctgccttttggccaagttttctctcccccgcatttcctccttgatctcgtttgaatcctcttccctggtgaagtcatttaggttcaggctcttattttactttggtccataatttagatcgaaccacatgtgctgatgtgattgaaacgatgtggaattctctggacagagatagaattatggaggggttagtgtgtgtgtttaagattaaaagaccaggtgtatgggaggaaatataatgaacaaaaaatagtattttaaatgaatactaaacttgcactcatggaaaaagttctcttcccatgaggttctcgcaaagcattttaccatcagcacacgcagtttttctcagttttctgagatggggccatcttgaatccaacagacaacacacagcatcagccagactaacacaaaggacgtcatgggcatggacgtaaatactggtgtcaacactaggtctgcacctcgagaggagtggagcaaaaggatggagtggcagatgaaggtatgctgttcagaaaggaggcagaaatgaaaggaagaccatcagtgcgctccacagcttgaggaccgtcctggagggcaaatgccagctgctcacttctgaaaagaaaaattccagtgaaatgagtacagtcattcttaggattactcacttgatactgtgtatgtctcttcttggcttctcatctccacacaaaaccctcaggtggtaaaaatctaattaaaaaaattatataaagtcttgtagatttattagcctgaacataatagattttttttaagcacgttaagtcttccatggactaaaagaaaacttgtaaacctaagagaacctctatttttgatatacaaaataatacatttccttaaactatgatcttgatactagaattttaattaaaaaatacctgcagtttatatgcaaagttatagattaatgcttaaaaataggttgtatgtagtatccacaggtcatgtttgactgtcaaatagatgtaattttaattcataataattgtgtcgtgttcttccccactagaagccaattatgcaagcttcaccattcacacatggaaaataatttaatggagtactcattgcaatttcacttatccagaattggctgttgttctcagagcagcttgtgttgccttgttaaggagaatatgttagtatccagacatccagaaaggatcctttactgtttcagagtccattttccccacttttgaaatacacacacaaacacccattcatgcaaaccaaacagagattgtaaagtgattccactgacatttatgcacttcttttttctctttggttcttcaaactctcagtcagtgcgcatttactcttaatttagatacggtttaaacctaattagaaaccagaagctcttgtatttccacaaaggattatgacagccccaagaaaagatagtgaaaccattatataacaagataaaggcttcttaacaatacaaggatggattttctcattgatcttagccttctgaattttagaaattgccatttcaaagtctaaaacaaaggaaaatcagggaataaaagaatggtaagtagacacaaacctactggctccatcatttctgttttagcaaataacctgccacatataccaatagcccaagagatgggcatgtccctgcatttcctggtcaaggtgacaacactgcgtcctcctggaagaggtctgccactcaccataccacaaaccaaatataataaaatcagaaggcacactatagtgaattttttagaggcatgtattgaaaagcatctcaaaaagcattctcgaagcttccagaagtcaactcaagttatctgaaaagtgacacttttgatgattgctcgcttaatactgggagagccagatgaagattcctccccacttcctcagatgtgcaactctggaatttcttagtgttactggagattcctgctgcattctgggcctttaatgcataaacactgagatgttctaaggaaattactccctagggaggagaggggtggacgaggagtaagctttgctggtgactcatgcgctgtgtggaaactccctgcacaagtgagctgcgcagggtgagtctaaagggttaatgcactttcaaaagcctctaatttgttattccagaagagtaatttactcactagaagtatctgggtggctactaacacatttgtgtctttaaaaagatcagttttattttaagattaaaaatataaagcaagagctggaaagtcactaaaaactgacagccagtttcccattttcaagagtatttattaaaaggttctggttgcagaaggaataagaaatggcttgagatcatgacacagtgaatcatgttgtaaacatgttagctatggctgtgaattcaaccagcgatgagttcaagcgtccccagaaggtgttgggggaattagggacatggctgtgtttccccagagaaaagtggccattttactttccctcttcactaacatgcttttgacatgcatggcagagctgaaggcaaggggaaggggacaacatagtaagtgactaagtggcttttttttttttttttttgccaagtgaagctgagtcatatggcctctgtcattccaaaactattctctacggctgcattcctttcgctcttgccttcctttagaaccctggagaaggcctcctgaagcctggccctattatgtatcctgacaaagataaacttttccaaaaagctgcatgttgtttctagcacagtttttcctcgcagtgactacgtgatgaaagtaccatgcagaggaggtgtctgactgaggcgttcgtggtgtgtgacagagtcccctgcacaggacagccgcactcccctcttgcgtcctttcctcccatgtttgcaaagcctctttccctgtcagcagggggtgttctggcagttgacatttctgaaaactacagcctacatttttaaaaaatccagtaagtgaaaactaaaaaattaataccgtggtcataatagtgtggcatttgataactaatgaggcactgtcgtgccagctattattttcagacatttacagtccttttttaaatacaaagaaatatttggtgtgaaatgttccccgggagctggtgcaagcagaggcgacagggcaagggagcttgggttgtagcctcgaattcctccggccagggctaccgtcagcctgcggcacacaagtaaatcaaatataaaaccaaaatttctgtaagcaaatcagtttctaactcactgtaacgaattatctttcgcacatcacagaggcatctcttttcactgtcgagtttggtttgcttggttacaaaaagggcagttcaaaagctttggttgctattgtgaaagtcagctgaattccttccaccgtgctggggtggggtggggttcacgcaggttctcttttgtcaccaggggtgctgtggattcacaagtaagcaagaggctcctcaggtcaagcctctggctgctccctgaggtcagctgcctagcttctcctcctctgagatagacgggaacaaagtctttgatgtgtgcatttctcaagcttgacaatgatacagctacataaaaacccatgatttcatatagatattccaaaacgtaaaagtaaaccatgcatccacagagacatggaattacagaactggatgctgagctggtcacttgggaggcaggcgtccttgccattggtttatgcctcagccccaccatgcagtggctggccaggtgacctaggccagtcctgcatcctcggctcctcacctgcctggtgggacagtgacatctctcctgcagcactgctgtcagggtgagggaggtagggcgcagtttcagaaaaccattgggctgcacctgcgtgagcacagctgcaggagcaaaagtcagaaaggtcagcaaaggatttcaggagcaaaggtcagaagaaaccctcaaggtggttgtgtctgcaggaaagtgctgtcgtctcctgcaatgctttcaagactattcagaagcacagtgtgaagggagagccggagcccatggggaaatgactccagagtgttccacgtgttggaaggcatctgttggaaaacggacattcaagcaaatagttgcctgcatagacaacgcagaatgactgggaaagccccaacaagttacctactggtaaatgaggtgagaagcttaaagtgagaaccccattgctgcctctttttcactttaaaaacatttaagttttgaattatggtaaaatacacgtaagatttactactgtaaccatttttaagtgtacggttcagtagtgttaagtatattcacattgctaaggaaccaatctgctacttttgtttattaattttttcctgaggggaaatatttttaaattttaaaatatttaattgacaaataaaaattgtgtatattcaaggtgtagaacatgatttcatatgcacgtacattgtatactcattaccacaatcaaagaaattaacacatccaacccacccatagttgccattgtgtgtgcgcggatgtgcgtgtatgtgtgtgtatgtgtgcacgtgtgcgcctgtgtgtgtctgtgtgtctctgtgtatacgtgtgtgtacatgtgtgtacgtgtgtgttcctgtgtatgtgtgtctgcgcacgtgtgtatgcatgtatatgggtatgtgtgtacgtgtgtacgtgtgtgtgcatgtgtgtatatgtgtgtctgtgggcacaggtgtgcctgtgtgtatgtgtatatgtgtatgtgtgtacatgtatgtacgcgtgtgcatacgtgtgtgtgtgtgcacaggtgtgtatgtgtgtgcctgtgtgtgtgtgtgcatgtgtggtggggacactaaaaatctctcatcacctttttagtcaaaagaacagttgttttggtttggctcttctgttttaaaatatcagaacaataataatttcccacagacaaaatcctcaatcctcaccatccttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaacgctccagtgaccgggaggcaatagtctgtccacatctaagaacacacttggaataaccttagagaagagagagagagagagaatgcatggttagtaggttatcaaactcctatgacttttcacaggaaaagccctcatccacaccaactttaggaatgtgtagaaagaagggtcagggacaggggtgagtggtgggcagagcagttggagggcacagggaaaaggcatctggtcatgtatttggagtaggaggtcttgctttactattgaattgcagggacactttgggaacagtgttcacttctttttgcaaccatttcttcagagaaaagtcatgatactcaagtcttcttacaaagcagtttgaggctttgagtaccagactgattacagagatgagtatgaagcattattgtagtatttttaagtgaaattcactaaatgcaaataaacctagcaaatgctctatggttaatttttttctaaaattcagataattaagacaattcattctcctgaaactgctgttcatgtaaaaaggaattttatcgaggtggcccttgagtgccaaacagcctgtcctcagctgcaaaatgagtcgttgatgatcctccagcaagggatactttttagctcgtgtggtgattgctgcacacgggatatgtgcagcaagtatctgctgagctaataataaacagcctcagacagaaagacagtgggcacaaggtcatgcttaaaaagaccccttgttctactgcatcccagctccccaccatggggcctcacaggccctggtgaccaagcacatcagacctggttcttgctcagtcctgggagccacagaacccagcacgtactttacccccaagaccagactccagcttggcttttgtcctcctctccaggattggtgacctcctaggtcgtgaagctgtgatgagcaaagacacactcctctccattctcccaacttcaggtccctttgacagtgtcagcaggcatttaaatagcagaccacccacagcagggctggtagatgcagtgaactcaggaagatgcctgcatagactctagtgttaaagacagaatccttacaaggaacccccatagttacctaactgctgtctccagtggtcatagaagtgtgataacccactaatcatcattctctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcagagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaaaatatagtgaggtcattcatcttcggacaaattgccccaactacggtgggaaaagaaccaatgtgttggactatttatctaatttttgtttagttcggggatacaaataaatgcatagatacatacaaacatgcgtacataatagcagcagcagcctgtgaaacattgacaagacctggagttggaagaggactttgccatcctccagtccaacagttgcctgtcacagattagacgactgggatgtgcgcaggcgattatttgcaaacggccctgagtcccccagtttatgtcttaattcgcagccagggctgattgtagaagcaaatttgcaaacatgtgcaagaagaaatcacacatcctagagcttggatttcctcgtttcttgctatttctatccgtagacagaaccattgctgagctgttaaatttgtctccttcccctataccagtcttgaaaaaggaaaggaagtggagcaaagaaaaagaaattaataaagccggcagatcctaggagaatcttatttaatccaagctttgtaaagttttgctttattccatggcaacatgggtatacacatcccaccggctgtttcagtggctcagagcaggtaaggcctgtgccaaacgccgctagcaggaggaacaacgtggagacagccccagaggtggaacgttggcccttctgtggctccggtgtctcaggacctccctaaagcccagccctgacactgagcaagtttccaccactgttaggaagaagtagaaaggaatttggagggttggtgttactgttcaagagctggaaggcttctgcccccattcccattccattaattgcgtgaggtagagaactcatagaagataggaacacatatgctgatttccaaaattgcctttgtatattttcacgtgaagactttaggggcaaaagaaaagaagcaagcattttgaatatgtgtttcaatttgccttctgttatataaaattgtattttgcctattcttttttcattattcggaaccttcaagaaataaattaagttctctcaaaaatgtgttttttgaaaagaggactaaaacagatggcctggctgtgttaaacacagggaccagaccagcacccacctctccacctgccctgccttcactggcagaattgtgatccatcatgttctctgttcaatgtcatcatccctttcagagcatgggtctcttcctttctaggcagtcttaccaggatgcatgggtgtgcctgcgtaggcacacgcacagctcccaaggactctaaaaaaagatatttttctgcttatatactaataatatgttagagatttatgtttcaaattagtacagaatcacatggttctctccaaattatatttgagagagaaagaatagaacaaaatttattttacaaaaatactcagtacatttagggcatatacaaagatgttccagaatgtagcttatctctttaaagacaattaacacagtttctgggcaaggcaaggcaaaatattcagtaacttagcaacaccaacagaagacagccaatattgcagcacatttttctcttggattgggtcagagagtactgcagagaaaatggagtagagagacctgaaatactttcgcacacactgtggtcagtgcagcgtccactgtgtgccacagtaatactagaaactccctggttaggccttggaatccagctctcatttcgtatgtgacctgcagggaagtaagttaaatgcacacgttttatcaagttcaaatgcaaacttaattttaaatgtatgcaacatcagtttaagcgttgtagctattactagcaattgtacctattactagtctgtactctgcacaactttggagtatactgcctactcaaggtggattttagagctctatttgtggcattatatcacggacaaaagcacgttcatcagagtcagaggaatgtggtgcaaatcccagctgtcccacttaccagctgtgggacttgagtaagctcctgaagcagctgcacctgcattttctggtgggcaccatggagctgtcagcagtgctttcctcagagggctgcgggctggatgaggtttgctggtgcatgtgaagtgtcaatcattgctctcatgagtggtgatgctgatgccgttcccttttttagggaagtgattttcccttacaaagttaccaacagtttcatgttggcccatttttctattaattgtttccactaataggaccaacagtggtagtcccatcattttattactgcttgtcgtagcacaagcagttgcttcattgtgtttagataaatattgacggctgcttttaacagtctgctgttttgtctccttttgaggtccttaaagtaatccttaaaaagatagtgcagatggaaagatgtctggagtcagtgaacctgccttctttcctgtgtgcttgtcagtttctaaaatgccatacacaaaggactttcatgatttctttttaggtacatgattacagttcaattcacttcactgtctggaaaatttccttataatcaggatgaaatttctcatgttagcctttcacatttcactacttttagataaggaattctcaggctttgctatatctgactgctcttggaggctgagcttttggctaactacctgactactttgtcgtttctcttcccttggaatgaagcaaatatctaacttctcactcattgtttctgctattttaccatttagtcatctgtgatttttctaaatactgaaagacttccctcaattcaaactatgtgccggatcaaggaaagggcagttggatattgcagacagcatagtgcaattgtgaagagtgtctgcttaccagccacgctgccttgcacaagttatcaagcctctcaacccacttcctcaatctgtaaaataggtatgagtgtaggaccttcccaggggatttttttgtgactatagaatgattctcagaagactttcaggcagtatgtgggtgaggcacatgctggaaaggcttctgcaggtgcagtgatcaatgcttttctcagtgtgtacatcccataatacagacacgttaccagaaactccctagccaggactttgattgcagctcacattttgtatatggcccatagggaaatgaagtgtgtattttttataaagttcaagtgttaacttaatttggaatttactatcaaatctcagttgttatgggcatttatagctattaatacttcgtcccatgtgtcccatgaggaaaccaaggaacagaaattaaagttctttctggagtcccctgaatctcgttcctgttcttttgcaccctgttaattacatagagacattcacagctcttctgaccttatcagcgttaaggaaaacagaaaaccagcgtgctatttgttctgtcccttagtcaagccttctcaacatatatttttcttccaagattttgcatgtgcacagggatgcctatcctctacaagaaacacattttaggcaaattataattaaaatgctgtttacatctcttcacctttagaatttaaagaatgatcatttcttagattgcatctcagacacacccttcccctagtctggagagggcgaggcccatgggtactgcaaacagcctgacgttgtcaggggcggtctcaacggctcattcaccacatctgcctcgcgaaggctaagccatgtgctgttacccctgctgcgctctggctcattctaaggtacacgctattaaccttgtgagaaaacaaagaggccagccccacccttcctgctcactctgagtcacggtgaaaatgtttcaggatctcgggttcgaccatgagtcctgtccaggtccaggaggaaattcggaaggaccacatgttcactctgagatcccactttcatttccctcctggttgagcagcattaatactctggctagatttaaattctggctttctccagttagaactgaaagttatgacaatgtaatcaaaatagaatgtgggtttacagctggccccctggcctggtttgtgaacataaaacagaaacagaaagtgtaagtggtgacatcatattctctcattcaatgtgaaaggccaccgaagtctttccagaattatttttgagaataatatgaatttttaaaaaatacctaattattttaaatatcgtcttgcttgctccccaaatacctactgttttcaacttggatatacgacatgattaaagaatatctaatatttgggaatgcatactttaaccttataaactaccactgtaaatagacagactcattaaagtgaaaggacattttaaatcaattagtaagcaaatcaattaggtggcaaagacaagattatttttccttatggtagttgaagaataatgcttaacctgtcattctaattaccaagcacggtgttctctttggaagatcatttcaacaaaacattattttcatccagaatttgaaccttgagattgcatggtattttagaaatctattttagaaatctttggcaaaggttactattaaaacaatcacattcatggaaaatcagtataagagcaactaaaataactcacaataccagtaaaatcactttgtcatcttcttaagacttttaaagagcatttgtaagtaactgaatagaaggccaaagggtgtgtaggtagcccagaccatcagtgggcagccagggccagggcaggggccacggttgcagcctgcattcttctaaagggcagagcaaattaaagttgaagcaggagctaaaaaaaaaaaaaaaaatgtttcaaagaattccaccaaccagaggatactacctaggacagtttgggcctaacttatctgtgaaggcctccagcttcctccacaccggtggccacttttcattcactctgaacccttctttgtatggaggtcattttattaattgagctgtgaccaacatgacagaatttcctgttttagggcttttataatatagatagtttatatctaatttcagaatatattcactggggaatggacttagcaaccactaccacaacaatgcaacaatgtgttttggaacaaatttaccaatctgaatttccccctagattaggtcacaggaacattgcagctgatgtacagctatgttcctcctgaaacttggagacacatcctcttgagctgggttataatgggccacccaaagctcgagttcctgtaatggatacactcaggcagcagaacctaccaccgtagtgaggacagcacccagagccctcagaggccatcacaagtgcaccacagctgccttctctggcacgctcagagctacacagtgtactctgggattggaactctttatttttttttcagttgatttgtaaataagattgcacaaaaatccatgcacatcaactctccaaatcagaatttgctgagctaaaaagagcattaaattagatgggctggctttcaaggggtgggggtgcaatagtggaactctgcacaacagttctttacaaagagacaagcaagcacatcgcgtggaaatttccattcaactggaaatgtccaagcctgtttacctcaattaattgtccttgttcacttgtccagcctagcaattgtccattagtaatttgttataaatgagacatttggtattaaagcatctctttgggatactggtatggtttattataacattctgttagtagtgttgtacaagcttgagatgtattaatacgaaatccaagctgcatgagggctttatttttcaagcctacaccttgctgaaattctgaattaaaatatgattctcagtacaaatgaataaatcaacagaaatggtaacgcatgtcaaatattcttaaaacccaagaaagccttgtaacttccttcaatctaatgggaaatgcaggcaaatacaagactgatgtccttgagttttattatcaagactcaagggcaccagtaaaatctagtttcattggttggaaaaaaaatcctgataagcactgttaggcatattaactttaatgattacaatttttaggacactctgtggcctagacttagaaacacaactaatgtccagaaaaagattcctctttttattccatcatctgataggcctatttttacacatacacaccaaccaaaagtagccaagcaaacaaaacaacatactcacaccccttcgcctattatcatctaggtgattttcaatgctcattgcaatgaaacctacttattgtgcatggcacccacccccactgaggaatactgtagtttctttccctttgaacttcattagtagagcacatggttcattcactcctgaagagttcttcgtatgtcagaatatatatactacaacataatttccatcagagctctgaccacccgcttatctattttcataatgcctgccactccatcattagctgttgtcatgtaggctatcaataaatatatgacaaataaaacagttagggaatgagggaaattgactagcagccaaagacctaagccatcctctgcttggacattagaaaactgagttcactacagtcataagatacacaaaggcagaatgtaagccatacaaaaatccatgtcaatcccaatatgtgagtacaactattgaacaccatgtactaatggatgagttggtaaatcattcaatgtcttcatgaggtcaattacagattattatttagaccccaaagattccaaagatggtatttcggtcagatcttcatcctttgtaagcctagcagaaaatatggcagttttattgactactattctttgctgggtgtggtatttttaaactgagacatcagtgtgcctagcacagggcctcaagcacacagaaaaattccttgataataattaaataaaatttcagcaaaaaatatcatcttaaggctgtgaaattatcttcctgtgtggctaaaatagtgaataaaattcagcgcaatataaatcatagtacaatttcatcactaaattttctgatcttgatcttgtcattttacattggaagtaaaaatgtgtcctcctttttttctctgacagtgaaaagtgtgtgtgtgttgtgtgcccttttgcacaccctgcctcacacttgctggtctaattccttccagcatgattatgatataattaaatgacagaaatgtttacttccaagtggaactaagccagggtaactcagggtagggcagctgcttgcaccgaaagaccaagactgctagagaactaggaaacaggcggtgcaagaactccaggctctcatggaagagcgggaggcttctatggggctgcagaaactctttggtgcttggggaaaaaatgggttaaatgctcttaaaaaagaaacctgggagaggtagtttccagatgcaggcccgtcttttcttttaaacagaggcagctccgaagagctggacattgaaccctgagcaggaactggaggccgtcagcgcagctttgtttggcgagcggagctttgcaagggtgtaatgctgcaccagggagacgctatctgcagggaccggtgacgccgtgggtgtggagggggaggcagtggctggccctcttggggtaaggtacgcccaggaacagtttagaataacgtgcgcgagtcaaagggaagaagaagctcctgcagaccttctgggcactgtgcagggtttgctcctgtccaccgtgccgtgttcctgtcctggggtatttgggtgtgtggcgtgtggggaggggagaaggagcaaggcggcagggaggggatgaggaccaccctgtccatgggacaggccctgggccccgcacacaccccaagccccgcgtcccgcgtcctcactgtcctgggacaccccccaccccaccccaccgccacagcccagagcggtgccaggaagccgcctcgacgcagccgtatcttgaggctccagccccatccccagggtaccacgccacgtagagacactatttttcacttcgtgtttgtcactcctaaagcatgtgtgctagctgcaccaaccctgggatgcctcggtgcatagggtttatgtgcgtcctcctccttccctctgagctggtcccccgtggggaactgctgcccagactgacctgcgtccttccgcacgtgcaggaaaatgtccacgtgcacttgtcagggtgggggccacacgggcaccaccactgatcatctgtgggatcgagttactgcccatgcagatcccacgtgcagggcccagtcgctttggtgagagagtggacgctgtggtgactccacggtctgtggctgtgctcaggaggacagagaggggacatcctgagatggtttgggcagcccgcggatcctgtgcatgtccccagagcgtccactttctccatggagcagtggagtggcgttgctgagacagaaagttcaggttctccactccccatgcagcccccactcccctgtctccggccaggcacgcgtctggggtggagactcccggtgcccggggccctccagacctctttccccaccccagggagcaggcgggtacttctattccgtttggcttcagaagggaaaagagaacgtaagttcagggagttctcgtccattcctctcccgtgggccgggcaggcagcagggacagccttcaggagccaggaggggctcgagctgcgaggccctggaatgaggcaggcatgggctgaggctggagggaaagccccgctaaggctgggcgggggcgggaaaacttaccaccaggggactcgagatggggaaggaaaggtcagaagaggagaggccaggcacggggtgtgggcggcctgcagagctggagcaggtgctccgcccagagccaggcatgcacactcagagtaggtggcctgtgcagcggggaagaggggcgggtcggcgtgctgctgaagatgcaggagctgcggcctgctctgtgcgtgctgaaggtgtggtgagaagcacttacaaaaagaaatggactgtgttaggattgcacattttactttgtttctcccaaatacgtgttctttgaatttttttccttccagggccaggactggagtgatggttgagacaggcacgcactgggtcttgtctgcatttacattttgagattttgttcagcatggattttatggcgtttttttgtttgtttgtttgttcgttttcaaaatactgcacggtttatcgtgaagacagggtcctttgctgccgtcttaagttttgggcccaagaacgtgccccaccctaggcccgggcctgctggcttcatagctctcatcattcccacggaaccttaagacctgaggacagaaaggaaggaaacaagcccagtagtccgtgaaaatccagggtcccgccactccaggtgtctgcagcagagctgaacacacgtaggctcttgccaggaggggcatttgtatgtgctgagcattccttatattctcaatatgacgcctttgaaagatctgtggtttgcaaatatttactctcagtccataacttatctttccaacctcttaccaggctcttttgctgaataaaagttttaaattttgaagtctaatatatttttaatttttttattttatggatcatactttttgtgtcaggtttgagaagtctgcaccaaagtatgtcctgtggttttcccttaggtcatcttcaacaagtttcatagtattttgtttagatgtaaatctgtggcccattttgagttagtttttgcacaagagttgaggtcaaggttctttttttgcctgtgatgttcagtggctctggcaccatttgttgaaaacatgatagccaatgtcaagacttaatagttataataatcaggagcttttgtttctttttgttttgtttttagtaactgccagtcactgcttgtggtatacatacacaatggaatactattcagtcttaaaaaaaaaaaaagaaggaaatcctgtcatttgcatacctggaggacattatgttaagtgaaataagccaggcaccaaaagaaaaacattgcatgatctcactccttcatggaatctaaaaaattgtattcagagaagcagagagtggaatggtggttaccaggggctgggaaggtgtgagcttggggagatttggtgaaaggacatagaatctcagttagacaggaggaataagttaaagagatctattgcacatcatggtaactgtagttagtgacaatgtattgtatacatgaaaattgctaagagagtagattttaagtgttctcaccacaccaaaaaaaggtatgtgcagtaatacagtcattaattagcttgatgtagccattccacaatggatacatatatcaaaacatcatgttgtataccataaatatatactgtctctttatgtaaatttaaaaataagataaaataaatgttattcacttgtcgtggatgtggtggggacaggtgtgggatagccctccctgtacaactaggacccaggggtgatctagtgacactagccatttatcaggacgtatgggtgccagtcaggatgataaagcttccttttggccactatactacttagaaatgccctgcaaaaggtgcacatcaaagattgaaagctcaatcctggattttaagtgcttcaaaagtgcacttaattgccacatttttgtcaaacattttcccaggtagtatttttcctcatgtaaaacaacagcaatttaatttgaacagaaagcattttgaaacatacttttggcagggttccttgcagatcagaatggaaatgattaacagggcaattatcaatcatggacttttggcggcagaaggaactgtattgtttggtacagtctgggccagggccacacaccgtaacggagatactctattctgtggacggttggagggggctgtgctgagcagggtaactgcatcttttcctagactgttcacactgctgccacgaaggagtcttgtttagactggacctggctttcttcttcgcaatgagtgttgcagactcccgacaaaggccaggtggtaaagtgtggtgtctgtgagcgagagcctgagatgcctgagctgacctgtcctcagccacctgccatcgtgcagaggtgagagcagcccctgaattctgcccctcggtctctccatagctaaagcaaaaccatccttccgtgctcccaggacaagcaggctattaccaaatcacccactaaccctgggcgaggaggggccatcactgcacaattcatcagtgtctgtgacaggaagagattgttttagactggtttttttttttttatttgcaagcttttttctctctccaaaacgtgctgtcagtgtgttctaatttactctgtaaggaattctggagctaatcataggctcacaaaaagcagcacaggaaagtttcccagataacatctatttcagtggctttcaaacatttttgaccttaccaaagtaagaaatacattttaatatcatggcacacatacagctgtatctaaactttcataatactgcctttacgatatcactctgatattgtctattcttttctgtttatttttctttttgttccttgttatgctggttgtgacccactccagtgatttcacaatgcaggctgggtggtgtcccacagtttgaaatcccaatctagggccttcctctcactgtacaaagtaggtaactggggacattagtggatcagtgatcaaaccaaagttatttgatcttaccaagtgatatcaggatgagaaagctgttagagtgtcagatatgtgaaggaacttgggtcattcctgatacctcaaagagaaaaaaggtagtccttgaacacctcctacttgtaaaggatgcacaatcctacatgcccctccctttcctttcctcccctctgtaccccacccctgcccacattttcttcataagcagctttggtgttttggcttgtttgtttcccttgtctcctacctgtgactttatagccttttggagactcacagcaatagttgtatttaaactcagtgggtggcatccaaggctaaaaaggagattgcctagacacaaaaccacccaagggagaaagcaggacagcatcttactatgattgtttcttgtttcttcctgtctcataaggattattacccagggttttcatttttttcatttcatggttcattttcgctccagtgtagacatacaatagaccactcgtccctgtggctccgggcagcagcctcatctgagaccctcctgagacatctcgtgcagggcagccgtagtgtgtggcttccccagggctgctctaacagatcaccatccttgccatggcttaagaagctgcagatttatttgcttacagctctggaagccagaagtccaaaatcaaggtgtcagtagagtctctctctctgaaacctgctgaggatgatgcccctggcctctccccagcctctggtgttcccagcagcccttggcattccttgccttgtagatgcaaaactccgatctccacctctatcctcacagtgagttctcctgcatgtctgtctctgtgccttcacattcctctctgtgtgtctgtgtttccatctccttatgaggacacccatcactgaatcagggcccactctataccagtaagacctcatttcaactccattacatcttcaaaaaccccattctcaaataaggttacttcacaagtgctggaggttaggacttgaacataccttattgaacaatccaactgatgacacatagtaatttatgcactcgttcttggagacgttgactttatttagtagcattaaccatggcaatgtcaccagcatcgctgacagcctgaagcatatgatctccagaatgtatttcaatcatcatgttcacttccttggtattctttagacaataactcagccttgaactccagtaaagggtttccctgggattttcttcttgactcactccactgtggcctccctcatccaggactgtaacagacgcctgacgtcagtggtctagacctctctgctgaatgtcatctttggtgaatgtcttatgagaaaacacatggttggtcactcttagaagggcatgaaagcctgtctgcagtataaccaaaacaggcacatggcgaggcacactgtgcgcatgtgtgtacaattaatatcatggttttaaattattttcaggccaaggggagatctttgctgcatctactgaagaaagcgaatctttttcttcctgaaaaaaaatggctacttattagtcgaatttgtgttttaaaaatatgtgaactaatataatgcagacatgcattaatgtttaaatatactggaagtttttggtaaaatgaaacccattgtctctgttgattactttgatgagtcaagaagtaacatcctgggaatgattggccagtttaaatgagtgcctcaggtttttggaatacaagaaatcaagaggaagggattagaacatataggttagcaagattgggatcctaaaatacagacccaaatgaatggaacaaaatcagggaatttattaataacagggtcaaggccaaatcagtaacaaatatcctgagtggaagaaaggtggtttaacaaatgcccctatgaaagatagagattggcttaccatgatgagatgtaagcccaagttatgaggttggcacacaaaaccacaaatgtcatagcttaaaacaacacacacttcttatctctgtttctgtgggtcagggtctgggttctcagggactcacaaagtatgttttcatctggagctccaggtcctcttccaggctcataagggttcttggcagaattcagtttcttgaggctgtaggactgaggtcctggctcctagaggccaccctctccataagcagttcttagcatggccgcctgcttctccaggcccagtgggaaagcatgtgcctccaggagggctcagtccattcttcatggcttttacctggttaagtcaggcccactcaggataacttcattttgtattaaatcaaaaccagctgatttgggatgttaattacatctgcacaacttcaactttgccatataacctaaccatgggactgatatttatcatgcatttgggtcaagttgcattaagagatataataaagctggacaagcttctgttgattagaagagttcagttacaaggctacacttgggaggaatgtttacaaactggaatggtcagaggatggggaagacacttgagaaaagtcaagtgacggatgaaggcaaatgtggatatttatctgggagaaaactaagaggagttataatagctgtcttcaaatatttaaagggcttttattaggaagaggaatttggcatattggattttgccttcagagaagtggagtcctgagatgctcttagccattcattccagcctccagggctcacctgctgtcttctgtccaggttctcggtagcagggcagtacagccccatccgtgatcttccatagtcaggcatattgtcacactcagtgagcggagagtcaaccgggaggaaggcacagtttctctggaatgacctacggaatggtacgctcaaatgcaaattctccttcccttccccagtccttgtccttcagatggtaatttaggagctgaaggtcagggcaccagcagcctttggaagcctacaggacaacagtcagcctggctagaaaaaaaaacaatgtcacaggcatgttgtgtttaatcacatgaaggatatttgcattgttttccaactgatgccagcagacacattgtcagtggtatcatgcctggggtatcagagttgacattgggttgccccttctctgaggcattcatgtaaatccttttaagtttataaaacctccatgtggctcctgcatgcttcatcatttgcatgtgtctctttttccaggggaggcagcatggggagcaggatgctggtgggctccaggtgcagagagcagggtgggcgtcagaccccaggtccactgtgcacgccctcttgtagagcccgttccgttgtccatgagatgaggagtgttcttatctctaaagtattatcatgaaaacctaacaatgtagaaagactaaagcacatgggtggtgcttcataaatagtatttctcccactttctgaaaactcctgctgaagtaactgcacaagaatccttgaacatttagaattctggttttagccataccataaagtcagtagtgcgtggtggaattctgctaacgaaaattgcgaaggatcaaggcagagtacagagctggtgtgtagcgggtaccttctgtctgctggcactaggtattttacacattaaatcagctcgttctcacatcagctcttttaaaaataaggaaatgaggagccacagtggcccaactgatgcagtggcagaagtagaatttgagcttgtgcagatgtgcctccgtgttttgtctcctgagcatgctgccccaagtttgacaataccaagatttgtactggaacattccctcccatccccaccccctagaagcccctcttcctcccttagatttgacacatagtttgaaaccactattaactaccttatgagagccactgtttgtgaagtgctgactatgtgccaggtcccgtgccgtgcaatttttgtgaattatctcgtgtctacagtgcctcacaatttctctgctcaatacctccatgttactgccgaggaaagggaagctcagagagagtaagtaatttgctcgagttaaagagctggccaggacagccaggggcttgcaccccggagccttcatccactacactgtcagctggtatctcaaccagccattacaggctgtaaaaaaattatataagatagtctatggtaatgcagaaaagtgaggttattttgctccctttccctttgaagaaaaaagccctggaaagacatatcacttgagtatgggaaaaaatgaagctgtggcttttctgtgagtcaattctttcctggcagcttcttggaataagaccaagtatagcagcagagttttctgttttaatttgagctgcagggtgactttttttcttctatgctttcatctctctgtggcttcttttgcctcgttaatttcatgccctgcccaggcgggctactgtgctgcccagtcacccgggtctggggcggccaccgctggccagcaggcaggccctccagaggcagaggtggccacgcttaggtcgctcccgctgtggaggcggcacacttgggtggcagcacagctgtgatgtggcggcagctggcagccccatgggaaagatgtgtgaagtgtggggtttgacgacccatgggagaacagactttcttcctcttcttgttttcccttcaaagccgtgagtcaacctcaaattctctgtcttttttctccaccccctcgtgcctctctccctcacgctctgcatctctcattgcaagcttgcatttttttgcacacaacactatcttaatatttctcttttctgcaggcaggaaatgagaagtcatttttcagggtcattcaggaagtcatccagagttataatggcccattatctactggtcagagtttacttaggctttcactacttccactgcccacttgaaacagggaaaaatattttccccccgcgctgtgagtgtgctatttagagctgaccacaagcggggggaagagaggatggctcggatgctgcatttccactgagaacacaaggctggcaaagcttgtctgctgcccagcaagcacttcaggctcacaccattttaggttcactttaagtagtttctcaattgttaaaaaaaaaacaaaaaaaaaaaaacctgtactctgaggatatgcttataatcccatagctaacccagaatttcttagagaactgatcaacatcagcagtggcacttactgaaaatgcacattctcaggccctgcgtagggcctactgagttagaatattagagagcaggtctcagaaacattctatccggcagtcttattctatgcacccgaagggataagagccatgctttcatgaaacatgggttgtgtgtaaaatgtttaaaaggtatggcaaaatgtgtttgattggcaccaaggatttctggttcctcctagaatcattaatcaaactttgaaggagaaataagagagtcggcattttcttgcacattctttgtgatgttgtgatgagttggaaacttcccgattgggtttattagagcatgaacacccaggcacccagcttctagccagccctgtcaggcagagtctcctcgaagatgtggaaaggactgaccaacagctgaggcctacaggaacctgagcaggcaaggggagaggcaccccggaaccaggagcaatggccttcccaccctccctcgtcctctcctcttctccttttggagttgcaggccacagaaaggaagtgacatgagtcactttgggccttcttaattccttcatcaaaggcagcacaggtgtgtatgtgtgttggtggctaattgaggtaggcccacagaggagataacagatggacatactatttcctttcttccattctgatataattcagggtataaacacacacacacacacacacacacattctcacttctttggcatctaccacacctgccccagtgcccatttctctcccacctgaataaaaagcccccacaaagcctgaggtacatggaaaggagcagtggtctggctcccaggagtgtgagaagcagccatgttttcagaggctgtattccacttggacttggccctacgctgaaggtaggagcggatgggggaggcccccttcgcacaaagagccccatgaaagagtgcacagtccagtctataaaacagacgcagaaaatgtgtgtaggacttcttcctgaaaaagagcgtggtgcgtccagtacctccatgttcatggaacttcccagtctgcagtttacccttttgtgcaactcccttttggtaaagccctggtcacacttctggttgttcagattatacagggataattccagagtgattttaaagtcaactgccaggcatccgcacttgcaaattagatgcctggcacatgcttgtgttaaggtaataattcattacaatacaaattacaggggagttcctctgggcatgcgacctttcccgtcatttggctttccctgtgattatcaggggagcttccatcgtgctgctaatgggaccttaaccatgtgtcaacccatggctgtaatgctgacactgttttctttctggaatgaaaggccttcgcaattgaaaccaaaatgttatccaactcagtcctgtccctttgacgatgaaaacatcaagttctggagactggccatccagcctccctgcctcatctcccacgccctccatcattttttgtctctacttacttatttatttggctgtattttacgtacatcatgcaaaaatattcctctttgtaaaaagtataatgatttcaggaaattagagggtaaaaagcaagaaccatgctttcactccactgtcaagagttgtggaagaatccttccagcattttttctgtgtattttacatacatacaaatatatgtacaaataaaggtcgatcatttaggttttgtttatatttttgtatatatgagcttatgtcattcatacatattgttttgcctcttgcttttttttaacttaattttactttgcttgagagctttttgaactgaagtacgtgtaagtcagcctatgcatgtaatggctccctcatcttctgtgaggctgtcactaaaaaggggatttagcttgttctgggctttgcagcccgtacactgggcactgttcatacgtacttctctgtgcacgcaaaggagggcttgctagggaggcctggcagagggtgccattcaaataggattttcaatggaggaatttttaaattttcagttatttgaataagttttaatatatatccagaaccccaaatcatcaagtttgttttcttccacatctgtccttccatttctgaactattttaaggccagtcatgtctcatccaagaaatcccatcctttcacacaacactatctccgtttcatggttatgaatctctaaaagcatgatttttaaaacataatcacaatgctgtcatcgaacttaaaaattagccataaatctcttatgttacccaacaaccagcctactgacacatctccagttgtctcaaaaatgtgttttccattgtggtttgtctgaaacatgatccaaaagtcagacccacctctcacctttccctaacctgccggagcccatgtttctttccagccaggcttggagaccaccacacgggatttgcttcttggggcctccctctaaccagctatgcaggatgccctctttcctgtcaatacaagctgctcaaaggactcattcagttcaaattcacctatgtgagcctaggtgatgctacttatttatttatttatttatttatttatttatttatttatttattttgagatggagtctcactctgttgcccaggctggagttcagtggcataatctgggctcactgcaagctctgcctcccgggttcaagtgattctcctgcctcagcctcctcagtagctgagattacaggcacgtgccaccacgcccagctaatttttatagttttagtagagacagggtttcaccatgttggtcaggttggtctcaaactcctgacctcgtgatccacccacctcggcttcccaaagtgcttcatgttttcaggagctgtacgtgcatttttagttttgatgaccaggtcctttttctgttttttaaagaacttcaaatgatctccagggtacacagcgcttgtgtgctgatgaaaaagctggcagtacaaaggccaccagccaaggtcacacagccaaaaagcccctgacctcgggccccttcccagaccctgggtcttttgctgccacatgaatcttcttcaaggtcctatgtgtagattttcttgacttggccatattatttaggattcagatataataacaaaatagatgttaaagcataacatgaaggcatttaaaagggtagaaagcacatgatttactaaaaccataaatcttatgacctgaaagtttcacctaatctcttaaaaaataccgtactaaaccctgattgaaaatcagagctcagacatacagcctgagatgccaaaaaatggccaggcttgtctgttgagaaagccatatgtaactaactgtttggaaattcaaaatatatcttatcattttaaaaacatctttcttctaaagacaatcatcttggcttcaggaatgaggctagtaaaaagtgaaatactcctacttgtggaagaaatcctcattttaaccatgaagaactgaaaaatgcattctgatgttgatggacccaacctatatttgggtattttatgatgtacacaatatacttttgtatatgagattgttattaaatgtgactttgctttttcaagacatacaatgttcctccgggggtcaggcactgtgtttagcactttgtcctgacctcatctgacttctcagctgtccctgagaggtaccagtgtgcaagatcgctgagttggcaagtgatagtgacaatattttcaccccaatttctaatttaaagaccccgatttctagttttgttttgtattggatttgcacaatttcacgttctgaaagaggatgccctcaactttgcaaaatgggccttttgaatgaaaaggatcagtcatgtcaggaaaagcgctacaatgatgaaatatgataaataagtcagtctttcatctgtaattatctactatggggtaaaaagtgatgaaaactaccatcttgaaaggttctggtgatagtggttcctaatgcagtgaaagatgtgtaagtcaaagatttgtaaccagccagggaatgagaggcgaagccatagctggtggcgggggccacatctgggtgtggggaggccacagttgggttgggggtggggcctgcagttatccacacccctcccacctcccttcgacagtacaggcttcctggttaccttccagagagtaaggccagggagagttgaataagttgagaaatgtcatgtcgaagctattggtggaaagagttccattaattgacaatacaagtccctactacattctaaaatctggtcctgactagtggcaagccgggcccaggagtagcacttaaacaatggcaggcttgtgttgctggcaggatacttcagcctcagaggagctgtgtgcagctggggagactcacactcagaggatttcaaagcagagggcatctcgtagagcaacttatccaaaccctgacccactgtaaacacacacacacacacacacacacacacacacacacacacacaccctgagagagagaaagagagagagataactaaagagagagaactaaagtttggcaaaataatacatgctctaatgaaggtttattaatgattaatctactcctagcatttcctagtccactctatctccttaaaaaaaaattctggttgcagcccactaacttgattgtacagctgcttaatggatagcaggctgtaattttcagagaactgtttaatgcgggctacctctgttcttccatgctgcttgtggttcctgctctgctcaggacagaatggggaggaaaacaggctctgcggcacaatattggcaagtgaaattttgtaaaccggccctcccttccttttgcatttggtctgaaaattcaattagatgctgagtcctacaatgtatttgagaagcccaggagtgccctagaggatgagactgggtggctccctgtcaggttgaacatttgccttaattactttggcaagatttgcatcagtggtattagtccctgcctcacttggaggcctgcacttaagtggccacattcaggctccaatttcctggtgatttcatagtgtagggcacttgcaatcaaaactaggcttaaagcccaaccctcttacattttacccacccccacaaatgcagcaaataaaatgactctgattttcattccctagacctcttttctatatttattacattattgttaagacagtttttgaagaaagctgttttatttaacaaaatagctttatggaatcaacttcatatatcttctccgccagatcaaaacaagctcgtagtattagatgtcaccgagcaccatgacaggcagatgaacatcatccctgtgcccggctaatgatagctcggcctgccccggcgtcagccgctcctggcagggccagcgggcggtgtgggaccggcaccgtatctccagcaattcgcagataacaaatatggttctgatgatgttactaaagatctgtccctttcaagattggattagacattaggaatttggagggctttttattgctagcatttttaagaataaccaattagagtattgattctaaagtctgaaagccacatggacagagttcatgtaattggctactttatgtgcctcttcctagattgccctgcattttcaaaacaagagcctttctattttaatcaaaagaatccagaatgaaatgaggctttgaaaactcagcctatgtttgtcttgatttccttaactgacatctagaagaaaatatgagctcaggggtccgctgggttccttccagcgcctaagcctgtaagctcttcctgctggaaccaagctttaaatgcacttgtcagtcatgtcccatgagaatagatactgccttccatgtttttttgttctgatttccgtgtttgaaatgatgaaaatcatttttctgtgctttttaaaaatggaattgcttttgtgttgggaattgtgctgttcatttttactctacctcgttttggaatcactaatgtggccaatttatagccaaaaatcagtatcgtagagtgagcaatgaatggcatggtgactgtgtgagcgaattcatgccctccctccccaccgctcgccccgcgtctcagtcctcagtgatggtaaacagaatgaggaccttctcccgaccgtgatgcgcctcagccctacttcccttgtcctttcctatcataaaatcttctttcatagaaatggtcatttctgttcatatctgtggactgtaaataacaaggaagtcatttttgaggtgaaaactgcacttagactcattccaattttgatggaaacttttagctggtggatggcattttgttttgtcttagttttgcaaggagttatcttaatttagggagatgaaactagtctgtgatccgaggtctcacttccatacatttctctcgggcagtgtggctgcctgaatcatgcctggatgccacaggtgcttagccagctggtcctgtcgtaactgtcactggtagctcagggagtgcagaggtgccagcagacactatgaaattggcctcgtaaagcatcagttatgttgtgatggtggcaaagctgcaggcgagatgggaagtgcagccactgagaactcacagtagagcgtgtgtaacgtaaaaagatgaaacccattgtacacagctgtgtactgcctccttgaagtcaaatttcccccattaccaaggaaaagttttttctgaagggggctgcttgacaggatgacatctggtgatatcatttattcctttggaaatcaatctgtggaagtgagtttccactgactgatgaggagaaaaatgaattggcttcacccagcatccagcttcttatcctgggagagatagctcttggtctgtcatccacgcagctgcctggtgcaagagccaagtttgtgcagcctgcagagcactcttcctgagctgtgggctgccaggtcggggggcagggggggcctcactgtgcagcctcctgccacccactgatcatctggggagactggcctatcctgtcaggagacgcagttgcccagacgttttcaagggcctaagatgtaggcagttgatccacagatttttggagagtccttgagttggagattacaggtgacctcagaggagggagtgagaacatctgggtcatgggtttctactaggagtccacagtgaaaacaagaagaggaatttacgacaagacagtccagcaacttcctttctaacttctcctttcacatatgctggatactccaagactttgcatttacatggacatcacagatccactttgagagaagtagggtaaaaagaaataaatacatagtgctttaggtgtatttctatacatcttaattgatatgggattacattttcacttgtgtttactgtacagactctagacagatcctgctcttttgcaggtaaaacaaatatttcttaaaacctagaaagacccaaaacaatttaacagaaacattttggaccattttggaccttggcagttaggccccagtgcagcagcggcaaccataaacctctccataggtgctgaacccaggtgatccctggcaccggcagccttatgtcagggctctcttatcgctggtttttatttctcctaataaaagtgattaaaagattcatcttttaaagaaagcaaggacacagaggtggattctccctgacgctagcacagctcatgcccaagccactcctgcagggctctggtctaagtgcaaaagctggaaaagctgcaggtcccgcaagacacagagcaaccctgcaagccaggtcaccttccctcttctctgctgtccgactggccctccaccatgtgacattcaaaagctcaagttacttaacctctcaaaactcagcatccttttctgtacagtggggaagatactggactgttgtgaggattaagtgaggagagtggcccaatgaggttgacagttattactgtcattgtcattatttgccttctcacaggcaggcgtgccacagtcattttactgaagctgcttcagtgggtcctgaattaggccctgtcctttgggagagacagtcctggttcaacacacagctccctgcccagggcagcttgggagtgtgggccagtttcgcctttagaaccacaattctctgatatgtgcaatgagagaattaattatagactcaaaggattgcatgcagacacacacagatacaaacacatacacacaacacacagagttacacacagacatgctcacaatacacagaaatacacacagacacacgcacacagcacacagagatacacacagacacacacacacacacacacagacatacgcacagatgggcacacacagagacacactcacagagacacacagatacacacaggcacacacacagagagacatacacacagcccacagggatacacacagacacacagagacatacctacaacacacagagatacacacagtcacacacagagagacatacatacaatacacagagatacacacagagacacagatacagacacagacagacatacacacagacacgggcacacacagagacacacagacacacacaggcacacacgtgcagataaggtaatattagctagttcaggaggagaaagagataaagataaagtaatattagctagttcaggaggagtgaaagaagccttgtttttctccactttttatagaagagaaagtgaagattcgatttgaggtgagttcagcacaaaagcgtatcccaggccctctggctccaactgcagccctttctacctcattcccagaccccacctaagccttttctcttcaaaatcttctcaggcacactgatacacatacctcagatttttaattctccggttgtgttcaccaggtgcttggtcatgattaagaat

SEQ ID NO: 21 - DNA, 150409 bp, Artificial Sequence
  Synthetic BAC sequence
ggaaaacatcacttgaagctggaaaaccacttttaacacagcgggaaaagctatttgttcagacaggagtggggtgggtctgggcagagcactgctctaacttggccatgccgtggcagcagctcctttaatgccactttttcctggcgcgcccgcggggcctggagctcagaaagaggggaacgctccctcgtctctcaacagttgctccagacaggtcagcaaacatggaattcagaatgttcattaaacactggctgtgtcttttgtgttcaaaagcaagacactctctctgaaccatggccccacagagagtgcagaatgtgtgaaacctgccgggaaggtctggaccccttgcggggcagtgggcagcaccgtgcctccgttcacaccactcacatggctgtgcctctgcttccttctggcatggctgcttcttcctcaggtctcaaccatctccctcagatgctctttcccatgtttgtggctacaggtccccgtgacctgcagaggcagagcactcaccagcagcccagcctcgttgcgcacccatgtttgcatttgcaggccctagaaccactccaagctccgtgtggcgagatgcaccctcctgcccttcactggggagctgccctcctgttcacagcggcacctgagtcacacatctggagccatcctggactgcctcatttccccgatggggggtttccctgacttcatccatcctgtcttttgggtccccataataactgacatgggtcggcccgtaccagcccctgtgagaagggctttaactgccttcccaccccctgctcatcttagagtctctctatagtgctgctgaaagaatctctaaatcagtggttctcaacctcagccgcacattgagaatcacctgggacccttaaaaaaatcttaactcttggtccaagaattctattacaatcggtctgggatggggccctacaggtatttttttaaagctctccagttggtaatgcatagctagagttgagtatcgctgttctaacgtgcagatctggtcatgttaccagccttttaggtggtcttctttggctttctctatctaaagttcaaaaccgaacatgtgcgcattcagtgcacccattttcaactgtgcattaacacattcagcccaccagcaagatttatgaaccattttctgctgttgtatataacatatcatatgcataatggcataggttattgttttcttcaaaatatatgagatgtgagtccttctacgaactgactcacactgattgcccaacttcctctctcgaggtctcatcctctttccctgcagccgtctccctcttgcacgcacacacacacacacacaccacacacacacacacaccacacacaccagggtcgatgccatctaccctggacttcatcttgaactccttcgagtgtgagtcattactcctttgtgcacctctgctttctcttctcaagatgttcacctgcttgaggtcagttccttgagcgtcttccacttgccatgttcaccacagtgctcaacatgcctgaatgcatggatggcgacttctcagatcctcagtctcctcatctgggtaataaggcattgggttggcgggtccatctggtttcttccagctctgagagtgcatttgctctgtgattcattcgttccacaacacttcaccaattaaagagagggtacaaaaggtgaacatccttggctcccagcagatgctcctcaaaacctgaaaaatcagataggtgagggaagattgaatgaaaggcctcttatgattctgcagcaattttggtggtttaagaactctatggaaaaatcatcagtatttctggaattgaagtaaaatggatagtgagcctctgtgtatgtgaaggcccgcatctggaacatgaaagaacctgtctgatgtgttctagtcaggaaagcaggtagccaatactatttatagaatttacagaaactgaagattttgtttctactgattttcaaaatagtattatgtctgatttttttcctcagaaatatacttcctgctcttctcaacaaactcatttgaaaatatgattagaacatgatagaattttactcatttgccaactgcggttcccatttcacatattgttagaattctgcatggtggctttgccctttaaccactaactgataaatgatgtagttagcttttaaatgtgtggaaaaatataatttcaggttcaaccataggtcagaagtacacgtgttttgttagtctatttgtctctcagtcatctcatggaaaattctcagcttttggtatggaaataattttcttgaaggcaatatttgttgagtgactgacggaatgaaaaacgccagttgcgtaagtgtgaaaaagatctgggtgttttcattggatccaaattccacatgagccaacaacagcgtggtgtggaggctggagcacattaataagaacagtgtcctaaattcaggaggtaatgctctgcccatgccctgtgcagctcagacggtgtgtgcagtgcagtatgtaacccagggcacatttcaggggcccacagggagctgcagcttgtaaggtggagtgcagccaacagagcagagagtcagaatccccgcagagtggttgaaggcacaaggatgcgcagcaaggaagacagacttataggtggtgcgactgccatcctctggtactgaaggtgctatcatggagggagggaagtagattgaccctcctggctccagagtacggaactcagacaaacggtcagaagcttacagggaggccaattttggatcaactttaagaagaattttttaaaagctagagcaatcctaaaatggaatttgctctttataaagttgcgaatgcctcaccctggaattgcttaagcaaagttgggacgggcagttgtgagtaatctcctttccaatccatacccgcaatcaccagaaacgtggacttccctgacactgagcacctcttaattaagcatctcataagtgaacaaaacccagcccttcaaagaagtcactttatttatgtgtgggtctgcagcttggatttcttgataatgttaaataaaactccatctactcttccacaaacacttcaagaaacctaagacttttggccagagtaacaccgaggtttgagagaaaggatatgtgtgtgagaggtgtggtttcattagaacatattatttgacttcatgttgaatcaacacttttgtgcaaaatgcagttttaccagcctctttccttgttttggtcacataatttaacttaacattctcggtacttgattttctaacataaaatgggattgagaggggaattttgaagttcccatggtctgtcctctacattctgacagctcattatctctgcggtattgttctcacatttaagtgaggttagcggaggcagaggcctctcaggcctgaagatagcctctgttttcagggaaatactagactgtgagatctgtgacactgaagcactaagttcatctcacaaaagcaacgtgctctttttaaatggttgatcaaagttactttcaaaaggaagtgttagtttttgttattagccgaaacaagagctgctttaatgtagtatatttaaaatcatatctcaattaagatgttattcaaatactatttgacccaccaatctcattactggatatatacccaaaggaatagaaatcattctattataaaaacacatggctgggcacagtggctcacgcctgtaatcccagcattttgggaggccgaggcgggtggatcacgaggtcaggagttcaagaccagcctggccaagatggtgaaacctcatctctactaaaaatacaaaaattagccaggcgcggtggcaggcacctgtaatcccagctactcggaaggctgaggcaggaaaattgcttgaacgcgggaggcggagtttgcagtgaacagagatgaagccactgcactttagcctaggtgacagagcgagactctgtctcaaaaaaaaaaaaagaaccacttgcatatacactattcacaatagcaaagacgtggaatcaacctaaatgcccatcggtgatagactgcataaagaaaatgtggtacatatataccacgaaatactatgcagccataaaaaagaacaagatcatgtcctttgcggggacatggatggaactgcaggtcattatccttagcaaacgaataagaaaagaaaacaaaataccgcatgttatcacttataagtgggaggtaaatgatgagaacacaaggatacactggggcctacttgagggtagagggttgaagggagagaagcagaaaaaataactattggggtactaggcttagtaccagggtgacaaaataatctgtacaacaaactactatgacacaagtttacctgtttaacatacctgcacatgtacccctgaacttaaaaaaatttttaaaaagatgctatgcaataaaattctcaattaagaatttaacttggtaaatgttcatttaatgatctaaaaatatgtgtctggatggctctagcaaaaaaataaataataagtttctcagagatggtaaggctgaaataaatggggaaaaatctgaattgtaatcctttttctgttggacctggtgttggggtttcacacttgtgggtgaatgtgggcctcctgtgagcaccagcacaaaagactaaactgaacaaaagattaaatgtcacctctaaaattctgtgcaacaagacttccagccacagaatgtgcaactcagatttccaagtaaaaacacaccaggaagcagatcttagatctctgttatctccttggcaccagctggtattcatcctcaatgctagctagagttgaaataaagagtgaaagaactttctcttttattacttaataaacttccttttttgagctgttttaggcttacagaaaaattgagtggcagtttcagggagttccagcacggcccctgtttctttctcatggtccctgcaggtttcccctattattaacgtctgtcattagcatggcacatttgttacaattaatgagccaatattgatacattattcactaaagcccacaggttgcgttaggggtcattcttggtggtgtacgttcttcaggtctggacaaatctataatgacatgcattcaccattactatatcacgcagagtcgtctcctggccctacaagtcccctccttccccacctgctcactcctccttcccaccctccccaaactgtggcaaccatttaacttttgactgaatggatttattcttattctgccttattgtatgtacaccatattttaataagataaaataatagtctatagtagacttctgtaaatactcaatgaataaatacttgcatgaatgcaggaaaaatcaatcagtcttgcaggatttcttatgcgttacatcgtccttataagaaagcagtcattctcaccgagatgtgctgagcagatactggacatgttctgacccagataagggctgggtggaagtagggctggagacacagagacccagtgccaacttccaggacctcggaagaactgaaggcagagaggtcctctcagtgtggactgggcctctgctggcagccaccagcgggcacagagctgatgtgtgttatgccacgtggggaaaacctacagacgattctgagaaaggctcacagggacaccctctgcccctaaaagaacaatttaactctaatttatttctgtcactctgcattttctgacctttcccaagtgtacagttttatatgcatttaactgccaaattgtcatgtgagattatatggttatatttcattaatatattctagtttgttcagctgttcttactgggtgaatttgtgtggtttcctgacatttttgtttttagtagtgcctcagtagttttatacataattacgtttcccttctggattatttccttagtatctagttcaagaagtgaaatcgctggattcttgtggtaaatttttgaatttcacagtataatgctgattttctcaaagtctcacattctaagaaagtataatgaggcaaaacaaacaacaaacatcttaagttgattttttcctagcatcttttccttccatctttgcttgtagaatctagactatttcatgaacccaagatataatcagtatccttcttcagtatggccaaagtgagtttctcattattttacctccccttcaggaaatgacttttcatcttgtgttttgggagccatagatggttctgggcaggaaactggctttggatagacccagcatgtagatggctatttggccttgctcccagtataacgatgcagttccctgtgaaagggtatgagtaggttttggggctctggataccgtgtggcctgaagagacaagggctcaatgccaactctgcctgtttccaactgtgtaaccatgtgagcgtcaaaaatcatggacgtgctctggttaacactgagtgggagctcaacaaattattatttttaattgttacttggacatggccaagttgactacactttatgttctgctacctgccagtctgaaagtgacgccacagaaggtgaaccgcatgttgggagatgctcctcatctgcttaaatgaggtgcaaacacagcccatgcgcctgctcttcatgactgtatctgtaccagcaatatttgtattggcaaatcacatgccccagtgggaactacttaaggggaattcaatggatttcattccttttatgtaattggccacttagtaatagacgtgtaggtctcttgtgtggataaggattctgccttttatgtaagatatgtgttgcaattcagctttcaggtcccagccccgggaaggctccaggccttcacaaactggcccacccacgagaaggaaagcaattgtccaaatgtgggtagcttttcttcccactgttgtcagctgcttccaattagcccccatatacataatcccagtttgtgtctgtatcagtacaattctcccatgtcaatgtgaattttaagccacagagggaaaggggacagagaatatgctttcattcagctctcctcgtctcacacctcttgccctgcatgcatttctttgctctgattaaacgagcattttataagccacatttgctgtgtgaaaggcaaagtcttccctcccacggatgacggtctccagggatgtgtgtgtgtgtgtgtgtgtgtgtgtgtgtgtgtgtgagagagagagagagagagagagactgtaaacatatatctctgtgaaacttcattttccatatgtgaatttttggaaccgagacaaatggaacttagctaaaagatgggaaaggtagactgactctgacttaatctacttaacctaccaggcaatttataacttgatggcctaatttttgcagcacccagaagcaagcctgtttcagcacggcaaaggctcagctgctaagtgggcagcattgttggaggtgagcagcttaggctgactgttcatcaaaggaccaagcgcttgaggttcgctcatcgctggaggccagagtggggagggccatttaactgctcaaggccatggaactctactgtcagtttcagggaaatttgggaccctggagcacaaaccaaaactccaattaaccaggagaggaactcgatccccaggagataagtgaagagtaagaagtctatctttagaaacaagagatgtccaaggctagaaagatggggaaggagggtggaactgttctggaagtgggtctcaatctcagcaccagcagctctcaagactttctagagaaggaaacttcatttctgaattaaaattagtcttcaatgacatggcagggatttcggcacactctcttgcgtcataggccactgtgttggaggcaggagtgttggctttggaggcatagagattaaaattagagtaacacgtgagcactgaaaaggttaaacagtagagacatggaggactcccgacccccatgtacccctttcttaaccctttaattaagatcacagccctagaaatagcttgcaaaataattaactactgatcatttataccttagtgcttctgtgagcatgttttctctttcattgctgctcatctgcatggaaaaatgtgcatgggtttctgaatataactccatggtgcttgcttccattatatttgtgccatttggatcataactgataagcaaccaaagagtcccatattactgcacgttcccatcgctattttatgtgaaggtggtcctgggggctgttctgaattctcagtttccttttttcccctccccagttctttgaaaatatcagaaacggacttgtggcatctttgaaaagctacttaaaatgtgctgctgtgctctgaacttgaaaatgtgcttttaatacaaagtttgtgcagcccttgctgctcatacgagatgaatcttaccatgtggtggatgcccgtctcatgccaggcactgtgctctaagcccattggtttatttcagtgcttgaaattggctttcgagagaggcaccacggttccctttttacaggagaggaaacaccagaggatcagagatggagagtctttctccacaaactcacagaccccaaaggcaagctcagggttgtcagcttccaaagtctgcctgctccaggacctcatgttgcatctccattctcttcactgagggtcaaatggaaagaacacatgggggtcaagtttcagaaaataagagaaatgaagaaatatgtgcccggaagcaagaacgaccgacctcattaaactggctcccttcacctcctctcacatctttttctgccttttggccaagttttctctcccccgcatttcctccttgatctcgtttgaatcctcttccctggtgaagtcatttaggttcaggctcttattttactttggtccataatttagatcgaaccacatgtgctgatgtgattgaaacgatgtggaattctctggacagagatagaattatggaggggttagtgtgtgtgtttaagattaaaagaccaggtgtatgggaggaaatataatgaacaaaaaatagtattttaaatgaatactaaacttgcactcatggaaaaagttctcttcccatgaggttctcgcaaagcattttaccatcagcacacgcagtttttctcagttttctgagatggggccatcttgaatccaacagacaacacacagcatcagccagactaacacaaaggacgtcatgggcatggacgtaaatactggtgtcaacactaggtctgcacctcgagaggagtggagcaaaaggatggagtggcagatgaaggtatgctgttcagaaaggaggcagaaatgaaaggaagaccatcagtgcgctccacagcttgaggaccgtcctggagggcaaatgccagctgctcacttctgaaaagaaaaattccagtgaaatgagtacagtcattcttaggattactcacttgatactgtgtatgtctcttcttggcttctcatctccacacaaaaccctcaggtggtaaaaatctaattaaaaaaattatataaagtcttgtagatttattagcctgaacataatagattttttttaagcacgttaagtcttccatggactaaaagaaaacttgtaaacctaagagaacctctatttttgatatacaaaataatacatttccttaaactatgatcttgatactagaattttaattaaaaaatacctgcagtttatatgcaaagttatagattaatgcttaaaaataggttgtatgtagtatccacaggtcatgtttgactgtcaaatagatgtaattttaattcataataattgtgtcgtgttcttccccactagaagccaattatgcaagcttcaccattcacacatggaaaataatttaatggagtactcattgcaatttcacttatccagaattggctgttgttctcagagcagcttgtgttgccttgttaaggagaatatgttagtatccagacatccagaaaggatcctttactgtttcagagtccattttccccacttttgaaatacacacacaaacacccattcatgcaaaccaaacagagattgtaaagtgattccactgacatttatgcacttcttttttctctttggttcttcaaactctcagtcagtgcgcatttactcttaatttagatacggtttaaacctaattagaaaccagaagctcttgtatttccacaaaggattatgacagccccaagaaaagatagtgaaaccattatataacaagataaaggcttcttaacaatacaaggatggattttctcattgatcttagccttctgaattttagaaattgccatttcaaagtctaaaacaaaggaaaatcagggaataaaagaatggtaagtagacacaaacctactggctccatcatttctgttttagcaaataacctgccacatataccaatagcccaagagatgggcatgtccctgcatttcctggtcaaggtgacaacactgcgtcctcctggaagaggtctgccactcaccataccacaaaccaaatataataaaatcagaaggcacactatagtgaattttttagaggcatgtattgaaaagcatctcaaaaagcattctcgaagcttccagaagtcaactcaagttatctgaaaagtgacacttttgatgattgctcgcttaatactgggagagccagatgaagattcctccccacttcctcagatgtgcaactctggaatttcttagtgttactggagattcctgctgcattctgggcctttaatgcataaacactgagatgttctaaggaaattactccctagggaggagaggggtggacgaggagtaagctttgctggtgactcatgcgctgtgtggaaactccctgcacaagtgagctgcgcagggtgagtctaaagggttaatgcactttcaaaagcctctaatttgttattccagaagagtaatttactcactagaagtatctgggtggctactaacacatttgtgtctttaaaaagatcagttttattttaagattaaaaatataaagcaagagctggaaagtcactaaaaactgacagccagtttcccattttcaagagtatttattaaaaggttctggttgcagaaggaataagaaatggcttgagatcatgacacagtgaatcatgttgtaaacatgttagctatggctgtgaattcaaccagcgatgagttcaagcgtccccagaaggtgttgggggaattagggacatggctgtgtttccccagagaaaagtggccattttactttccctcttcactaacatgcttttgacatgcatggcagagctgaaggcaaggggaaggggacaacatagtaagtgactaagtggcttttttttttttttttttgccaagtgaagctgagtcatatggcctctgtcattccaaaactattctctacggctgcattcctttcgctcttgccttcctttagaaccctggagaaggcctcctgaagcctggccctattatgtatcctgacaaagataaacttttccaaaaagctgcatgttgtttctagcacagtttttcctcgcagtgactacgtgatgaaagtaccatgcagaggaggtgtctgactgaggcgttcgtggtgtgtgacagagtcccctgcacaggacagccgcactcccctcttgcgtcctttcctcccatgtttgcaaagcctctttccctgtcagcagggggtgttctggcagttgacatttctgaaaactacagcctacatttttaaaaaatccagtaagtgaaaactaaaaaattaataccgtggtcataatagtgtggcatttgataactaatgaggcactgtcgtgccagctattattttcagacatttacagtccttttttaaatacaaagaaatatttggtgtgaaatgttccccgggagctggtgcaagcagaggcgacagggcaagggagcttgggttgtagcctcgaattcctccggccagggctaccgtcagcctgcggcacacaagtaaatcaaatataaaaccaaaatttctgtaagcaaatcagtttctaactcactgtaacgaattatctttcgcacatcacagaggcatctcttttcactgtcgagtttggtttgcttggttacaaaaagggcagttcaaaagctttggttgctattgtgaaagtcagctgaattccttccaccgtgctggggtggggtggggttcacgcaggttctcttttgtcaccaggggtgctgtggattcacaagtaagcaagaggctcctcaggtcaagcctctggctgctccctgaggtcagctgcctagcttctcctcctctgagatagacgggaacaaagtctttgatgtgtgcatttctcaagcttgacaatgatacagctacataaaaacccatgatttcatatagatattccaaaacgtaaaagtaaaccatgcatccacagagacatggaattacagaactggatgctgagctggtcacttgggaggcaggcgtccttgccattggtttatgcctcagccccaccatgcagtggctggccaggtgacctaggccagtcctgcatcctcggctcctcacctgcctggtgggacagtgacatctctcctgcagcactgctgtcagggtgagggaggtagggcgcagtttcagaaaaccattgggctgcacctgcgtgagcacagctgcaggagcaaaagtcagaaaggtcagcaaaggatttcaggagcaaaggtcagaagaaaccctcaaggtggttgtgtctgcaggaaagtgctgtcgtctcctgcaatgctttcaagactattcagaagcacagtgtgaagggagagccggagcccatggggaaatgactccagagtgttccacgtgttggaaggcatctgttggaaaacggacattcaagcaaatagttgcctgcatagacaacgcagaatgactgggaaagccccaacaagttacctactggtaaatgaggtgagaagcttaaagtgagaaccccattgctgcctctttttcactttaaaaacatttaagttttgaattatggtaaaatacacgtaagatttactactgtaaccatttttaagtgtacggttcagtagtgttaagtatattcacattgctaaggaaccaatctgctacttttgtttattaattttttcctgaggggaaatatttttaaattttaaaatatttaattgacaaataaaaattgtgtatattcaaggtgtagaacatgatttcatatgcacgtacattgtatactcattaccacaatcaaagaaattaacacatccaacccacccatagttgccattgtgtgtgcgcggatgtgcgtgtatgtgtgtgtatgtgtgcacgtgtgcgcctgtgtgtgtctgtgtgtctctgtgtatacgtgtgtgtacatgtgtgtacgtgtgtgttcctgtgtatgtgtgtctgcgcacgtgtgtatgcatgtatatgggtatgtgtgtacgtgtgtacgtgtgtgtgcatgtgtgtatatgtgtgtctgtgggcacaggtgtgcctgtgtgtatgtgtatatgtgtatgtgtgtacatgtatgtacgcgtgtgcatacgtgtgtgtgtgtgcacaggtgtgtatgtgtgtgcctgtgtgtgtgtgtgcatgtgtggtggggacactaaaaatctctcatcacctttttagtcaaaagaacagttgttttggtttggctcttctgttttaaaatatcagaacaataataatttcccacagacaaaatcctcaatcctcaccatccttctatttcctatattcatcataaacttcatgcttgatgttgaaattgttttctgaaaatagagaatacaaagaggagattttaaaatgtcagtggcagccccacactcctttttaatcttatttcctgatatcttgagtttacttggacgtagagttttccttgactatggttatttctggtagtagcagctccagattaggcaatggttttcttcagagatagcttagagtgagccccagaacaaggtcaatgcgaagattgcttgtgtctgcgtgtccagggcacagtgatcctcatcactagccggggggctccgtgaggatctgctcctggtcgtttctgttctgtatcttctctgcagcccttactgaagccgttaccaactggcacaattcaattcctactgtacccatcatgcacagatggctgaagtattgagaacgctccagtgaccgggaggcaatagtctgtccacatctaagaacacacttggaataaccttagagaagagagagagagagagaatgcatggttagtaggttatcaaactcctatgacttttcacaggaaaagccctcatccacaccaactttaggaatgtgtagaaagaagggtcagggacaggggtgagtggtgggcagagcagttggagggcacagggaaaaggcatctggtcatgtatttggagtaggaggtcttgctttactattgaattgcagggacactttgggaacagtgttcacttctttttgcaaccatttcttcagagaaaagtcatgatactcaagtcttcttacaaagcagtttgaggctttgagtaccagactgattacagagatgagtatgaagcattattgtagtatttttaagtgaaattcactaaatgcaaataaacctagcaaatgctctatggttaatttttttctaaaattcagataattaagacaattcattctcctgaaactgctgttcatgtaaaaaggaattttatcgaggtggcccttgagtgccaaacagcctgtcctcagctgcaaaatgagtcgttgatgatcctccagcaagggatactttttagctcgtgtggtgattgctgcacacgggatatgtgcagcaagtatctgctgagctaataataaacagcctcagacagaaagacagtgggcacaaggtcatgcttaaaaagaccccttgttctactgcatcccagctccccaccatggggcctcacaggccctggtgaccaagcacatcagacctggttcttgctcagtcctgggagccacagaacccagcacgtactttacccccaagaccagactccagcttggcttttgtcctcctctccaggattggtgacctcctaggtcgtgaagctgtgatgagcaaagacacactcctctccattctcccaacttcaggtccctttgacagtgtcagcaggcatttaaatagcagaccacccacagcagggctggtagatgcagtgaactcaggaagatgcctgcatagactctagtgttaaagacagaatccttacaaggaacccccatagttacctaactgctgtctccagtggtcatagaagtgtgataacccactaatcatcattctctgtctctctgtctttctcatacacacttacacacacatacacacaaccttgttgcttaattttcagagagtctactttcagaaaagccttcaggaatacatcatgtacaaaactgagaaattacctgaagtatctttaaatttagtaaaaagttgcattgttttttgaacatcacacttgaaaagtacatgaatacaaacatacttaggaaaaaaagctttaattaatttaaaaaggagaacaatgctatatgctgtatcccacctttctctgaatgttacattttctcccctatcccaggctgcatctaagaaaactcagagggaatatgctatctatcttttccgagcaatgaaagctctgggttttttccttgcttttcagggcacaatacttctctttcttcctggttagacaggataagttctgagtcccctggtatcatcagcttacttcttctctgttaaatattcacaaaaaatcactaactttcatgcctcagcaaacctccactgcctaaaatatagtgaggtcattcatcttcggacaaattgccccaactacggtgggaaaagaaccaatgtgttggactatttatctaatttttgtttagttcggggatacaaataaatgcatagatacatacaaacatgcgtacataatagcagcagcagcctgtgaaacattgacaagacctggagttggaagaggactttgccatcctccagtccaacagttgcctgtcacagattagacgactgggatgtgcgcaggcgattatttgcaaacggccctgagtcccccagtttatgtcttaattcgcagccagggctgattgtagaagcaaatttgcaaacatgtgcaagaagaaatcacacatcctagagcttggatttcctcgtttcttgctatttctatccgtagacagaaccattgctgagctgttaaatttgtctccttcccctataccagtcttgaaaaaggaaaggaagtggagcaaagaaaaagaaattaataaagccggcagatcctaggagaatcttatttaatccaagctttgtaaagttttgctttattccatggcaacatgggtatacacatcccaccggctgtttcagtggctcagagcaggtaaggcctgtgccaaacgccgctagcaggaggaacaacgtggagacagccccagaggtggaacgttggcccttctgtggctccggtgtctcaggacctccctaaagcccagccctgacactgagcaagtttccaccactgttaggaagaagtagaaaggaatttggagggttggtgttactgttcaagagctggaaggcttctgcccccattcccattccattaattgcgtgaggtagagaactcatagaagataggaacacatatgctgatttccaaaattgcctttgtatattttcacgtgaagactttaggggcaaaagaaaagaagcaagcattttgaatatgtgtttcaatttgccttctgttatataaaattgtattttgcctattcttttttcattattcggaaccttcaagaaataaattaagttctctcaaaaatgtgttttttgaaaagaggactaaaacagatggcctggctgtgttaaacacagggaccagaccagcacccacctctccacctgccctgccttcactggcagaattgtgatccatcatgttctctgttcaatgtcatcatccctttcagagcatgggtctcttcctttctaggcagtcttaccaggatgcatgggtgtgcctgcgtaggcacacgcacagctcccaaggactctaaaaaaagatatttttctgcttatatactaataatatgttagagatttatgtttcaaattagtacagaatcacatggttctctccaaattatatttgagagagaaagaatagaacaaaatttattttacaaaaatactcagtacatttagggcatatacaaagatgttccagaatgtagcttatctctttaaagacaattaacacagtttctgggcaaggcaaggcaaaatattcagtaacttagcaacaccaacagaagacagccaatattgcagcacatttttctcttggattgggtcagagagtactgcagagaaaatggagtagagagacctgaaatactttcgcacacactgtggtcagtgcagcgtccactgtgtgccacagtaatactagaaactccctggttaggccttggaatccagctctcatttcgtatgtgacctgcagggaagtaagttaaatgcacacgttttatcaagttcaaatgcaaacttaattttaaatgtatgcaacatcagtttaagcgttgtagctattactagcaattgtacctattactagtctgtactctgcacaactttggagtatactgcctactcaaggtggattttagagctctatttgtggcattatatcacggacaaaagcacgttcatcagagtcagaggaatgtggtgcaaatcccagctgtcccacttaccagctgtgggacttgagtaagctcctgaagcagctgcacctgcattttctggtgggcaccatggagctgtcagcagtgctttcctcagagggctgcgggctggatgaggtttgctggtgcatgtgaagtgtcaatcattgctctcatgagtggtgatgctgatgccgttcccttttttagggaagtgattttcccttacaaagttaccaacagtttcatgttggcccatttttctattaattgtttccactaataggaccaacagtggtagtcccatcattttattactgcttgtcgtagcacaagcagttgcttcattgtgtttagataaatattgacggctgcttttaacagtctgctgttttgtctccttttgaggtccttaaagtaatccttaaaaagatagtgcagatggaaagatgtctggagtcagtgaacctgccttctttcctgtgtgcttgtcagtttctaaaatgccatacacaaaggactttcatgatttctttttaggtacatgattacagttcaattcacttcactgtctggaaaatttccttataatcaggatgaaatttctcatgttagcctttcacatttcactacttttagataaggaattctcaggctttgctatatctgactgctcttggaggctgagcttttggctaactacctgactactttgtcgtttctcttcccttggaatgaagcaaatatctaacttctcactcattgtttctgctattttaccatttagtcatctgtgatttttctaaatactgaaagacttccctcaattcaaactatgtgccggatcaaggaaagggcagttggatattgcagacagcatagtgcaattgtgaagagtgtctgcttaccagccacgctgccttgcacaagttatcaagcctctcaacccacttcctcaatctgtaaaataggtatgagtgtaggaccttcccaggggatttttttgtgactatagaatgattctcagaagactttcaggcagtatgtgggtgaggcacatgctggaaaggcttctgcaggtgcagtgatcaatgcttttctcagtgtgtacatcccataatacagacacgttaccagaaactccctagccaggactttgattgcagctcacattttgtatatggcccatagggaaatgaagtgtgtattttttataaagttcaagtgttaacttaatttggaatttactatcaaatctcagttgttatgggcatttatagctattaatacttcgtcccatgtgtcccatgaggaaaccaaggaacagaaattaaagttctttctggagtcccctgaatctcgttcctgttcttttgcaccctgttaattacatagagacattcacagctcttctgaccttatcagcgttaaggaaaacagaaaaccagcgtgctatttgttctgtcccttagtcaagccttctcaacatatatttttcttccaagattttgcatgtgcacagggatgcctatcctctacaagaaacacattttaggcaaattataattaaaatgctgtttacatctcttcacctttagaatttaaagaatgatcatttcttagattgcatctcagacacacccttcccctagtctggagagggcgaggcccatgggtactgcaaacagcctgacgttgtcaggggcggtctcaacggctcattcaccacatctgcctcgcgaaggctaagccatgtgctgttacccctgctgcgctctggctcattctaaggtacacgctattaaccttgtgagaaaacaaagaggccagccccacccttcctgctcactctgagtcacggtgaaaatgtttcaggatctcgggttcgaccatgagtcctgtccaggtccaggaggaaattcggaaggaccacatgttcactctgagatcccactttcatttccctcctggttgagcagcattaatactctggctagatttaaattctggctttctccagttagaactgaaagttatgacaatgtaatcaaaatagaatgtgggtttacagctggccccctggcctggtttgtgaacataaaacagaaacagaaagtgtaagtggtgacatcatattctctcattcaatgtgaaaggccaccgaagtctttccagaattatttttgagaataatatgaatttttaaaaaatacctaattattttaaatatcgtcttgcttgctccccaaatacctactgttttcaacttggatatacgacatgattaaagaatatctaatatttgggaatgcatactttaaccttataaactaccactgtaaatagacagactcattaaagtgaaaggacattttaaatcaattagtaagcaaatcaattaggtggcaaagacaagattatttttccttatggtagttgaagaataatgcttaacctgtcattctaattaccaagcacggtgttctctttggaagatcatttcaacaaaacattattttcatccagaatttgaaccttgagattgcatggtattttagaaatctattttagaaatctttggcaaaggttactattaaaacaatcacattcatggaaaatcagtataagagcaactaaaataactcacaataccagtaaaatcactttgtcatcttcttaagacttttaaagagcatttgtaagtaactgaatagaaggccaaagggtgtgtaggtagcccagaccatcagtgggcagccagggccagggcaggggccacggttgcagcctgcattcttctaaagggcagagcaaattaaagttgaagcaggagctaaaaaaaaaaaaaaaaatgtttcaaagaattccaccaaccagaggatactacctaggacagtttgggcctaacttatctgtgaaggcctccagcttcctccacaccggtggccacttttcattcactctgaacccttctttgtatggaggtcattttattaattgagctgtgaccaacatgacagaatttcctgttttagggcttttataatatagatagtttatatctaatttcagaatatattcactggggaatggacttagcaaccactaccacaacaatgcaacaatgtgttttggaacaaatttaccaatctgaatttccccctagattaggtcacaggaacattgcagctgatgtacagctatgttcctcctgaaacttggagacacatcctcttgagctgggttataatgggccacccaaagctcgagttcctgtaatggatacactcaggcagcagaacctaccaccgtagtgaggacagcacccagagccctcagaggccatcacaagtgcaccacagctgccttctctggcacgctcagagctacacagtgtactctgggattggaactctttatttttttttcagttgatttgtaaataagattgcacaaaaatccatgcacatcaactctccaaatcagaatttgctgagctaaaaagagcattaaattagatgggctggctttcaaggggtgggggtgcaatagtggaactctgcacaacagttctttacaaagagacaagcaagcacatcgcgtggaaatttccattcaactggaaatgtccaagcctgtttacctcaattaattgtccttgttcacttgtccagcctagcaattgtccattagtaatttgttataaatgagacatttggtattaaagcatctctttgggatactggtatggtttattataacattctgttagtagtgttgtacaagcttgagatgtattaatacgaaatccaagctgcatgagggctttatttttcaagcctacaccttgctgaaattctgaattaaaatatgattctcagtacaaatgaataaatcaacagaaatggtaacgcatgtcaaatattcttaaaacccaagaaagccttgtaacttccttcaatctaatgggaaatgcaggcaaatacaagactgatgtccttgagttttattatcaagactcaagggcaccagtaaaatctagtttcattggttggaaaaaaaatcctgataagcactgttaggcatattaactttaatgattacaatttttaggacactctgtggcctagacttagaaacacaactaatgtccagaaaaagattcctctttttattccatcatctgataggcctatttttacacatacacaccaaccaaaagtagccaagcaaacaaaacaacatactcacaccccttcgcctattatcatctaggtgattttcaatgctcattgcaatgaaacctacttattgtgcatggcacccacccccactgaggaatactgtagtttctttccctttgaacttcattagtagagcacatggttcattcactcctgaagagttcttcgtatgtcagaatatatatactacaacataatttccatcagagctctgaccacccgcttatctattttcataatgcctgccactccatcattagctgttgtcatgtaggctatcaataaatatatgacaaataaaacagttagggaatgagggaaattgactagcagccaaagacctaagccatcctctgcttggacattagaaaactgagttcactacagtcataagatacacaaaggcagaatgtaagccatacaaaaatccatgtcaatcccaatatgtgagtacaactattgaacaccatgtactaatggatgagttggtaaatcattcaatgtcttcatgaggtcaattacagattattatttagaccccaaagattccaaagatggtatttcggtcagatcttcatcctttgtaagcctagcagaaaatatggcagttttattgactactattctttgctgggtgtggtatttttaaactgagacatcagtgtgcctagcacagggcctcaagcacacagaaaaattccttgataataattaaataaaatttcagcaaaaaatatcatcttaaggctgtgaaattatcttcctgtgtggctaaaatagtgaataaaattcagcgcaatataaatcatagtacaatttcatcactaaattttctgatcttgatcttgtcattttacattggaagtaaaaatgtgtcctcctttttttctctgacagtgaaaagtgtgtgtgtgttgtgtgcccttttgcacaccctgcctcacacttgctggtctaattccttccagcatgattatgatataattaaatgacagaaatgtttacttccaagtggaactaagccagggtaactcagggtagggcagctgcttgcaccgaaagaccaagactgctagagaactaggaaacaggcggtgcaagaactccaggctctcatggaagagcgggaggcttctatggggctgcagaaactctttggtgcttggggaaaaaatgggttaaatgctcttaaaaaagaaacctgggagaggtagtttccagatgcaggcccgtcttttcttttaaacagaggcagctccgaagagctggacattgaaccctgagcaggaactggaggccgtcagcgcagctttgtttggcgagcggagctttgcaagggtgtaatgctgcaccagggagacgctatctgcagggaccggtgacgccgtgggtgtggagggggaggcagtggctggccctcttggggtaaggtacgcccaggaacagtttagaataacgtgcgcgagtcaaagggaagaagaagctcctgcagaccttctgggcactgtgcagggtttgctcctgtccaccgtgccgtgttcctgtcctggggtatttgggtgtgtggcgtgtggggaggggagaaggagcaaggcggcagggaggggatgaggaccaccctgtccatgggacaggccctgggccccgcacacaccccaagccccgcgtcccgcgtcctcactgtcctgggacaccccccaccccaccccaccgccacagcccagagcggtgccaggaagccgcctcgacgcagccgtatcttgaggctccagccccatccccagggtaccacgccacgtagagacactatttttcacttcgtgtttgtcactcctaaagcatgtgtgctagctgcaccaaccctgggatgcctcggtgcatagggtttatgtgcgtcctcctccttccctctgagctggtcccccgtggggaactgctgcccagactgacctgcgtccttccgcacgtgcaggaaaatgtccacgtgcacttgtcagggtgggggccacacgggcaccaccactgatcatctgtgggatcgagttactgcccatgcagatcccacgtgcagggcccagtcgctttggtgagagagtggacgctgtggtgactccacggtctgtggctgtgctcaggaggacagagaggggacatcctgagatggtttgggcagcccgcggatcctgtgcatgtccccagagcgtccactttctccatggagcagtggagtggcgttgctgagacagaaagttcaggttctccactccccatgcagcccccactcccctgtctccggccaggcacgcgtctggggtggagactcccggtgcccggggccctccagacctctttccccaccccagggagcaggcgggtacttctattccgtttggcttcagaagggaaaagagaacgtaagttcagggagttctcgtccattcctctcccgtgggccgggcaggcagcagggacagccttcaggagccaggaggggctcgagctgcgaggccctggaatgaggcaggcatgggctgaggctggagggaaagccccgctaaggctgggcgggggcgggaaaacttaccaccaggggactcgagatggggaaggaaaggtcagaagaggagaggccaggcacggggtgtgggcggcctgcagagctggagcaggtgctccgcccagagccaggcatgcacactcagagtaggtggcctgtgcagcggggaagaggggcgggtcggcgtgctgctgaagatgcaggagctgcggcctgctctgtgcgtgctgaaggtgtggtgagaagcacttacaaaaagaaatggactgtgttaggattgcacattttactttgtttctcccaaatacgtgttctttgaatttttttccttccagggccaggactggagtgatggttgagacaggcacgcactgggtcttgtctgcatttacattttgagattttgttcagcatggattttatggcgtttttttgtttgtttgtttgttcgttttcaaaatactgcacggtttatcgtgaagacagggtcctttgctgccgtcttaagttttgggcccaagaacgtgccccaccctaggcccgggcctgctggcttcatagctctcatcattcccacggaaccttaagacctgaggacagaaaggaaggaaacaagcccagtagtccgtgaaaatccagggtcccgccactccaggtgtctgcagcagagctgaacacacgtaggctcttgccaggaggggcatttgtatgtgctgagcattccttatattctcaatatgacgcctttgaaagatctgtggtttgcaaatatttactctcagtccataacttatctttccaacctcttaccaggctcttttgctgaataaaagttttaaattttgaagtctaatatatttttaatttttttattttatggatcatactttttgtgtcaggtttgagaagtctgcaccaaagtatgtcctgtggttttcccttaggtcatcttcaacaagtttcatagtattttgtttagatgtaaatctgtggcccattttgagttagtttttgcacaagagttgaggtcaaggttctttttttgcctgtgatgttcagtggctctggcaccatttgttgaaaacatgatagccaatgtcaagacttaatagttataataatcaggagcttttgtttctttttgttttgtttttagtaactgccagtcactgcttgtggtatacatacacaatggaatactattcagtcttaaaaaaaaaaaaagaaggaaatcctgtcatttgcatacctggaggacattatgttaagtgaaataagccaggcaccaaaagaaaaacattgcatgatctcactccttcatggaatctaaaaaattgtattcagagaagcagagagtggaatggtggttaccaggggctgggaaggtgtgagcttggggagatttggtgaaaggacatagaatctcagttagacaggaggaataagttaaagagatctattgcacatcatggtaactgtagttagtgacaatgtattgtatacatgaaaattgctaagagagtagattttaagtgttctcaccacaccaaaaaaaggtatgtgcagtaatacagtcattaattagcttgatgtagccattccacaatggatacatatatcaaaacatcatgttgtataccataaatatatactgtctctttatgtaaatttaaaaataagataaaataaatgttattcacttgtcgtggatgtggtggggacaggtgtgggatagccctccctgtacaactaggacccaggggtgatctagtgacactagccatttatcaggacgtatgggtgccagtcaggatgataaagcttccttttggccactatactacttagaaatgccctgcaaaaggtgcacatcaaagattgaaagctcaatcctggattttaagtgcttcaaaagtgcacttaattgccacatttttgtcaaacattttcccaggtagtatttttcctcatgtaaaacaacagcaatttaatttgaacagaaagcattttgaaacatacttttggcagggttccttgcagatcagaatggaaatgattaacagggcaattatcaatcatggacttttggcggcagaaggaactgtattgtttggtacagtctgggccagggccacacaccgtaacggagatactctattctgtggacggttggagggggctgtgctgagcagggtaactgcatcttttcctagactgttcacactgctgccacgaaggagtcttgtttagactggacctggctttcttcttcgcaatgagtgttgcagactcccgacaaaggccaggtggtaaagtgtggtgtctgtgagcgagagcctgagatgcctgagctgacctgtcctcagccacctgccatcgtgcagaggtgagagcagcccctgaattctgcccctcggtctctccatagctaaagcaaaaccatccttccgtgctcccaggacaagcaggctattaccaaatcacccactaaccctgggcgaggaggggccatcactgcacaattcatcagtgtctgtgacaggaagagattgttttagactggtttttttttttttatttgcaagcttttttctctctccaaaacgtgctgtcagtgtgttctaatttactctgtaaggaattctggagctaatcataggctcacaaaaagcagcacaggaaagtttcccagataacatctatttcagtggctttcaaacatttttgaccttaccaaagtaagaaatacattttaatatcatggcacacatacagctgtatctaaactttcataatactgcctttacgatatcactctgatattgtctattcttttctgtttatttttctttttgttccttgttatgctggttgtgacccactccagtgatttcacaatgcaggctgggtggtgtcccacagtttgaaatcccaatctagggccttcctctcactgtacaaagtaggtaactggggacattagtggatcagtgatcaaaccaaagttatttgatcttaccaagtgatatcaggatgagaaagctgttagagtgtcagatatgtgaaggaacttgggtcattcctgatacctcaaagagaaaaaaggtagtccttgaacacctcctacttgtaaaggatgcacaatcctacatgcccctccctttcctttcctcccctctgtaccccacccctgcccacattttcttcataagcagctttggtgttttggcttgtttgtttcccttgtctcctacctgtgactttatagccttttggagactcacagcaatagttgtatttaaactcagtgggtggcatccaaggctaaaaaggagattgcctagacacaaaaccacccaagggagaaagcaggacagcatcttactatgattgtttcttgtttcttcctgtctcataaggattattacccagggttttcatttttttcatttcatggttcattttcgctccagtgtagacatacaatagaccactcgtccctgtggctccgggcagcagcctcatctgagaccctcctgagacatctcgtgcagggcagccgtagtgtgtggcttccccagggctgctctaacagatcaccatccttgccatggcttaagaagctgcagatttatttgcttacagctctggaagccagaagtccaaaatcaaggtgtcagtagagtctctctctctgaaacctgctgaggatgatgcccctggcctctccccagcctctggtgttcccagcagcccttggcattccttgccttgtagatgcaaaactccgatctccacctctatcctcacagtgagttctcctgcatgtctgtctctgtgccttcacattcctctctgtgtgtctgtgtttccatctccttatgaggacacccatcactgaatcagggcccactctataccagtaagacctcatttcaactccattacatcttcaaaaaccccattctcaaataaggttacttcacaagtgctggaggttaggacttgaacataccttattgaacaatccaactgatgacacatagtaatttatgcactcgttcttggagacgttgactttatttagtagcattaaccatggcaatgtcaccagcatcgctgacagcctgaagcatatgatctccagaatgtatttcaatcatcatgttcacttccttggtattctttagacaataactcagccttgaactccagtaaagggtttccctgggattttcttcttgactcactccactgtggcctccctcatccaggactgtaacagacgcctgacgtcagtggtctagacctctctgctgaatgtcatctttggtgaatgtcttatgagaaaacacatggttggtcactcttagaagggcatgaaagcctgtctgcagtataaccaaaacaggcacatggcgaggcacactgtgcgcatgtgtgtacaattaatatcatggttttaaattattttcaggccaaggggagatctttgctgcatctactgaagaaagcgaatctttttcttcctgaaaaaaaatggctacttattagtcgaatttgtgttttaaaaatatgtgaactaatataatgcagacatgcattaatgtttaaatatactggaagtttttggtaaaatgaaacccattgtctctgttgattactttgatgagtcaagaagtaacatcctgggaatgattggccagtttaaatgagtgcctcaggtttttggaatacaagaaatcaagaggaagggattagaacatataggttagcaagattgggatcctaaaatacagacccaaatgaatggaacaaaatcagggaatttattaataacagggtcaaggccaaatcagtaacaaatatcctgagtggaagaaaggtggtttaacaaatgcccctatgaaagatagagattggcttaccatgatgagatgtaagcccaagttatgaggttggcacacaaaaccacaaatgtcatagcttaaaacaacacacacttcttatctctgtttctgtgggtcagggtctgggttctcagggactcacaaagtatgttttcatctggagctccaggtcctcttccaggctcataagggttcttggcagaattcagtttcttgaggctgtaggactgaggtcctggctcctagaggccaccctctccataagcagttcttagcatggccgcctgcttctccaggcccagtgggaaagcatgtgcctccaggagggctcagtccattcttcatggcttttacctggttaagtcaggcccactcaggataacttcattttgtattaaatcaaaaccagctgatttgggatgttaattacatctgcacaacttcaactttgccatataacctaaccatgggactgatatttatcatgcatttgggtcaagttgcattaagagatataataaagctggacaagcttctgttgattagaagagttcagttacaaggctacacttgggaggaatgtttacaaactggaatggtcagaggatggggaagacacttgagaaaagtcaagtgacggatgaaggcaaatgtggatatttatctgggagaaaactaagaggagttataatagctgtcttcaaatatttaaagggcttttattaggaagaggaatttggcatattggattttgccttcagagaagtggagtcctgagatgctcttagccattcattccagcctccagggctcacctgctgtcttctgtccaggttctcggtagcagggcagtacagccccatccgtgatcttccatagtcaggcatattgtcacactcagtgagcggagagtcaaccgggaggaaggcacagtttctctggaatgacctacggaatggtacgctcaaatgcaaattctccttcccttccccagtccttgtccttcagatggtaatttaggagctgaaggtcagggcaccagcagcctttggaagcctacaggacaacagtcagcctggctagaaaaaaaaacaatgtcacaggcatgttgtgtttaatcacatgaaggatatttgcattgttttccaactgatgccagcagacacattgtcagtggtatcatgcctggggtatcagagttgacattgggttgccccttctctgaggcattcatgtaaatccttttaagtttataaaacctccatgtggctcctgcatgcttcatcatttgcatgtgtctctttttccaggggaggcagcatggggagcaggatgctggtgggctccaggtgcagagagcagggtgggcgtcagaccccaggtccactgtgcacgccctcttgtagagcccgttccgttgtccatgagatgaggagtgttcttatctctaaagtattatcatgaaaacctaacaatgtagaaagactaaagcacatgggtggtgcttcataaatagtatttctcccactttctgaaaactcctgctgaagtaactgcacaagaatccttgaacatttagaattctggttttagccataccataaagtcagtagtgcgtggtggaattctgctaacgaaaattgcgaaggatcaaggcagagtacagagctggtgtgtagcgggtaccttctgtctgctggcactaggtattttacacattaaatcagctcgttctcacatcagctcttttaaaaataaggaaatgaggagccacagtggcccaactgatgcagtggcagaagtagaatttgagcttgtgcagatgtgcctccgtgttttgtctcctgagcatgctgccccaagtttgacaataccaagatttgtactggaacattccctcccatccccaccccctagaagcccctcttcctcccttagatttgacacatagtttgaaaccactattaactaccttatgagagccactgtttgtgaagtgctgactatgtgccaggtcccgtgccgtgcaatttttgtgaattatctcgtgtctacagtgcctcacaatttctctgctcaatacctccatgttactgccgaggaaagggaagctcagagagagtaagtaatttgctcgagttaaagagctggccaggacagccaggggcttgcaccccggagccttcatccactacactgtcagctggtatctcaaccagccattacaggctgtaaaaaaattatataagatagtctatggtaatgcagaaaagtgaggttattttgctccctttccctttgaagaaaaaagccctggaaagacatatcacttgagtatgggaaaaaatgaagctgtggcttttctgtgagtcaattctttcctggcagcttcttggaataagaccaagtatagcagcagagttttctgttttaatttgagctgcagggtgactttttttcttctatgctttcatctctctgtggcttcttttgcctcgttaatttcatgccctgcccaggcgggctactgtgctgcccagtcacccgggtctggggcggccaccgctggccagcaggcaggccctccagaggcagaggtggccacgcttaggtcgctcccgctgtggaggcggcacacttgggtggcagcacagctgtgatgtggcggcagctggcagccccatgggaaagatgtgtgaagtgtggggtttgacgacccatgggagaacagactttcttcctcttcttgttttcccttcaaagccgtgagtcaacctcaaattctctgtcttttttctccaccccctcgtgcctctctccctcacgctctgcatctctcattgcaagcttgcatttttttgcacacaacactatcttaatatttctcttttctgcaggcaggaaatgagaagtcatttttcagggtcattcaggaagtcatccagagttataatggcccattatctactggtcagagtttacttaggctttcactacttccactgcccacttgaaacagggaaaaatattttccccccgcgctgtgagtgtgctatttagagctgaccacaagcggggggaagagaggatggctcggatgctgcatttccactgagaacacaaggctggcaaagcttgtctgctgcccagcaagcacttcaggctcacaccattttaggttcactttaagtagtttctcaattgttaaaaaaaaaacaaaaaaaaaaaaacctgtactctgaggatatgcttataatcccatagctaacccagaatttcttagagaactgatcaacatcagcagtggcacttactgaaaatgcacattctcaggccctgcgtagggcctactgagttagaatattagagagcaggtctcagaaacattctatccggcagtcttattctatgcacccgaagggataagagccatgctttcatgaaacatgggttgtgtgtaaaatgtttaaaaggtatggcaaaatgtgtttgattggcaccaaggatttctggttcctcctagaatcattaatcaaactttgaaggagaaataagagagtcggcattttcttgcacattctttgtgatgttgtgatgagttggaaacttcccgattgggtttattagagcatgaacacccaggcacccagcttctagccagccctgtcaggcagagtctcctcgaagatgtggaaaggactgaccaacagctgaggcctacaggaacctgagcaggcaaggggagaggcaccccggaaccaggagcaatggccttcccaccctccctcgtcctctcctcttctccttttggagttgcaggccacagaaaggaagtgacatgagtcactttgggccttcttaattccttcatcaaaggcagcacaggtgtgtatgtgtgttggtggctaattgaggtaggcccacagaggagataacagatggacatactatttcctttcttccattctgatataattcagggtataaacacacacacacacacacacacacattctcacttctttggcatctaccacacctgccccagtgcccatttctctcccacctgaataaaaagcccccacaaagcctgaggtacatggaaaggagcagtggtctggctcccaggagtgtgagaagcagccatgttttcagaggctgtattccacttggacttggccctacgctgaaggtaggagcggatgggggaggcccccttcgcacaaagagccccatgaaagagtgcacagtccagtctataaaacagacgcagaaaatgtgtgtaggacttcttcctgaaaaagagcgtggtgcgtccagtacctccatgttcatggaacttcccagtctgcagtttacccttttgtgcaactcccttttggtaaagccctggtcacacttctggttgttcagattatacagggataattccagagtgattttaaagtcaactgccaggcatccgcacttgcaaattagatgcctggcacatgcttgtgttaaggtaataattcattacaatacaaattacaggggagttcctctgggcatgcgacctttcccgtcatttggctttccctgtgattatcaggggagcttccatcgtgctgctaatgggaccttaaccatgtgtcaacccatggctgtaatgctgacactgttttctttctggaatgaaaggccttcgcaattgaaaccaaaatgttatccaactcagtcctgtccctttgacgatgaaaacatcaagttctggagactggccatccagcctccctgcctcatctcccacgccctccatcattttttgtctctacttacttatttatttggctgtattttacgtacatcatgcaaaaatattcctctttgtaaaaagtataatgatttcaggaaattagagggtaaaaagcaagaaccatgctttcactccactgtcaagagttgtggaagaatccttccagcattttttctgtgtattttacatacatacaaatatatgtacaaataaaggtcgatcatttaggttttgtttatatttttgtatatatgagcttatgtcattcatacatattgttttgcctcttgcttttttttaacttaattttactttgcttgagagctttttgaactgaagtacgtgtaagtcagcctatgcatgtaatggctccctcatcttctgtgaggctgtcactaaaaaggggatttagcttgttctgggctttgcagcccgtacactgggcactgttcatacgtacttctctgtgcacgcaaaggagggcttgctagggaggcctggcagagggtgccattcaaataggattttcaatggaggaatttttaaattttcagttatttgaataagttttaatatatatccagaaccccaaatcatcaagtttgttttcttccacatctgtccttccatttctgaactattttaaggccagtcatgtctcatccaagaaatcccatcctttcacacaacactatctccgtttcatggttatgaatctctaaaagcatgatttttaaaacataatcacaatgctgtcatcgaacttaaaaattagccataaatctcttatgttacccaacaaccagcctactgacacatctccagttgtctcaaaaatgtgttttccattgtggtttgtctgaaacatgatccaaaagtcagacccacctctcacctttccctaacctgccggagcccatgtttctttccagccaggcttggagaccaccacacgggatttgcttcttggggcctccctctaaccagctatgcaggatgccctctttcctgtcaatacaagctgctcaaaggactcattcagttcaaattcacctatgtgagcctaggtgatgctacttatttatttatttatttatttatttatttatttatttatttattttgagatggagtctcactctgttgcccaggctggagttcagtggcataatctgggctcactgcaagctctgcctcccgggttcaagtgattctcctgcctcagcctcctcagtagctgagattacaggcacgtgccaccacgcccagctaatttttatagttttagtagagacagggtttcaccatgttggtcaggttggtctcaaactcctgacctcgtgatccacccacctcggcttcccaaagtgcttcatgttttcaggagctgtacgtgcatttttagttttgatgaccaggtcctttttctgttttttaaagaacttcaaatgatctccagggtacacagcgcttgtgtgctgatgaaaaagctggcagtacaaaggccaccagccaaggtcacacagccaaaaagcccctgacctcgggccccttcccagaccctgggtcttttgctgccacatgaatcttcttcaaggtcctatgtgtagattttcttgacttggccatattatttaggattcagatataataacaaaatagatgttaaagcataacatgaaggcatttaaaagggtagaaagcacatgatttactaaaaccataaatcttatgacctgaaagtttcacctaatctcttaaaaaataccgtactaaaccctgattgaaaatcagagctcagacatacagcctgagatgccaaaaaatggccaggcttgtctgttgagaaagccatatgtaactaactgtttggaaattcaaaatatatcttatcattttaaaaacatctttcttctaaagacaatcatcttggcttcaggaatgaggctagtaaaaagtgaaatactcctacttgtggaagaaatcctcattttaaccatgaagaactgaaaaatgcattctgatgttgatggacccaacctatatttgggtattttatgatgtacacaatatacttttgtatatgagattgttattaaatgtgactttgctttttcaagacatacaatgttcctccgggggtcaggcactgtgtttagcactttgtcctgacctcatctgacttctcagctgtccctgagaggtaccagtgtgcaagatcgctgagttggcaagtgatagtgacaatattttcaccccaatttctaatttaaagaccccgatttctagttttgttttgtattggatttgcacaatttcacgttctgaaagaggatgccctcaactttgcaaaatgggccttttgaatgaaaaggatcagtcatgtcaggaaaagcgctacaatgatgaaatatgataaataagtcagtctttcatctgtaattatctactatggggtaaaaagtgatgaaaactaccatcttgaaaggttctggtgatagtggttcctaatgcagtgaaagatgtgtaagtcaaagatttgtaaccagccagggaatgagaggcgaagccatagctggtggcgggggccacatctgggtgtggggaggccacagttgggttgggggtggggcctgcagttatccacacccctcccacctcccttcgacagtacaggcttcctggttaccttccagagagtaaggccagggagagttgaataagttgagaaatgtcatgtcgaagctattggtggaaagagttccattaattgacaatacaagtccctactacattctaaaatctggtcctgactagtggcaagccgggcccaggagtagcacttaaacaatggcaggcttgtgttgctggcaggatacttcagcctcagaggagctgtgtgcagctggggagactcacactcagaggatttcaaagcagagggcatctcgtagagcaacttatccaaaccctgacccactgtaaacacacacacacacacacacacacacacacacacacacacacaccctgagagagagaaagagagagagataactaaagagagagaactaaagtttggcaaaataatacatgctctaatgaaggtttattaatgattaatctactcctagcatttcctagtccactctatctccttaaaaaaaaattctggttgcagcccactaacttgattgtacagctgcttaatggatagcaggctgtaattttcagagaactgtttaatgcgggctacctctgttcttccatgctgcttgtggttcctgctctgctcaggacagaatggggaggaaaacaggctctgcggcacaatattggcaagtgaaattttgtaaaccggccctcccttccttttgcatttggtctgaaaattcaattagatgctgagtcctacaatgtatttgagaagcccaggagtgccctagaggatgagactgggtggctccctgtcaggttgaacatttgccttaattactttggcaagatttgcatcagtggtattagtccctgcctcacttggaggcctgcacttaagtggccacattcaggctccaatttcctggtgatttcatagtgtagggcacttgcaatcaaaactaggcttaaagcccaaccctcttacattttacccacccccacaaatgcagcaaataaaatgactctgattttcattccctagacctcttttctatatttattacattattgttaagacagtttttgaagaaagctgttttatttaacaaaatagctttatggaatcaacttcatatatcttctccgccagatcaaaacaagctcgtagtattagatgtcaccgagcaccatgacaggcagatgaacatcatccctgtgcccggctaatgatagctcggcctgccccggcgtcagccgctcctggcagggccagcgggcggtgtgggaccggcaccgtatctccagcaattcgcagataacaaatatggttctgatgatgttactaaagatctgtccctttcaagattggattagacattaggaatttggagggctttttattgctagcatttttaagaataaccaattagagtattgattctaaagtctgaaagccacatggacagagttcatgtaattggctactttatgtgcctcttcctagattgccctgcattttcaaaacaagagcctttctattttaatcaaaagaatccagaatgaaatgaggctttgaaaactcagcctatgtttgtcttgatttccttaactgacatctagaagaaaatatgagctcaggggtccgctgggttccttccagcgcctaagcctgtaagctcttcctgctggaaccaagctttaaatgcacttgtcagtcatgtcccatgagaatagatactgccttccatgtttttttgttctgatttccgtgtttgaaatgatgaaaatcatttttctgtgctttttaaaaatggaattgcttttgtgttgggaattgtgctgttcatttttactctacctcgttttggaatcactaatgtggccaatttatagccaaaaatcagtatcgtagagtgagcaatgaatggcatggtgactgtgtgagcgaattcatgccctccctccccaccgctcgccccgcgtctcagtcctcagtgatggtaaacagaatgaggaccttctcccgaccgtgatgcgcctcagccctacttcccttgtcctttcctatcataaaatcttctttcatagaaatggtcatttctgttcatatctgtggactgtaaataacaaggaagtcatttttgaggtgaaaactgcacttagactcattccaattttgatggaaacttttagctggtggatggcattttgttttgtcttagttttgcaaggagttatcttaatttagggagatgaaactagtctgtgatccgaggtctcacttccatacatttctctcgggcagtgtggctgcctgaatcatgcctggatgccacaggtgcttagccagctggtcctgtcgtaactgtcactggtagctcagggagtgcagaggtgccagcagacactatgaaattggcctcgtaaagcatcagttatgttgtgatggtggcaaagctgcaggcgagatgggaagtgcagccactgagaactcacagtagagcgtgtgtaacgtaaaaagatgaaacccattgtacacagctgtgtactgcctccttgaagtcaaatttcccccattaccaaggaaaagttttttctgaagggggctgcttgacaggatgacatctggtgatatcatttattcctttggaaatcaatctgtggaagtgagtttccactgactgatgaggagaaaaatgaattggcttcacccagcatccagcttcttatcctgggagagatagctcttggtctgtcatccacgcagctgcctggtgcaagagccaagtttgtgcagcctgcagagcactcttcctgagctgtgggctgccaggtcggggggcagggggggcctcactgtgcagcctcctgccacccactgatcatctggggagactggcctatcctgtcaggagacgcagttgcccagacgttttcaagggcctaagatgtaggcagttgatccacagatttttggagagtccttgagttggagattacaggtgacctcagaggagggagtgagaacatctgggtcatgggtttctactaggagtccacagtgaaaacaagaagaggaatttacgacaagacagtccagcaacttcctttctaacttctcctttcacatatgctggatactccaagactttgcatttacatggacatcacagatccactttgagagaagtagggtaaaaagaaataaatacatagtgctttaggtgtatttctatacatcttaattgatatgggattacattttcacttgtgtttactgtacagactctagacagatcctgctcttttgcaggtaaaacaaatatttcttaaaacctagaaagacccaaaacaatttaacagaaacattttggaccattttggaccttggcagttaggccccagtgcagcagcggcaaccataaacctctccataggtgctgaacccaggtgatccctggcaccggcagccttatgtcagggctctcttatcgctggtttttatttctcctaataaaagtgattaaaagattcatcttttaaagaaagcaaggacacagaggtggattctccctgacgctagcacagctcatgcccaagccactcctgcagggctctggtctaagtgcaaaagctggaaaagctgcaggtcccgcaagacacagagcaaccctgcaagccaggtcaccttccctcttctctgctgtccgactggccctccaccatgtgacattcaaaagctcaagttacttaacctctcaaaactcagcatccttttctgtacagtggggaagatactggactgttgtgaggattaagtgaggagagtggcccaatgaggttgacagttattactgtcattgtcattatttgccttctcacaggcaggcgtgccacagtcattttactgaagctgcttcagtgggtcctgaattaggccctgtcctttgggagagacagtcctggttcaacacacagctccctgcccagggcagcttgggagtgtgggccagtttcgcctttagaaccacaattctctgatatgtgcaatgagagaattaattatagactcaaaggattgcatgcagacacacacagatacaaacacatacacacaacacacagagttacacacagacatgctcacaatacacagaaatacacacagacacacgcacacagcacacagagatacacacagacacacacacacacacacacagacatacgcacagatgggcacacacagagacacactcacagagacacacagatacacacaggcacacacacagagagacatacacacagcccacagggatacacacagacacacagagacatacctacaacacacagagatacacacagtcacacacagagagacatacatacaatacacagagatacacacagagacacagatacagacacagacagacatacacacagacacgggcacacacagagacacacagacacacacaggcacacacgtgcagataaggtaatattagctagttcaggaggagaaagagataaagataaagtaatattagctagttcaggaggagtgaaagaagccttgtttttctccactttttatagaagagaaagtgaagattcgatttgaggtgagttcagcacaaaagcgtatcccaggccctctggctccaactgcagccctttctacctcattcccagaccccacctaagccttttctcttcaaaatcttctcaggcacactgatacacatacctcagatttttaattctccggttgtgttcaccaggtgcttggtcatgattaagaattccgtgatgtgtaccccatgtgtttaaatttgctgctgagttaactttgtggcggcctgtggactagacctctgcacatgcaatgcagaacggcagggccagatttgaaatcctgctatcttttcggctgccttgtaaaaataacatcaggcgatggggatacgatgccagaggtcacctgtgataagttctgtttatggccattttacttctaggaagacaggaagtgtcaggatctcagggatctaggaagccaaaatgtttttccactctgaaataaagtgactgaccaggagttcccggccacgcagccctgtgggaactgccgcacggccacttttatgaagtggacacgtgttggtcccactgaaaagaaactccccacccatggctccctcacgctgcagcagaggccctgccacagcacctgtcagcccctgccagcttgcaggggcgcaggcgcagagcggtttgtgcccttgctggagccagggaagggcacagggtccctcctggagtcatgggaggtgcagccgaggttctatattaaaatacagaggctagcacatgtgcttggggaatgcagctacagtagtggaatgaaagtgctgtccgttccttacccccccagctcctcacctgtcctccacacgcatatccctggctccctttccctagtaaggagactgaattgaaattgtggcttgcccgaggctgcatacctgtgctctttctgaagcccaagtcactggctctagaattctaacctgtgaggaagccactgaggatgtttgtcaaaatacatatttctgtgccttgccccagttccacggcccaggaatctgcagttttcacaagcacccccaggtgattctggtggtgtctttgcacttcttcaaggcagtactgcctggaacgcagaatcccagcctcctctatcctccttgcctaatggcctggatgctctcagatctacaggggaagggaaggtcacacagtcatcgcaatagtaacctcagctgataaatcctcccccataaaacttattccccagtgttttttaataggaaacaataaaactgtaaccagcccaaatatccatcaaagagaaaatggagaagtaaatcatcgcacattcacctggaccagatctattgtaaagccaataatactgaagccccttccaaggccctgggagtcctaacagtgcactggcagtgtctataatttatattatgaaatttgcataaggaaaacattttgtctcatttgtgcaatttctccttctaaatatacgtgtcactttgtacctgatttctataagacccaggacctacaaaccctgtgtctgcccctgcagccacccagggaaggactgcacagcagcaagacagattgccatggagcatgttgtgcccaactagggacagcgcagatagattctgtaatttgcctaacaatgtctataggatgatcccatttgtcaaaaaaaaaaaagaactgggctttattgatgtcacctaaatgcacctaaacttcttttttgccccatgctcttctgtactcttgatctttccccaaatttttaaaaacatgacactcattcccttatttttcctacttagaaaagtgtagatggttttatcataggaagttcaaaaaaattaaaatataatgaaaaatactcaaatagtgcctcacaacagtaactactgctaacataaataaaatccatatttcctctcatacagaccccagagttgctttgcctgacagtgtagttgatggagaaaataatctttatccttagcctccatctggttgcagaccataaagacagggaaaaaatgagggtgttggtagcttcgttagaaactgaaagctcactgattttttcaaaacctaaatagcctgtgtttctccaaataactaatttgcagccttcggcagccaggactggcagggatggggctagggggactggggagaactgctctctcctgagggtggtctgacccgacagcacgcatgaccttcccacagtcaggaactgctcagagacgtgatggcaactccatagaatgaaatactcttcagccagtaaaatgtatttttggataaatatttgctttaaaaaactttactatatgttgttaaatgaaaaaaaaaccttaaggcatcagaaattatgtgcagtaaaatctcacttttgtaaataaatatacctgtttactacgtatgcataaaaagaatcctgagaaatataagtactgtatgcatattgttgttaagtattttttctgtttgcttatctataattctaattttgcttcaaagaacaagttactccggcaatataaaaataaaataactaatttgtcttgtcatcaaacagatagtaagaacaggcaaacctggccctccacactgccagccttttgtgattcaaggcttcagtttcctccacttgttaaaaagattcaacaaagtagttgaaatagtatgtgaaccagtaaaccctaaaaggtgtccagtgttgtctgtgagctaattaagtgatttgattctgactccccgagtcttctgatttcgaagcagtggggagtcagacaggagcctcaggtggcctctcctgagaggccctggaaagtgatgagaacctggcctctggcagctcttcataaacgtccatgttttccctctactctctcactcttttcccagggcctcaaacagaagatgaaaatcaatttctaaaacagccctctgtgtgctctctcgtatctctccttttcacacatcgtggtggtggctttctctgtgttcctctgttgattcagtctctggaattaacggatcaggattccatgcccagaatgctacaaagactgtgcttgagttctcccacatctcactcaattacacagaagtttcagattatgtaacagatgctgtgctgggttaggcagagccatctgacttgttttgctttattttagaccatgagatgggtgagtttttctttttaatgccacattcttttaagaattaaaaacctccacttggctgtcagcattggaaatcagagtgatggtgcaagccctgatgaggacaatgtccttgtctatgaaaaggtgaaatcattgcttgaaatcgctaagcaggacatgcagtcccagatggaggggggaattcgggagctggttggaaaagagtatttggcactttgcagccttgagaggtgcagaagagacaccgaggggttcaccaccagagccaccattgtcagagaggcgtccagctgtgtccacctgggactctgccttcagggcttcttgcctggctgggagctgcacaggcagactcctgggacggtgtgccgacagctctgggcacccccttctaggatctgattcctgaggaatcacaatgtggatttcacaatcacttccagtgtcttttgccaacctctgtgaacagatgtgcaattaaaaaaaaaaaaagaaaggggcccaattctcaacactgtaagtggaaactttttaatggaaaaggataggctaatgaattgaatttgaaatctgagacagaaccgatgcatcaaatgtgctggtgtttacagataatacaaggggggctgcatcttatggtttcaatccttttttaaatttttgttctgagagacccagccagcagactgccgccagtcttgtcagagatgtcagtggtggccactctgaatggaaagcagcatctctcagcatctctgaggcactgctcctcagcggagactgtggtggctttgcctttcagcacgcatcctttctacgatgcctgacagtgcccagggaatgggcagagctgggagctctgaagccctttcacctaaaccaccctgggtcacctgacctagttttcctcccaattttaattatgtcaggcacttcacaaaggcctccttggggacaccatgagctcactgtcatcagattgctccaatcacagctgtggcttgcacacaaccgccatctctgccccagcagatgctgtgtgtaaacagttgtattaattacatctcaaaaacatggttcttgccagatcctcaggatttgggtgcagcctctgaggtgggtgggaggccctcgagggagaaatgtctgcaggaaattcttcccctacgagaggtctgttttctaagttatctaagagctactgcagctgtttactgcagagtgaccctgctcaaagctgtggtcacccaaggctttgaaaggggacctccacttccgccctgggtggagcaccgtgctggagacccacgcctgccaaggcctcattgtcatctccacacgccgtccttggggtgggccactcctgggacacgcagacaggaagccggccacctgagccactcggaggctctatccagagtcagctgccaagcctcacgtcacacatcactgttagtcttggagggctggcggggccctgaagtcaattgaacacttggatgacagggaacttgccactgccagaggcaatatgctccatttttttgacagttccaacaatttttctttaaactgtcataaaaaattgctgctgtgaataccagtgtcggcgtccctgcctcacctttacctggtgcttttccaccacacaaaactgtttctcctcgtgctggccttgggcttgcagacagctgattcttctcctcccgcggctgagcagcctcctccgagcaaccctctgacaactctgctccttctgacaacctctgcaagggctgccagatgtgaacaaggggcccgggcagaaggtatccaggaagactggaaactcgaggaagcctgccctgtcctgtccaccagactttacgcttgcgtcactgggctttgggacctaagtcctcgtcatttgttccttttgcagttcctactgttctcagcacttccttccagcttactgaggtacactcagatgtgatatgccatcggtacagacacagttctgctccagcatttccccgtgttctttctgtcgctctatttactgaattaccgtgaggatgtggagcgaggctgagttctgtattttaacaccattttaattctcacctactgagaaatccatcctcttatcactgtgctttttttaacctgtcacgaatccatgaaatcctatcagccagcctgcatacttccttttaaggtgcagttgaatcaggagaaacttgccgcacatgctgcgtccgggcacagcattggctgaggctgctgccctgacctgtccgctttgtagtactgcccagctatgaaacaggttagccacacatgacctgcatttaggagtaacaagtctgtctgtacatgcacatacagcaacttttttaaactgtctatattttttcctgagataggtatttataatatctccatcttctttcccattttgaaacttagaacaagtttgcctgtcaacagttctccacagcatactgtgtattctaggattttctaaggttgagcaacggaggttcagcaattttgacttaatttcttcccatcccttttccacgcagcccagaagccttggatcacgtggtgaggggaagaggttgtgctatgtcgggaaactctgtatcgaagctcggctcagatcatgacattctcttgactaaaaccctcagtttccatcaaacttgtcactctggcattaaagcctgtcactgtgtggctctgaaaacctctctgaacgtgttccctgcctctgccctgcaggtccctgtgctccacagaagcccacttatgtgacccacccccactcatcaccaccttccctcacccagagcctcagctccccactcccacctgtaagacccctactggaaagattcccacctgcccctcaagattaatctccaaggacatttccaaattcctctccccatctctcagccagatggctttgctccctccaggaaccccagccaccttcgacctccagcagggcactccactccacattctcctggtctgtctggctcatcttacctgagccatgctctccaggtgaaggactatgtctaactcaactctgctttaaaagcagctaacacattgctctttgcatattgttcactcactaagttgaactggacttggacatgcacactgaactgcagcgtctgctgcttcttggtggcccagctcgtcaaaagaataagatttcagcaaaacaatgtaacaattttttttaccaaaagtaatgttaacaatatatggttttcccctgatgtttgcgtcaaaatgctttttggaaaaaacatttttcaactctttagggtcagaattaagcaatgaaatttatataccacatgtataatgtgtatgtttatctaagtatctgttcatttatatatcttaaatagaaattttaaaaatttttttaaaactcctgataaacattctcaggaggcacactatgtaactgttggttgatatacctagctagatggtgaaatcagattttgtttaaagcatggaggagagggaaaaattaaatcttgcagattctgcagtccttaacatctttgaaagaggaacatttcagacaatgtaataagaaggccacgtgctttgacttctgtagattttaaaaatacttctgtatagtttcttcttcctttgaagaagtttggggagtttgggaagatggagaaagatataagaatagactccccatatgggtcatgaattatctttttgcatcagaactcttagtgcagtttcagtattttcttcctcaggagggtgagctgcttccgaatgtcctccccttctttgaggcatcctctgttggtgaactttgagagcatccatttatgaagttgatgacctttcccagtctctgcaagcccttcagtgtgtgtcctctctgagcaaatctgaattgtgtgcttaatacatggaaagggatttgggagggttgctttttaaactgatttcttaattaatattatggtttagttaactagacagtctcattgcagaagtgcataaccataatatgtcttcaaatatatctcccttcctaacaccctgtaatatacttttgtaaagatacccttacagaatgtgatccaccatttatgaacctgcagcattgcattcagagactaagtgaaaagctggcagattttcatttaaagcacaagctaaggaagaaagctggtctagaaggagctacagaagggtaatgcttagggagggaatgatgtgcctgtgggtggtggtagttaaatctaaccaaagaatgatgtcgtgggtgtttggatattggatggtccacattgggccacattctttcaaacataagagtctgtagaaatatgacctgtaaaagactcttaaatattctggaaactgtttcttccttgtcacatccttatatatacttgaacctatgcctaccagacatgacatgtgactattcatacagatttcatcatctctggtttaagaataaaggatgctgcatagaaggctcacatcttttaattcacaagactgaaactgttctgaaatgacattgtttctaaaaattcattacttgcattatattcatttttatttttccatgccagaagggtagaagttcctgtgctcatattaagaaacagcaatgtcaatcgaggcccaactcaaatccaatttataggagttataaagggcgtgtgcctgttttgtctagaagcagtgttgggcagcactgagtaggatagaccacctgttgctaccgataaaggagcagcttctcgaatgctcctgtctggtaggcactatcccgagtgctttggcccctcatccacaatctgtgtggcaaaaggcattgcaggcaattcagtgaggagaccgaggcatggagagcaagtgccatggaattccctaaggccgtgcagggagcaggttgccaagctgggttgaaaccgtcctccgtaggctcccaactccgccgtcgctgctactgtgctggatgatgcctggtagatgcagatgtggagccccatggattctgagacaggccgggtttcagtcctgccctagctgcctattggctggatgaccttggcaagttgactttcgtgagcctcatttgtctcatctctcaattaagaaaacctagagcctatctgtgggggttatctgaaggattccagggatgcatatggcactgtctaccgcatgcggtaactgtttcacaaatgatgaggagcgatttatgttcttagtggaaatatgtcggcgtgtgaagtcccaaagctctgccctgcctggcttgatccagtgcctaggcactgcccctcttcccctctctcccaacccactgtaagaggctaggctgcctcagtaactctgaggggcattgactcttttcatccaaaaattcatgttactgccccacattttttctgttgttttacaacgcagtaggaagtgggcagactgtcaggaaaagtgatttatagtcatgtattgcttgtgctttggcttcatttgatccaatgcagatcagctgcactcagaaaactactcaagtgaaagagaaaaagtaactgaagggggaaatctggatgagtaagaattccagggataggaatattaatagcaagctttttgcctgatatagtcactttatgctgcaggggtgcccctttataaagtgcttgtacaatggatgtttgcttttgattttggatttggagtctaatgaatgttctaaattattattagaggagcttgcggttgttacatgtctgcctttattgcttatttttagccatctcccctgatgtcaaatgctcaggcaagaatgatacattcatttataatgtggctccttcagaaatataccacataccttttggtgtggtttgtggctgagaagagtggggaatgcacaagtggaaaactgcagaaagattatgccttcatcacttcaagtatttgagatgaaactagatcatttgctgttgctttttattctcattctaagtgcttttcaaagtcagcgctaagattttaaaatggttttctgttgttggcagagagggaattactctattactttctgataaaacagagtctttcatgatcaaagagaaccaggctctagtagttccagtatcctaacgtggacactaattgtttccctccttttcttcatgaaaacagcttctgcacaaatgatagccttgtgaactagccatgggcacaactggagaagcatttagggagctttagtgcaaattgagaccacctacacatctgactctacagggtttgacaacatccagggtgaatcacaaaacatcagtctaatcagggcttatatagaaagagtgaaagaactctgatttcatcctaaagattatttatattaaccattgttccaaatgcattaactattttaatttagttgttttgattgttaaaaaaaacacatctgtttggtagataagacataatttaagacaaatgttctatttgataagcttttagaaacaacttatttttattctttcctgtgagataactcagatgtggagaatgtgacaaaattttaagcataacatgagaagggctgacacacatagatttctgtgtgcttacttgaaaacaacaaaatttaagaatttggtataggagttgtatcaggtagtgcagagtccccaggagacctagagacccaggtctgggagcctagcggcaagggctgaatgtgggatgacatcagcagaaactcacagccactgctattccaaaaacccagcagcagctcagtgcagggcagtgctgatagtacagtgcctgcaatcctggagtggatttggatgtgtcaggtacgcacacgctcactgctcccccagcagtacgttgaacagtgtgcgtccaggtgtctgtagggcccctcgccctaactcacaaaaccattctgggtcagaagccaccaatattgtcatcatcctcccttttctgagaaccctagtaagtccctccagtggggcaagcccaccttttcccttcattctgtggcaatatgccttcatttcctaatcagttttgccctgctcattcaatgcaaaatggatctgctttccttgggcaccaatatgtccagggattgtttatcaatcttcagttctgtttcctttacatatccctccaaaaatcaggcctgcactgcctgtgcactccacaatccacaggcctgaaggaaatgttatctttgatgtagagacttaaagtaaaactcttcaaattaattatttcatgcaaaaggctagtcctgactctaattctaagacatgtctcctaaactctggaagtctgatgtatcctattatcaacatttatccttaatgtgatggtttatcatttatcctcaaagctgcattgtaaaatgtacactgtaaagtgtacattttaaagtcggttttaaaaaatcatatttagagatcctggtaaaaatctatcaagtcaagacattaccttattacccatggaattgtcttcaactcttacagttcaaatattcctgaattggctttcacaataaacatcctaaatatgtaagtagaaacatatatattgccaactttgtgccttcccaagcaaaattaaaatacaggaaaagtcagtttgttttgcccataaataaatatatgtgtgtgtgtatgtgtgtgtatacacatacacactcagaaaagatagaagcagcagcatattttggcagcatctggtttattggaactcaaacgttctgattgtgcatacagactagttaatgtggtaacaattatgtatttcttccctgctccttgccttctttccctccccagtttttttcttcctgatagtaggtgtgtacttttttcctatttccattggcaagccacatgacaagcaaaacgatcactcgaagaatattgttccctcaatcaagaaaaatgcccattgggttttgttatttgatgttatttgatgacagagacctattgtttttccatttttctttttttgttttccgtggcacctatggaattaagcaatataaaaaatctattatttcagatgttcacgtctaatgaatttcatgtgaaatactggcagtataaccccaaatagaggaaatttgtgaagagtggatgctgcagggcatgagacatctgcacagagttcatctcttccagcatcttgcatgtcccaagcactgccctgccaggcagagaatgctgcagatcacggcagtgaattccagttgttcagagcacatttgacttccaaattctcaaggccacagatttgaggacagaacaatatttgcatttgaaattggaagattattttttgcacaagtgcctatatgctatatagagtttgcccactctgcattatcttccccctgttcccccgttatctggcacaagctattcaaaagacacgcctacttgtaaaataaatggtttgcaaactaaggaaaatacttaaatctcatgtaaatggtactatactatgtataaaaatgtgaagaaacacagaacagctcatgaacacctccactgctgtataaaagaaccatcttttttctggctcctattggatgccttagaaaaatctgtatttcctctttagttattgtgtttgaaagatgaagttgagacaaaagttctattctttttaagttggcagaacttctgaaaggtgatttttagctgcagtgtgactcattccaaatgcagaaatctctgaccctgagttagtctatttgtcatgcaagagcctagaaaagccctgagtgataagaaatggccataggccattcccacagaattttcaacaaaaatagaatcatgcttatgttctagtcatgacttagaacttataactcatgttcggaactgtccatgttcacgcacaggggccgtatcactccgccagagctgccctgggtgccggtgtgcagaggggtccgagagtgactgtctcttcctctgttgtcgaatgtgtgggttatctccataaatggctgccatgagcatccttgttcacacatttttaggtacttgagtgagtgtctgtggaataattttgggaagtgaaatctgtggtcagaggtttgtgagttttacatgctacattttcagaagttgagaaatagcagtaggctgaaggcaagtcgccatgcctggaattcatgaacactagttgaaagaactggcgtgagttagtcatgacaggagagatggggaagggagttgcaggtaggagggccatcttcaaattctcaaagtatagtcactccaaaccaaaattcgatttaatctgtaggactccattctcaaagcacagtcactccaaaccgaaattcgatttaatctgtaggactccaggtggcagaataagaggcaatggatgggtggaagcgaaacagggccaaagtttgacttcatgtgcaacttcctaaggagtgatttgaactccacaaacatgaactaagcacctcaacacaggctgggcaagttgctgttcttttggagcttacatcttagtggggaaagagaaatgcctatgtaaacatataaatcagcaggatacattgtgaggacggtcattgctcagtgagactgcaatagagtgatacgctggagggggctgcaagggagaaggtgggagggacagcatttagcagaatgagcagcacagtcccataggaagaagaatttattgcctccttaggcaaataaattcccaaaccttgaacatcagaaaggaaatagattaatgtgcacagaggattaaattatgtgatctgcaaagtcatttaaaatctatttccacataaaacatattaatgcaacctaaacaaaaggggtctggataccctcatcttcttcccaagcatcaagtctttctatagttaaactgagatgcttttattcttggaaaattttaaggactatctacagcaatggaagaatcgggtgttgggatgtgttcccaggtaataatgactgcaggctgatttggcccttgaggtgtggcctcatggccctctccaaaaaaaatcaaggacctgctacaaagcacaaagccgactgcaatgcttgctgcttactggttagggcagctcctctttgccagcgaccaagcagaaagcaagacaagacaggttctgaagcagtaattcaaagccttcctcgctttcccatgtgagtcattgctagtcagaatattacctttgcagagaggcttaattccaaatttgctcttaaagggatatcctctcctggtttaggtataaacttttgactcacaggacaaattctatcattcctttgggcctaggattgcatttatttccatgacaaaagggcctgtctggtgtttcagcaaatgaaaacaaaaatataaagcccatctccttttgaatgagctctaaaacagttctccactggacttcagaacaagagggagctctgggctgctggctggttgtgcatttgctgtgggttccctccggcaggcgacctctccgcgctgagaaggttatccggataaccaagtaagaaagtacatgaggaggcacagaaagaaaaatgtgagagataacagcataaacacacagtgtatgttgttatgaggcatcacatgatgagatactgctggggagggaagaagtgaggagattcctaggaatcttatgagaatttccagagacaacaagttttgagcttttttttaatttagaaaatttaccttatttttaaaagaatatgtaacatatcccatgctataaaattctagacatagtagatttaaaacagcataatggaaaatataaatatctattttcttttcctatttatgtattctgtgccagtaggaatgtagccaaaaagagagaaaaggggtctctgcagacatggatgtctctgtgacttgatcactgctaacccaagaagataataaagcagaagcatgtatccaggttgctgcagccaagcctgcccggtctgcggggcgtcctcacacatggggcagctctcccaccccacacactgggaaaggcggacagaggctgggcaaagcccccaattttcgttggcactgaccccgatgatttataggcctttgtttcccatgttaaatgtcttacgatcattaaattatttatagctcaattagcatgtgtccaaaaccaggaagttcataggagactgtgtgactgggaattaaggagcaaagcaactttccagtctgtgatttactgggtttccattctgtttcctgttcggatccggaagtagaatttcaaatattgcttttcatgctttatttgggaccgattttagccccgctctcctttctcttgccattcgctggccattagccaccagcctctgcacaatgaccagctggcccctggcagatcttgggcccaggtgtgaagtcgctggagaagcatttcagggccaagatgggagtgatttcattttccattgacactatgcagaaatgaaggggattcaagtgccttcagaaaagcttccttccagcgaatggagttttgggggttttccagacttgcaactgcttttattcttggaagcatcattgttgctttttccccccttccatttatatcccaggaactgattcagaaaccatagaaattggatttggaatcgctgaatgctagcagacagctgactgcactcttcccaagaaaccctgccagctgggttcgggtatcgcgcggtgtgtgctctctctgcctggcccgctgagtcctctaactctaatggattccttcttacaccaaagtgcactagaactaaagtgttttgcttcattctttagacattttgtggtttagggctcaatcagccagggtatgatttgcaatccacagtaaccggtttcagagcagctgcccagcgaggcaggtttcatctcgcttgctagacgttttgtttttttttttttctaaacctcacaccttttatttattagacttggattccagtttcctgagcctgtttgtgccactgattagacaggcttgaagcagaacccaccaggcttcctgaataaaatgcagcagtgattgtattagggggttttaaattgctcaaaatactgtctaaaaaacactaaaaatcatgttactttctagattgaataaaatcctatagaaatgaattcctggacttgatatgtagcaagctggcattggctcgggagtgagtgggctcagttaagtgagctaagatgagatggtgcacaggcgagcacccacctgaggagtgtttggatgttatgatagccagctcctctgtaaagacctgtccttctatgtcagcagcccagcagataaatgacgtgtaaataccacatttaggagggcttatgatgatgccaattaatggagacctttttgaaacaggaaggaggtgaaacatattcctttgcttctacatcactgtgtgccaggcactgtttacagcatctcgtttaaccagcagtcaccacctgacggatggctgatgtggggtggggtcccagggtgggattgcgtgatgggcttggggtctctggctgatgggtgccagagctgggactggaactcctggcgtgactgaggcagacacctgggctacccagcctcacccacgacgccctcactaagtgacccacaggactcaccggaagcagggcagcaaggtccccctacagaggtccccactgcaaaccgatacccagcttagacagcagttctgcagtcggcgtctcaccccttcgggtctcattgtgactcactttgatagccacacgatttaagggtggttcagtagtgatttgatgagtgctgtggctcagggtcattcccctgcccaagcatttcaaattccagaagttcatgccctgcatggtgggtgaaaagtctcaggccaaccatgagcacacagcagccaggcgactgaggcagctgcccggggtggcacgttgctcaaacccatcatttggagtcaaaacaaacagatgattagctggggtggtcactttcaatcaagagttttcacatcgcctagacatggcctcagaatcaggcctggtgtggccaggggctgatctcacagtagacaggaagtgtggcccgagggccatggctgccccctcagaaggccctgtggagtggctggccgagcctcagcagcctcctgtgaagcgaggaagggtcttcctgccggcctctggagatcagtatgggaatgcacaagtaggaaacgctggatgggaatccctctgccctgtgataccaaggcagtgagtttgtagactatggaattgctgtcggagggctctgtaaccggccaaggtcacacaggtagccattggtagagcagggactggaatcccagacccccaacttccaggactgtgcacctttctttatcccatacagccttacagtcaagtgccagtgcaacacctgattcccaggttccagcctttgtcttttataatgggaatcaaccttatcttgacgatccagagatagtcatcaaggaagattaaattatccccttagactcagagtgaccatatcattttccctccacacaaggacacttttgagaatgaaaaggaggagatgtctgtaccagacgctggatgacaggcaccgacaggctgtctgccaggggagcagcgattcctgtatgttgtagaaagtttttcaaaagtcaccttggaaagaggttttgttccttaaccttctgttaaataggaagctccgtgaatgaaaacaactcccttccctaaacattctagtaatgacccaacactgccaagcctgccagctctgcctcatggtcgtgttgactgtgtgagactatgtgagtgcctgctacacagtacgctttcagtaaacatggtattgcctcgataatcccacaaaaatgtcctattcaaatcacctggcacccaggaaatttccttcttttttttcccaggtgaaatatacagttgaaaacacctgacagcaattcccctctcccatgtgtttgcaggatggtggttttggttcctccatctttgatgtgtacaagtgtgatgttttccccccacagacaagtaaaccacattctcttcacattcccaatgttttgtcaatgtacctccttcaatagaggatcgataaggaaaaaaatcattgacaatctcaattagattcactatttcatccaaaagcatagcttagaactctagtttttgttcaacactcttgccctatgagtgcacagaactttaattctgatacaaacatccctgaatgtttagctttgacagagattccaaggtgatttgataagaagcagggctgtgtttgggctctgggagtttttgatatggtttcaagccccatccaaaacccacagacctctagaaagtaggtgcctgccttcctgcagcagccctggagcctgctgggggctttgagcagctgctgccaagccaggcctcacccgacactctgatgggcacggccatggtggcaggggcttggacgctgccaggtgactctaacttgtggccagggtgggaagcactgctccacagaggtgccaaaaccaggttccttcctgtgttctcacatttcacagcctcaatgtaaaaagtaagacatgggcactctggaatattacaaaaatatagaaaagcatgttatagtaaataaaaggctcacagaattttgtcatttaggaacaatgattattaatatattagtgtgtgtttttgctcattaacagtatatcctgagatatttcctataccatttaatattttaaaagatgtttacactggccacagtagctcatacctataatcccaacactttagagggcaaggcaggaggatcacttgaggcttaaaaattagccaggtgtagtggcacatgcctgtagtcccagctactcaggaagctgaggctggaggatcacttgagcccaggagttcaaggctgcagtgagctataattgcaccattgcactccagcctaggtgacacagtgagaccctgtttctaaaataaataataaataaattaaaacatttaaaaatacatgatgtttaattattagaggactcaattttatatctatgtatacaataatttttaagtttcttaatattggacttttagtacctttttaaaaatactatttttaaaaaaatctgtatttctaactttttataacaaggaacctttggctttgagatgactggggaatccattctttcctatagtatccatgtccaatggacttaaagtattaatcaatgtgtttatgttttgttatttttctggcattacaaaaaattctaaatatattgttaccgcctgtataaatatcagcttttgagagaaggacattgtgtagaaataatgaaacactgcaacttgtatttgtattattcttttttttttttttttttttgagatggagtctcgccctgtcacccaggctggagtgcaatggtgcgatctctgctcactgcaagctccgcctcccaggttcacaccattctcctgcctcagcctcctgagtagctgggactacaggtgcccgccaccgcgccgggctaattttttgtatttttagtagagacggggtttcaccatggtctcgatctcctgacctcatgatctgcccgcctcagcctcccaatgcactgggattacaggcattatattattctttaaattcacatgagaatttagtatggcttcaaaaaataccataagttaaaatatcaccaagactctgttcagacaaaagtatcagaaaagtgagccaggcactcacatagtttatagtttataaaagtgagacaggcatgatctcttaacctcactatagtcctgtgaataaggtttatttacatttcattttacctgccaggattattgtaaaaacgccaagcacattgcctacacaaactaaatattcagtcaatggctgctattttcatgagttcgttttaacatatatttattgtcctctactggatttaagaagttatatttattatcatctaagattttagctattccttctcttaaaaatagattttataatcaatggcagtaagggagagtaactcgcagttctctgaatctcaaggggttcctggaagccttcctgaaggtatagtgaaatttcagcttcacattcccatccatgagctccctgcaaatatcccggtctgctctcaggacccagtgacttacctatgcagaggctgtagatagcacctggagcttcctgtgtgccctcctcaaactcagccaatgccgtcatacagtagcaggcaggtgtctttgctgggtagttggactggatgtccctgggattgcagaactggaatggggagtgacatcaggaaactataatcatcaggacaacatggtttgccataactttaagttttaagcgaccgcagattatgcggagagagatgcatgcccacagccatgcttcccatgtaactggagaggggtctgaagtttgaaacaagtgttcctaggcacgggttacagtgtttgttatcatcatacttgatttagaatggggcacaacatgtggattcatggtaactgttacaaccttactcattttaatacctgaaaacatgctttccccatgctgggaatcgaaagattctcctaggaaaagaaaggcttgacaacatcgattcaaaaagggcatgcattttcctcatttaaataactctaatgtgcaagtagatcccctgacctcaagctcagaagagtccaggccttcacaccttctctgcttctgctctggggccagctattgagattcctgtgcccacgcaatgcgcacatcccacccctggccgctgtccacaagaaatccagttgcaccaagcaccccactttttgcacctctcatttatgtactcctaagagcctcaccacaactcccttctaaaaacatgagttcctgactgggaattcgatgctgcccaggcagctttgctcagagggagcagccttctagaaatgtttcaagtaaactttcaagtataactaaattcaaaaaaaacacatacacacacacacacacacacaagtcaaaggtgtgtaatttggccaatatcacaaaccaattagccctttgtaagtggcacccagatcaggacagctgaccataccagcaccctagaagcaccccgtgctgcctcctgggacagggctaccaccatcctaaggccagcacgatgggccagctttgcctgctgttgaattttgcttacatagaatcctccagtaggtactcctttgggtcaggttctttcactcaacattatgtgttgatatttttccatgctgtgctgcaaaattgtatttcttgcattccataactgggcagttccatcataggagaataccacactgcgttcgtccattctaccgccaatggacatatgggttctttctcttttcttgcagttacaagtttatgaatattgtcccacgtgtccctggtgaacttttgtttgcatttctgttgggtacctcagagtggcgttgctgggtcagagggtactggtcgctttagtagctttgaaagatattgccaaaacattttccagcgcagttatagcaaattatacaccaccagcagtagaaaacatctcctaattgctcacagtaaacccccaaagattgccacatacatcttccatatcaattacttaactattcagcaaatttgaagggaaatatatttaatctttttattcaaatagtttataaagtggaatagagatgtgggtaaaagttgtcttgccacctttttagatcggtaaaagtttgttgaatgcaggcaagaaaagatgagaaataatggtacccaatgaaagacatagcagtctacaaggaggggcatttcccggggtgggggggacccacactctgtaactcccacattcaattagcatgttataggtaagctgcagaaaacgaggcagcttgtcaaagaggaacggctcttggccatggttgctgccctaggaggatatttgatactagcagagctggggcaaccctggaggaaaccacctggaatgatgggagaactcctccagggaacatggccctttaatagatctctgttataaaaaataatcccaaagcagccaccagggcatactgctgcgatcaagtcctaggcggtattcccttctgcgccatagaccctgtgcagagtgccctcaacgaaggagcaaggaagaccaagtctcccgagggtttgcatatgtgtatgtgattctgcagtcatggtgaatgacacagtcagggctgcggaaaagcattggtaaagtgtatatttgaggcttcagaagtttgaaaaggctagatttcctaggccaaaacactgaaaatttgcaattagaacttcagtgctgatgctgggaagactggagttagtttgagacatgcacctgtgcagaactgggcccccagaaaaggagaaggaagggaatccagaccagagtagggcctgacaccactcagactcggcgtgtctataaattagaattgcgttacaattacactttgacattttagtggtttttaaagtgcccagcacaagttaatttttcattaatgaatcctttattcataaaatgcttagatggagattacccttttgagcattttgccagtgcttctgaaattaatggggacctcctgttggaggacacagtctgttgcaataggtgaccactgctctgaatctatgtcacctctccaggaccacgggcacaaccatcacctgaggcatgttggagatgcagatggtcaggccctcctagaatctcagaatctgcattttagcaaagtcctgggtaattcctatgtccattggagtttgagaagcactggtaatctcaaatactttaaaagattactagagtaagataggctcagtaggtacctgaaggcaccatcccaaagaccagagtggtagaagcaggtggaccagcctctgaacacatttctcccccactccccggctgtgtggaaggttgccacctttggggtagtcattcaacaaacacgtgtcaactgtccactatgtgtcaggccaccactgggcactggctgtggctagctggatagacaccatttctgccctccagaaatgtcatgtccactggcacatgacaagtcactaagtcattcagagccatgggtgacagctccaggggccgacaaaggagctgtgatctcacagatccacagagaagtgtcccagggcgggcgggaaccaggactgcacagggaggggtgaagtgacacataagaagtcagcccatcagcctgaaatgctcccccaaatcttcccattcagtgttttctcagtagcaaactcgtgggaaaattggttattttacttaaaaaactcatactagaaagctagtttaactttaaaaataaattttaaaaacatttttattaacaaatcctacctttcctccaaagtcaaggagaaaagaatagaagtgaacaatggaccaagtaagcctaaaactctgctctttcccctgctcattttacagttcaagtgccattcaatttatcctggcaagaagaggaaggcatcatcaagaccttaattttctaatacatctgatctgagaagaatgtgaaagctataaaattaatttttgatcaataactacaggccttttgagagagtgccctcctaatgaattgagtacctatttctccatacacagtgtctatcatgacctacaaacccttttcccatgaggtgtaacagagagagattacagccttggaactggatgtcagactctcctggtttaagacaataagccatgacatagagcctgaaaccaacacaatcttccgagtggttccagaaacatataggggataatgttggctctgatgctgtacatccccaacaaccatcaactatttggaaactagaatttcagcataattggagttggtgttaccctagcaaatgctgtgggaagagagtctcactgtgtatcttctcctgtttaaagcctgaatttgttcagaatgtaatatctctgtttagccactctactgaaactgatctaggaaatgttcaaaaaaaggtatcccaaggatccctttgtagctacatctgtgggattcccctcgctctggcgtggcctggcccctctgcatttgacaatacggtcctatgcttttgtcttcctgggctgcgtgaacccaccctgccctggttcacctctcctcttgacccatccttatcagtgtcttgaaaggtccttctattggaggacacattctgttgcagcaggtgaccactgccccaaatctgtttcacctccccagggccatgggcacaaccatccctggagtgtgttagagatgcagttggccaggtcctccaaaatctcagaatctgcatttttgcaaagtcctgggtaactcctatgtccatgagagtttgagaagtactggtctcatgagttcctgacatacaaatagtgctgaggccagtatgctgactgggtagccagatacaagtgaaaaccttcctgttttttgcaaacctggatggacccgaggccgctgacgtgggccaggacaagctactctttttcagtgtttctgttgcatcgctgtgtctctctgtgatcaggtgctgccctccctggcaggaggactgcagacaggatgaccaagagcactctacacagcctgctctccagtgttgggggacgccacccaccctcgtggttcctgttcatctgcctacacgtggagggcccaagagggctaatatgtgactatctccacttcctggtaccctgtgtgaataacttcacttactaaagggatgttgagcaactttattaataatgaagaaagcactttggtttgacaaataatcactccattttttcatttgaaagttaactcttgttagtagagaaagcaatgtattacaaccacaaggacgtttacatggaaatgaaccatctgcaaagcatcccccattttccttttaaatcagccaatgggtggtggtgggagaaatattcaccagagtatttaacatctatcccccttcctagactgtcagctccatccgggcggagactgttggtatctccacagcacacacagggcctggcacacatccggggctcagtgagcacttgctgaatggtgaacagattagctctcctgggaacgttgttgacacatctcataacactggtttggagtggagggcattcatcgggctgcatattcctatttttaattgtattctccactggttacagcacctacagttataaagacattgttaacattgcttataggaagacatttgatggaaatgagtccaaaggcattacggttagaaactggccaggtgtcatttttgagagattagataactgttttccggtagagtgaattgcctgtttgttgcaagttgggactttgctgggctggtttacagggccaaggggaaagagataagtggatcttctagtgagaggtcatctgttttgaaagcctggaagattccatgaactaaatccaagtcttacaacacagggaagtgtgtcatactgtgcagggatgaagtctccaatttagcatgaaaacaagagctcctcacactgtcctcttcagaaagcccatacaatccaaacttctgaatgcttagctgcttacaaccatacatagattgagggataaaactctgatatggaagagaaggtaaacattttttggcagacattcccaggaaaaggcggctctcttctctcattgctgctgctctttcagaatccatttcaacagaggaggagtcaatgggagccccgtgcctctggcagatatcatatggcgtttcagtggcattgtgtgttacccttcttaggtaacagctcagccattagaagaatgtcctacacaccttctcattttctgtgatgagaggaatgtgaggtactgcccttcgagagctgtcatttgtcctagtagccagcagcgtgactgtgctgtcttctgctctgtctccctgtcagccttctgcccagccaccaccactatagttttgttctctccattggaactcctggttcagagaattaccataaaaaacagacccctagacatacaacactctatcacataatggtgactttgtcttctattttggattactgagctttcttgggtaacttccactaaatcgaagttaatattagaagaacttcctcttactagaatcgaaaagcatttaagtgatgcagtcaagtttgtaccataagtaattcagtcatttaacaaatatatatggcctctgtgcgacagtgaccttgactgggaatgaagctgtcccatgtggggcctgttcttcaaaggcagttccctgctgcccagttcagtccagtggatctgggcatctctctttaatccgcattaggggctctttactgattcttcactatccaaaaagacttggaggggagacctgagcccacttctggaaggaaatgataacaatttatttagataatctttgtgcaacaagtcaattcactgaagagatctgctctctaggagcctctgtgaccccaccataactgggaaggctctacctctccagtcttcgggccacatttctctctggcctgctgtcttcccagcactctcagccttgctcatggagcactctagtcctccgtcgaccttggcctttggtaacgtgatttttcacctggcagctcccatctggtctcactccctctttttgtccagtctgcatgacacagcctcacatcgttagtgttccctcactcccctcttactgcccaacctgcaaagtccatgcctgggccagtgcagcatgtgtcctcaatgggctgctggtggcagtggggggaaccgcacagccacgctgtgtgctgctgaagaaatgcacagcctcctaccctcgccctcaagaggcagccatggctgcgcatttctgcccttctgagctccgctcacttttggcagcagccgttccaacctgcatgggatcttcactctctcacagatgtgctgactcctcctgctgcctcccctctctgtgccttctcactctctgttccctttgccctttctccccttttctcctctgcctacctccaagccatccatcacaggacagctcaagcatcagatcctctgggacactttccttagttgttcagtctgatgaggtgtccctcatcctctcttagctgaaaatcagcagctgcctcaacttcttttccagcatgtctcatgagtattgccacaacagcatctgtcacaatgtggggtagtggctgacttgcttttctgccattcaactgagttccctcagtgctggggccagcgtgcagtgtcttgtattcagtatatagctgattaattgatgaattgattaattaatggttcacactagcacagtgcaaccttcaatgcaaagatctcatcaaaataattcacatggtgggatattttagaaggatgaccaggctagtttgtagtaagaaaaaatcaacaagactaggtcaggaattctttttttgtctacaggcttgctatagaagatattgaaaatcatctacctaattacctttattttatcaggttgtgtattaaatatcacgtctgggggaagaaaatgtgatatgtgattacagacctttcctggtacaacatagtacgtttcagattaactcaaggtattgtggtgatattgcggtcaaagccaggtgattaaagagtcattctttgaaacaaatatctgtgcaatcaattaagaaattaatttgcaaattttatttgcttagagtaattgatatatcattccttttacaaacaaatataaagaaaacttaactaaaaatactgcatatctctttcagattatatatcccagaaaggatatatttttctcctttctggtcttcctttttggtgtagcatctgtaggaaatgcatttcttcatagctaagtgtacctccttgtgaaatatcttcagagtctactggtgcacataagcaattgctggcagcagcttgagggtctccatctcacatttatcatatgccttattgcatgaggctttgcaagaggaggtctagagctacaatatctcatggatatgaatgtcaattcaaatcccagtggcagtttatgagggggaaagcctagaagagaagaaacctagaggaatcaagcaggaggggagagtaataaaagactagagcagcaggtttttcttaactcaaactagaattaaatctctgtgtgtgtgtgcatgtgaatgtgcccgtatgtgcatgcatgcacgtgtgtaaatggatgtgtgtgtgtgtgcatgtgtgtgcaagtaagtgtgtatacgtgtgtgggcatgtattgtgtacatgtatgtgtgttttatgcatctgtttgcaagtatgtgtgtatgcacataaaagtgtgaatgtacatgtgtgcttggtgtatgtgtgtgtattaatgtatgcgtgtagttctagagtctagttagagaaagtgcataaagaaatagggaaattaacaagaaagctatagcttaaattataggaaaaacttttctccctatcagtcatggttttaaaatgttcagacttgatatgtttcccagtgctattgtcagaaaatgtccctatgacattccatactacttcaatcaaatctaaaacctttgttccaacatgttttattgatatgagtatatttcaaatttctaccaggtttttggagaggtattttggccataaaattgactaaattattcaaaataaaaaatgaataagcctgggccaaggcttggagacttgcttaactcagttcttaaattttcagattttcaaaattacaaatttaagctctaaaatcatggtgctgtgtatgatattctttgattgcaacttatggttgaaaaactatagagggctttatgctaagagttgtggatcttaggattttcatgaaatctgcattatcatcatctgcaagtttagatggggcataactgatccaaaggatggatccctcgggggcaattcaactggctgattccagccaagatgacaacagtcaggatccgttcccttctgatcatccattgggtgccctgatttcctctacagccctagctgaaagaccagacactatctcaggctggctgccccacatgccttgctccacaccaaattcacagtctataaacctgagcctccagtgctcctactaccatactcactcgaacattcccgattctgacctggagatgtcaacagctacttgatgccactctcttctatctttctgtagctaagccatccccaagtttgtcgattcaccctctttaacccctgtcggggtgtccattgtgccccttcaccctgccatctccctggtgcactgttttgcaaagttcagcatacatgagcgtcacctgggaaccttaataaagtgcagatgttgattcagcaaatctgggatgccctcgggctgcatttccagcaggctcctggggatgtccccgctgctgtgctgcagatgacactctcagtggtgggactccaggctctgctgtcgcctcctaggggtttctccacactccctggaggcctaatgggcccttctccacatggcagtaagatctgtttttgtgtttgtgtttcaagttgggagaaggagattatttaatactaaaatgtgcaacatgggattgagaaaactaattattagtcataagttgagtatgcaacattgaaaccacatgctttaaaaaattataagaaaaaatcatagtatttgaaagttacaagctattatggctaactccatttatctcagttagagaagaagagtcacctgtcaccagggcactgccagaagccaggctcatttccaacagcactgggtgctccagctttggggtgccagctcctcccataaagcaaacacatacctagggatgatatttctttgcaagggctctgccctacagcttgtacatctcaagaagttatgtaattaaactgtctgttttgagaaaattgtagattcacacatactagctgtaagaaatgatgcggataaatccagcgtaccagctttccccacggagacgtcttgcagcgtcacagccaggatgaggcattgacccaggcgaagtccagagcacctgtgcgctacagggccccttgcactgtgctgtcacagacacgcccacttccagatgccatctaggaccccctccaaaaagcagaggcattcttaaaaacacacatctgcacatgttcctcttcatttgaatctgtcagtggcttctcagtgcctttcaaatgaaatctaaagtccttacaagccttgcagcaggaacctctccatcccacttcccctcacactctcagcttcatctctgctaggctctgttcagccaggcagcctttcacagtccctctcctcctgccctgccaggaaggtcccctgcccccaactcttccccacatgtggcggggccccgcttgtccttagaagcccagctgaactgcttcctgaaggaacccctccagaacctctcagaccaggtcaggtttctgcactcttagatcatccccatggcataatcacagttgtgatgttgtgatgattcagtgaatgtctgtctccccactggatggtaagcttcctgagggcaggaacagcattggttccagtcaatgctatgtcccaggactgttcgtttttgcacatactaatcctaaaaggacgatgacaacagcaaccacttacatgacctagatgctcttctgggtgttgtgcaaatattaacaatttaatccttgcaacaatccacgagggaggcattcttctactcccacttaacagacaaggacagtgaagctagtaaagagaagtcatttgcccaaggggaccccactactgttggcagagctgggtgcaaacgcaggcttgtgaagccaggacccatgcattcaaagaccatgccaggtgcccccactgcacacctcatccccacataccagtgagggggagagaaatgctcctgcactgcctctgattaactgctttcctagaagtcacacatataaaagggatttaattctagtgggattgaatctcaatagtttccttattaggttgatttctgttaatagtttaagtactggatatacatgaattagaaaatctagattattagcaaatgcaaactataaagtattttataaatgttatcttgtttgtcaggggatgagtgagatattcattatacaaaaagtagtgtggattttgaggtagaaggtttactaaggatcataccgtagtatgaaatagccacaaacattcagtgaaaccaaacacccccgcttaacctcaaactaacactaaataataaggaatagacttgggggcagtgcaagtgtatttctaatggtgaaaaccattccccagtgaaaactaatgtaccatctagttaataagagctcctctgacccacgcacatcaatacttacatcccaatggtgatgtgacattttgggttttgtatttcttttgcaaattgagctagcatttttgatgagtggcagggctctgctacccaacctttggacagtttccaagcataaaatcacaattccagataattctgtcacaaagatctgggtctcattaggaaggagaggaagctgggagatgatccagtccaacctcccccaaaccaaacatcacggccttctcagttgtttcaccaaccatctaaatgttttagtaattctaaaaattgatgcgctttttccacgaaaggaagtgttaccacattttccaagtgggaggcatctatatccttactccttcatcctctccttcccaccccctcaccccccaccacccacacaacatctgcaattcttaaactaaagcacaaattgttacaaaagttaattgcactttcaaaggaatgcttgtatagaaactttctcggcttcaaggaaaaataatacgctttgaatggctgttcaacagcatagaaattagctgagtagaaggcactcatatagccattaggaccaatcctttctgccgccaacaccccccttataaagacttgacagtgggccagaataaacaacttcaggatgaattcagttgagacacaaagtacacacttccagtttttcccttctctggttactggcctcaataaccaggcagtcaacttaaaaagaaaaacaaaagcttgcttcagattacagattgcagacttcttataatatgtccatttcaccaggccccgctctcagccccgggaaaggccactggaaaccacctcacatggtagggccttgcgggagccagtaataaccttatctccgtcaacatgttctgtcagattgaatggggcagccagagaagccagagttggcacaggaaccaaaacaaaggcttcccatcctcctggagtgagcggttgagcctggattggtgcttagacctataatgggtgcaagcagcgttcattcatagtggctttctagacccagggacttggccccagccctgctgctccactcctcttcttgcttcattaccacgagtctcctagaccaccgaacgatgcctgcatttgaaagacacttctgctgatcaaagcagctgatgtgtccctttgcggttcatttctaattgtccccaaggaggagaaattcaaatagtttattactgagagttaaagaaatccactgaaatattctttggtctaaaattactgtcatggcggagcagcttcaccttagtcattgcccttaaatatgaaagctatttaagaaagtttgcccttaaatatgaaagctattttaaaaagtttaatgaaagaagagaatcacaaaacattttcaaaaagcaaaagaaaacctaagagaaaagttgaaagtaggaattttttaaagaatatacgacgtgtgttctgtgactcacccctgcaagttatttgtgtgtattcccttgcatagtaattaataatgaagcaaagcatggcaatgatatcttttcttgtctagtattctagaagactccatgtttttggaaaatatcactctagttagatctcaaatatattcaatcagaaaatgggttttctacaagattctatatctgtagtcaatagcaaatataattctattaagctagtaggatgtgataggaaactaaaacctaggggagaccaaagcaaggaaaaatacttcctcatccaaacttgagagcaatttaccgtcaggcctactattaatagatggaatacagattccattttcattactcaactgccatattcattattacactgtacagaaaagggaatcacatctgttgaaaacttatatatgatgttcatgcatgcattccagtaattcaacaatttttatttatctttttattgcttgctaatttttcaaaataataagctaaagaaaacaaaatgtttgtgctgttctcagatgacatgttatctctttaaaggacaaaatgtgctgtgaaataatagaatgctttcagcactcaagtgtgagtgagtgctcatacatgagagaaagccgtggggactacagaagccaagaagcagatctagctggggaggcctttgcagaggatgtagttgtgtggagaggccacacacgtggaattcccaggagggctgtggaggcggggaatctgcaggaaagcactggggtgagaaacgtgatgagaaacaattattgtcttaaaatatctgcagggctgtaaggtagagaagcaatacgttgcatctgtgttaagtcaaacaaaattatcaagggactggtttcagcttaacataaggaacaattatgtgatagggttgtcaataacaagagtagactgcttcttcacacactcctagtcactcagaatggtccaggaggagtggacaaccatttggtagagtatgggaaggcaggggccctgggtgggagtggtgagggtagggagtgagtatcccaatctagaagtaaattgtgcccagcacggagctgcaacactgccctgcacacaaacacacacaaataacaatccccagcccctgcatttccctctccggtttcaggaccttgtatcttacttcaattcctttatttagctgatgatgaaataggaagagcttagcactaagaaaatccttttggagtttggccttgggggaaaatgaatcactccaaccaggtctgtcttctagaaagtataggatgaaagggctcctcatcacatacttcctgacctcctgctaggcctttccctaaaacaggggctggcaaagcacaacctgtgggtcacgcctagcctgccacctgtttttgcaaataaagttttattggagcatgactatatgtatttgcttacagtctgtggctgcgttcacactatcccagcagagttgaataattgggacagggaccatatgatgggtgaagctgaaaacatttactctctggctgtattcagaggaggtttactgagcccttctctgagacatggcaagcgctgcttcaggctcatgcttcactagattcaggcctggggcagtaaagagccagctcaggatagcactcccgactcactcattttttcaggcaggggagccatctaatgtcaagtgcctacgtgcaggaactggtctgttaattagcagctctcctcatggaagggataatatattctagaaacaggagtgcggccctattgcaagaatgtcctgagccaaaattaagattcttctatggcagaaacttggctggggcttctcctgagttaacttggtagttgttagtgatttttgagtcagtttttccttgtcaacgaccccaggaatgagtttgggattacagggtagccagggaaagggaaagcttcacgcccgcccccgggacaaggtctgtcttcacactgctacatcccttcacccactttaaaatgaaacttaaaaggaggatttcagttgagtaggaagtgagaagagggctcattttaaaacaagcgttaaatgaaaacccacacacactcagagcacacaaatccaaccacgcttacaaaaccatcacagagggtcaggcgaggcccttttctaaatgaaaaagaacaggggtggagactgttctgagagcatgctgggttccctgaagggaattctcagctgtatgtgccccgcacaggatccctgctagacacaaggccagctgccttcctttcaagccgcagacgcatccctgtgtccaggcgggctggtcagctgcggtcagcaccagcttccccgctccatggtgaggtcatcacaacatgtgagcaggagggcaggccggcaacctctgagtgcttagagaaagggacgggattcctcctgtgcaacccctctagtctcactcagactcaagtctgactaaggggccaggtgctttgaccagggactctcccctctcacttccctcccaggagtcacaggtacatgagtccttgttttacaaatgaagaaaacagacccaacatgattaagatgttgccttcataggggtggcaccaggattccaaaccatggactccactgagcccagtgcccactgacatgtgccagtaacagtgcagctgcctgtggttctgtcgactaaactgccggcagaggctggctttccaccttctttttttttttttcactcttcaaacactttatgacatgaacataaactactggctgcatcgttctgctgacaacatgacatgtttctataacttgaaaaaagcaagcagtggactgctcattggtaaaattgagtcagtaatcttttaggaaggttatttttcttccttttactgcttctcatctgttccccgcagtaaagaggacaagatgacgacgactcagggaacacctccagcctgaagcagcaccatgcgagcttagaccttagggtcggcttagaaaccacaggcggggcggcttgggcccctcggacactccctctcgaagctgcttctccccaagctaccccaaaggcactgagcgccctctgccccccagcaattcaattcactggctgtcctgctcctgtcagtactgagagttgcatgtttgaccctcgggggaaaagtccagaggccctggggtgtccagcatgctctgaggtccctgctgctgaccccttgcgctgtcagcattcagagacattcacacagcacagcctcccaggctaacagctgtcatggaacagtggagcagctagacgtggccattctgtggcccagtgctgcagaggtcaaagggacaagcgcagggagcatctttgctttcagaaaaaaaaaaaaaaaaaagaagcacactggtgcactgacctgctcctggtgtctttgtgattgctcttttctttcgatttttggttgtctttttttttttgaaagaggggcttttatgcttttttcctaatgttcatgggtaaaccaatgtaaatgtgtgtatgtttatagagatggctttaaatcgcaattctgcagtagagattgattttttaaaaaacatgggtaaaaattgaagaaaaattttaaaagaacatttaaaccatcttgggctaggggtggatatgcaccaccccacggaagccaaacaaaatctctctgcagataaacatttgcaaaaagaatttccaatcccaatttttgagtcagagatcttttatttccttgcaaattacatatctgtttcaggatttttgactataagaagaatgaatgaagatgtgtttcttacagataactatgaacaaaccaggaaggataataacttgtatcccccaattcgaatccagaggatgggaaggcataaaaaaaagaaatggaagaaactttatttttagtggtaaatggtgggactatgtattttacgtatggtgaagtcaccaagcccaacacttggcacttgtaggcaaggtagtcttctaatctgaatgtgaagtattatgttttcatttgcttggtaatgaggaatattggtgctttcgtcccagttctcgagctgactgacttctctttctgacgtgtgttcctttagcacacctctacactgcatggctctgagatgtcctgtgactgtttcatgtgtaaagttgcctccccaaaggactcacatattccttcagggcagtgagtacttctgattcatccttagcagctaccttcgcgctactttactagatatgttgtagttgaattaatgaacaaaagaacaagcaactttggtgcctggtgtgcatctcagagcagggtggagtgagcctggccaaagggtcatcatgcaacctctgtggctgactccatctggccacggagcttctcagccatgcttggtattcacatgacttctagggcgacagctcaaccagcaaataaacagcttcatatgggaaatattactcagcctttgtcatcaaggagtgagtcacgggcctgaactgaatagaagatagaggagaaaaggtgtgtggactgggtgagacagcgcccagcgaggtgaactcccggcagccctgcctgtctttacctgcacatcaccttgctagggtgccttcggttgtgagggcctgtctaggaagagaagagttgcaccctggcaggcagcactgagctgtctcatgcaaagctgaggaagaaagagtgagctgcccagtgagcctgctggggtggtggaggctgggctgggctgtgcagtctgcagcccccagcagcccttggcacctttctactgcctggtgctcaccagctctccagtaacaaagagggacgtgaagtcagaggggaagggaggtagcacagggcagtcttgactttgaacaaagagctggcttcctgaagtcagctggccgggttttgaagccgattttccagcagtgatctttgatgccaaccccatttaggaattctgtatctccccctaccttctaccagatgtctctgagctcacctttggtgataatcatgcaatctccgtcatccccacgtccacactgccccattctgtcccaccccgggttctgtggtgctgtcggctccccagcgagccaggaagggagaggccagctctgctggggctcctgccgccctggctctgcactgcccttctctggcaggtctgaggcgccactggaggagccacacggccctgaagcagcaaggcagatgccctggacacagtggaggcacagagtgcaagcaccggcctggcccacagacttttggaggggaagtggtattattcagttcaaaagtatgcctgtgtgtaaagagagagcccctgaacatgagtaagcaaaagtctcagcgcagagattagacaagtagaatgctggcccgagaggaggcgtttactcaccctctgtctaggaaggaaagccaggcccagcacgctcactgctatctatcctctcacacagagggattttgaatcgaagccagcatcctgtcctttctccaatgtcccctgctcaggagtcaggactcagcaaggcccaccccagccacacacagatacagttccaggactcagaactcagcgaggcccaccccagccacatgcaggtccagttccaggattcaggacacagtgaggcccacccgagccacatccaggtccagttccaggactcaggattcagtgaggcccaccccagccacacacaggtccagttccaggactcaggactcagcgaggcccaccccagccacatgcaggtccagttccaggattcaggacacagtgaggcccaccccagccatatccaggttcagttccaggtaaatcatctgccttcctccgtccaaaagccttgtttcctgtgtgtccttgtgtttaaaatggaaacgttatgagaaactgcctgccagggcaaagggtgctgcccggcacacagtagggactcaaaatgaaactattgtattgaatacataacagatcaacgggtattgctttctgaaatcttttttagcccaattttgtttcttatagtccaataacaggtcaaattcatttctgatttactagccattcagttgcccataaaaaatggaaagtgatttaagattattagtttaaaaaccaatgaaggtaaaacagttatcattgaaggcacataggcagaaatagattgcaatagttgctgccatgtgaagcctcagtgtcatgctccatatttagagagatctatgatttctgaggccctttcatgtccatgatctcagtactgctcacaactgccctgtgaaattcgccgagctggccccatgtcaatcagagtacactgagcactgagacccagcatgttgagataactggctagagatcatcccataatggtaccatcacaatcttcacactgtagaagtttgatgatgtcactggaagcatattccacagtcccttgtgaactggccttcctgtgatcagaagcatcagtgaactcccaagagggtgggaactcccaagaggtattctcactctacttagtgtatattttacaaatcacaagcttggctttggattcttttaatggctagaaggagaatcatggggttggaagtccaccagtttgggtattctgttccctaactcaaaataaagagatgttattttcaagtcttctgcttgttaacttaattagagatacatgagtttgcagctgtgctgggcatgccgcagcttggcatgtttagtccagaaggcatattataatgtacatggaagattgtcagaaattcaaaaggactttttgagtatcacatgtgtattttcaagttccaatatagattcacattcagtttgacaggtatctttggatgcctatcagttaagaactatttattagttgtggaataaaatagggtaaaataaggaacaactgaggaaaaaacataaaatttgctttgtgaataaaagttgtcttcaaaattatgactttttccatcccacaaaagttttgattaaacccacaatgaaaatttaaataagtgtatttactttggtttaaccacttatttcattatgactcacaactataggttttctagtttccattattacaaactattgtgtggtttaaatcaatttcatagactagtctagttctatagtcacaatttataaaatttttttatgtggtaaattgagtgtcttcatagatgtacatgattatttctcaatttttaaggaatgtattttttaagatagccttctttagccttctttaacactgatttttgtaaattttttacagatttttttaaatttttggtaattttttagcataaagtaatacatggtcactatggaaaacataaaaacacaaaaactatgaagagtaaataagaaaaacacccagaaatttaccattcagaaaaggtcattgttaacaacacggtgtatcttcctcctgtcatgcttccgtgcatttgagcacatttgagatgtgtatacatgttcactttgagattttagtatagcaaaagaaatgaccggtcctgattcaatgaaacctctggcaaactcgctatattttccttacatatttttaagttcatcctataaatgaactatccattcatcttatttgagattttcttaaatctttcagcaagaaagcgggaaaaaaatcctcctctggcctttaaagcctaattaaatatatgactaagctagaaatattttataatgaccaaccagaaagtggcaaggactgtcactcttcccatacagcccacctcctcctctatctccctcaggcacacggaaacgagaaaggcagagaaacccaggacaagtcatccaagactttggtcacatggccatccattgctttcacaacaaaaatataaatccaacatgtgtgtgtgcatttcataccagtaggtccaataagctatctatatatacacatatgtgtacacacacacacacacatccttacagacactccccagcttactacagtttgacttaagattttttgactttacgatggtgtgaaagcaatgcacattcaatggaaaccatacttctaatgttgaattttttatcttttcttgggttagttgatgtctgatatgttactttcttgcgatgccaggcaatggctgggagccagagctcccagtcagccatgcaatcaagaggctaaacagctgatactatacagtggactgtgtcaccagcattttggggatattgtgttttgtgtttttgaatcctatcatgtctacaaaatgccattttcgactgctattttcaatttagggtgggtttatcaggacataaccctatggaaagttgaggaccatctgtatatctggtagggaaagatggataacaaattcataggcaaataataatttcatgattattattaagttattcctacttaataataagtagtgatcactgccagggagcagagaatgcaggataatgtgacagatgtaatggtgggtacttaagctaatgtagttgcagaacaggcttttctagagggtaggcctttaagcgtacctcgaagatgcaaaggaagcaaagatgcgaagatctgggctggggatggaagcagagacaacttggaggccaaggggagagactgacaacagcccagctcatacctcagcagcctttaatgcatagctaagaaaacaacaaattaaaacaattatagtttacttagacgattctaagtgtctaagtggatttgggcaaatctggagaaacttgttctaatactgtgtcttaataagtaatatagatttgcccaggcttgtgggcagagtggtatacaccccataatagcagaggaaggccacagggcctaccctacaaaaccagaggcatttaaaaacttaaaggaggcagattgcttttattttcagttaaaataaagtgaggagtttctcaagaaaaataataacgagaccaccggcccgccctagatgtccaacaagaatgcacagataacttcgtatatccactttcctgaacctgcccctgacagccaagtggagcacaacaacagagatgaacctcaaaactactgtgctgtgacataaggcttgctcaagaggacagtgtggtgtgagtccatctatgttctaaagcaagcaaagctattctgtagtgaaaatggatcaggacagcagttgcctctggtgtatgggggcagggatcgactgggaggggcatgagggatgacagttagggtttcgatcatgacaggaattcagattactccagcatgtgcatttgttaaagctcatcaaatgctacacttaagattaatcctctcacagtttgtggatgttaccttaaaaacaacaatgatgactgcaaactaatattgaactctggttagtgatataccaatgtgaagtatagtgatatctctactttactttaaaatgcatccaaaggcagactagaggaccatatctgacagacagaaaaatagatatgtgataaggtgaatgtagtaaaatgctaacataaggatgtttgcggtacaattctttcagcttttctatacatttataaatcataataaaattttaggacaaaaagttagtgctttgaagtcctaagtcatagggcctgctgctcttgatgcagtagaatttgtcttcagatttgcaaagggtaaggcaaaccactagcattttgtatggaacttgatgcaaatacttttaattgtctggttttcaaatgtatagacttaaagtaatatcaactctttctttgaatcaactactgaaatacctagtcttaaataaatatttttatgtaatccttaaagtactatgtattcatttttctttcttctttcttttctggtttgataaatattctataaagtaactgtgtttaatggccaacatttgagtaagtccatatgcagatccaaacatctcagtttagacaataacttaagacaatatagagtggctgacatcccctaacgtgggtccagatgcatgttatgttatgtttctgttgcattctcaatagttaactttaataaaagaaagtcaaaagcttatatattttttcaatcttcaaaacatttctgggaggttgtcttagttaattttatgttgctatacccatatcacagactgggtaatttataaagaaaataaatgtatttggctcatggttctggtggctgggaagtccaagagcatggcattggcatctgcttggcagctggtgagggccttcatgctgtgtcaatctatggtggaaggtcaagagagcatgcatgtgaggtggtggggaagagaaaaagcgggtttaactcatccttttatcagggactcactcccgtgatagctaacccattcttacatgaatggcattaatccattccttagggcacagctctcatgacctaattataatacctcttaaagtttccacctctcaacactgttgcattggtgattaagtttccaataaacgcactttggaaaacacattcaaaccacagcagagatcaacgttattgtcaccattttcatatttgaggaaagcatggcacagagagcttggagaagtacttcaaggtcacccaatgaggaagtggctaaacaaaaaccttatcttaaattaattaaaaacctcttgctctttgcagttttgtcttaaatctacctaatttgtgactgtaatttttaagtaatttactcatataagtggtctcacattaaattttctcattgctttatatttctaacatgagatatttggtataaggatggaaccaagatcataccttgttttaattagaaaacctagaccaagtcattgtgatcctcatcctagatttcagttaaatgctgctgtctccttttgggtatgtgacaggggaaagcctcagaagaaacaaccttatgtgttttcttttgatactttagtaattaacccaggatagtattcaagattgacatgccttatattgaatcaaatagcatatcaactgccttcttattctcaagtatagacatgttgggtaattgggcatttaagtttctttgcaattttttccattattaacaaaattaatgagcaacattctgcataaggtctgtttcctcagaatacgtttcccaaagtggaatcatcatgacgtagaatttaagcatacttacttgtttaaacaaattgtccagttgcttcccaaaatgttttgtgaattaagatttacatcaagaatatgtaatgttgttactgtctcccaaatacaggatctttttctgaatataaaagttatacatgctaattgtagacaatgaagggtcattatcctcatagataatgaagtgcttctaatacttgtgcttttattcatttattcaaaaagtgctaaataagccctgaaggggcttttggggggtcatttggggcttatttagcactttttgaataaataaataaaagcacaagtacagtttttttaaaatactgttttctataatagattaatcttaaatggcatgttttcctttattttactgacaaaagttacttactctgtgattgaataataaaaattctttggttcagctgagagaaacttgcaagctgacgtccttgattatttaaaatgaaagcagctgcctgttttcatctctctgcatcctgaggaaactcttctgcaacgtgttccagccctaggttctagctgaccctgttcatctgtttggcacgaggggcccaactaacacttgcggctacctggacgacagccaatctagttggaatgagagttagaggccatagtctgtcagctgggaaagcagcttttattccaaggtgtgccaaccgaaaggccacatgttattgtcacaacctggtacctacatcagtgctgacatctttaagaaccttagaattgggaaatcagtttagccctatctgcatgtgtagccgacaaccacacaattgttccaacttgaggttgcattcagagcaacctcatttcccccatactcctgaggaaaagcagaccagagacgctgggtcaatccagagttatggttggaaaaatgatggaataattctgcccctggtgataggagagagggactccatcttgtcaactgtcatggttcccatgtgaaagctatcattatcactgaaattgaatgagaacacagaagggaagaacagggaaatccccacagagttaaagaggatgtgaagattgcttcatgtttaatgtttgtgtaagtgctttgggttggttatgtgctgtctgaacatgtgctcatttccatggctcattgagagggcagacagtccaatgatactctttagaatcattcccatggggaaggaacaaagaagcctgtaaaatagaaatgcacatgtaaaaagcattgaagaaagtgccagtgtattgattttggccatggtttgtgctctaccacctggttactgtgattgcagaagtgcctttgcagatgaggaagaacctggccaaggctcaatccaacatccaaagccagaggccatatttcttcactcttaagataatttgggttcaaattatagtccctttacacactctctgcctcaaaaggcccaagactctcttttgttatgcttgcctaaacatgcctttcaaagaactagttctgtaaatacaactttattataaacctctcctttgcttttaaaaatggatcaccacgtccatttctatggtccaactttgtcccttaatttaaaattttttcttggattaagtttgatgccttgaaacattaggaactcaagcatacaagattgtatgctggtggtgagggaagtaactgtgcctccgcctgtgctgggtggatcaacatggagtgtggacgagcatagggatgtgtgggtttctcactagctgagagtgtttttaaatgttgtattttgatgtttgttattttctgaatattctacagttagacctttgatttattctttgatgcattcatttgaataatatttttaatctccagccagttaggtttttaatttacacttttgtccctgattttaggtgtagtgttgtgtacactactgcccagtgtatgttatgtttgtaaacattcattgcacgcacaacaatgtgactcacaatatttttgagaagtaaaaagttcattatatagttattaactcaaccctacagttatattcgtgaaataccttgtgaaatttattttttgcctactggagctcttacaggttaatcctgtcttcaagattttcatagaattttcatctaccacccacccctttaaatttcaacatttttttattttggcattttaatgcaattcaatgcattatagggacaagctatctcttattatgaattgcaccttatataaacttaaagatcttttatcacaaatttctttgctgtgtcctttagtgagaatttgtattatcagtcactaaagctcactaagttagtaagctttgcgcccagatgacctgggcaggaatgggtgagtctctgtgtggagagagtgaagaaactgctacccttaatacctggaccttgagggattgttttattttagtttttctgcatttctcagtatttcatgtgatatctgtctttttcttccagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaaggttggtgactttgattttcctacacaaataaaattggagaaaatctaagtggagaaaggcctgggcagaattccacttgaagtgtgtttatttttgctatggcaatgacaagtcttacagagctacaaacgagagttttatgagaaagccattttaccagctaatgtcaagtaataactagaaaaggatatcaaatagaaacaggctaatctggagttccatgtcatcatagacactgacgtttatccctgaccattacctcagtcatgatgtgctgccatactcgctcttaaaaactttttttaaaagccctgctttgcaccatttgcctattcccttagtgtaaatactcctactatagctgatttcaaggtaccaagtttcactcagctggtcacagaattcttatttcacgataggcgctaatgaccccataggagccagctctgaaggcttcagagtttcactgaattttggatggggtttacttagccttcttctgtttttcttttacctttcctttttaaataagaaataatgcaagacagatacaaagtaattctttttaatttccattttcactggagagtgttgaaccccgtgaggcatgagagcacagtgttccagaacaatgcttactgctcattatcacaggggtcaaaggctaacgtgcagggattgttgcagatcgtggacatgctgcctcctgtgtccatgactgcaatcgtctacctattttacagttgttgagcactcgtgtgcattagggttcaactgggcgtcctagggctccctggacccattttagaccttgagttcttgagttcctcaaaagagaaatcacgcatttatgttttctcttcttagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggtgagaggctgggatgccaaggctgggggttcataaatgcagacagcagttccgatggctcccagcgagcttgtcactcaattccacctcggagaaggcttttatttttacccagtacacgtgcactgagtgccggctgtgtgtaagatactgcaggggaagttactgagaagatggcagatactggaatgggaagatttaagcggggtaccagtgtttacatggacatgaaaaaatactgagagatagtaagaaatcgtaaagattctgagtaaaagagagtatgaccaaacaagctgagcaggaatcgtgaatctatgtgtgtaggcagtgaataaactgccagtcttattacctggacctcaaggataaaagacatacagtaaaaatcaacccacattgaggacagtttcgagagtcgcgctgctacacagaaagccctgtgtaagttaaggatagagaatgaggtgttctagaactttgaatttttgtgagcaggactcgtgaggttcctgtgagaggaaacaatgaaggatgatagaaaagaagggaaattgattttaaaaaactggagatagcagtgattgtgcctcactgtgcagtgggtttggggccaggaatgttaaattggtaacttcatttaacgcccacaacctttcttcaaagtaggcactgtacagatgccccttgacttatgatggcatcctatctggctggaccccgccgagggtgaaggcgtcattaggtcggatttcagggctaattgaatgtatattgccttcacaccatggcaaagtcgaaaatctgtgttaaatcatgctaagccggggactggctgtgctctgccatcgtacaaataaataaatggaagtcaagtaactcccttgagggccccagctagtgaatggagaggccagctatggccaccactctctgccccagggcgctcaacgcccctcctgtgccatgcagttctgacagggaggcagtgctggtaggaaaggggtgtgatgaaaggggtgcccagcagagggagtcatatccggagtgacaggagcccaacaggggtgcagcgctggaacccaagccagcacctctggtcatggctcctcagttcaccgcctataaaattgtgtggttcccccacaccccttgctgctcagagcagccgcgcacatgcttgtgctgtgcgtgcctcctgtgagatggcctggtacaccggttcctacagtgcgcctcacacgctgtctcggagggaggcagcctgtgcgggtgcctggacctccgagccagaccctctgggttcctgcctggccccgtccctcagcagccagatggctcgggagcacattctccaatccctccgtgtctctgtttcgtcatcttcaaaaatgtggatggcatagctgctaaaaaatggtgacatacttcctaggtggtgcagaaaattaagtgactgtaggaacaggcctcagcagctccttccacttccttggtatgattgttttttaaaccaaggctgggattgtatagatgcagattagttaatgtgataccattaatagctaacctagtgcctgctgcagggtgagcctcccctaagccaccgggaagcggctcctgcagcctccctcacgtgtgctggccctcctctggcagtcattgcctgtggtgtgctgaaggcccagctctgactgtgcctctgtgctctcctcgccccgccccctgctctctctcaggtctttggtctgttgtccgagctgccacagcagcctggacatccctgttggtgtttccagccctgtcctctcctgagttccatccacctgtgcatggctttttcatgagtgttttcacggatggttctgctgtcatctccaacctgataaacaaagcaccacgattcagcccttatgaccccaagcttccttcctcagttccttgcttctgtgcatccactgaagaagcctgttccactgtttccctgcactgggtctcctgtctgcaggaagccttcagccctcacttccacactcctctaagatgtgtgcctgtgcccttctggggaagctcattttcctagcagcctccaggatcttcaggggtgaatccctcctttcccacgttggtactctgtacacacaacatgcccattccctgcctggggagctgggcattgcttcatgaatcagaggtcaattttttctctattaaagtcacagatgctcattgcaccattgtgagaatgaatgaagatagtgcttataaatcagccagcaaggtacccagcctcactgtgtcagggtctccctgggcatgaggtggttagagtgtgtgacatgtctgtccccaagcctgtcagctcccagatcgaagccagtggatctcattcatcctcgcagcgcccacagcacttgcacagggttttgtacacataagtcattctgtcaatgttcatgtttaatgtcatcagtggaacactcccactttgtaaagacttgaatgtgttcatccctgacttttccacatcttgttagttcttctttggaaacagctgtacagtttcaccatcctgtgcatccctggagtctacctgtctctgtcatacattcagattcttcttgtttcgtgtcactctcatatccttttctctaatgaaaagctccgcctgggcatgcaaggtggagccctggatgccagcccctcacctggcatccagggctgtagcactcaggaactgcctccctgccctgcctaccccctacatcatgcgaccattccagtccagccaatcagccccttgggacccagcttaccacatgcatatcatttatgctgtgaccactgactaaaccattctcttccttcctccccatatttctaaatttctaatcattgctcaaagcccaattcagagaaaaccctagctcctccatggcaccatcattaacaattttatctggccgccccccgggaagttcactgggctaattgcgggactcttgttcgcaccatggcatctctttagcagaacataaatgcgaagagcacatgcatccttcatgggaatttaaaggagctggaaagagtgctcaccgcagttccattctcccgcagaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgtaagtgtcgcatacacactatctctgcctccagctcctatgggggacagctctacagcactggggcaggggagagaagccatgtttagtaagtcacattaatcagaaacaaaaagtagtaagcaaaatatctgaccactagaaaagcatgtatttaccacggacatagagatcgtttttttgtggcgggtggcagcccagctggttggcagtgcaggccaccggaggcagatcccctgcagggacagcagagcacttgtgtcctgagaagagctgctgttcatggggctggcagcaccagggcctctcctagcctgccctgctgacactggccagactcctacatgcttctgagtctccagaggctacccggccctcctgaagcaccagggctgaatccacccccagctgagggcatgaacactgccacatggagtcacacacacagctgggcactgccatggagaggaagtctgtccatgtttccttgaatactggtggcctggtccctgtcccattccccagtgaggcagcctgtggggaagcctggcagggaaccaggcgcaggtcagcgtggcgccctgactcaggccagcactgatgggggactctgagacgcaagctcacactcacccagctcccctgggctgcgcccgttcctgatcgcttggactttctgttctttagagtaagaagtgatcaccatttcctgcttctttgtttctccacaactgtgcagtggatgcctgtttgttttctgccctcagaacaaaaaaaaaaaaaaatagagctgacgtgaatcttcaaaatcatcaactacagggctttggatttttgtgtatttgttttattttcattttatggatggattgtgatgaaatgcccgtaatacaagattttccatcttaaccattgtaagttacaatgtcagtggcattatacatccacatgggtgtgtggccatcaccaccgtccacacacagaactcttttatcttgcaaagctgaaactctacccattagacagtaactctctgctctcccttccttcccagcctctggccctggcaggcaacagtccacttgatgtctctatgaatttgactgctctggggctctcatacaggtggaatcatgtagtatctgtccttttgtgtctggcttatttcacctagcaaaatgtcccgaaggtttatccatgctgtagcacgtgttaagaatgtccttcctcttcatggctgaataatattccattgtatgttgacactacattttgtttgtccattcacctatctacagacactggggttgcttccatcttttgactgtttgaataatgctgctgtgaacatgggtattgaggctctttgttttatagacatattattccaccagatacccatcctgacacctactatgtttgcaagaaactgaaagctttattttacattgcaaaatttcatattatgagatcaaggttagcatttcctcagctgtctggtggacaatggggaggttaaactgtgcacattttatttttttttaatgaacctggaacggttatggggccagtgtttgccatggatcaggtcaggcagcccacaatggcaggtctccatgttctgtacaacaactgtgggaaagacccacagagaaagtgctggaaaggggaatgatgggtaggttcatgcagtaaaaagattcaaatactacagggcattgaactataggccaatatagcattgctttaagaataaacaaaaaataagacagtaagaataagcctagcaaaatcaaaagtctataaagaactgacatttcaagccaataagagaataattccttattcaataaattgtctggaatgacttaactattaggggtgaaaatatcaaagtgagagaactataaagggtttttaaaaaggaattaggtatgttgggttagtcgcattggagagtgcaaattcaccatcgacctgatacctgaaatttcctccttaccatctagaggcaagttgggaatgctgccaggctcctgtggtaaaggaagctcctctcttgactggtgctttatggctacacgttcctgctcagaatggatctcatttagtcttcaccaaaaaaaaaaatctcatgagatgatttaagtgttttatggacaagatgtctaaaactcagaaaaatttcacagtgtgcctagcttttatgtttatgttgaagttgggcattagaagttagaatgaatgggtttacttcagagaaaattaaatccatcacccactccttgtactatgaattccaaatacatattaaatacatataataaaatatttaatatatatgtaagtgccagaaggaaacataaatatgaatattttgtaatatcaagttgaagaaaagccaaaatctgacatcataaaagaaaactttcaagtaaaatatgttaatggctaccaggaaaatattgtgcaatgtctgattgccatgaagagggttaatatccttgctatatcactctgtgaagtcatctttaaaagactaagaaaaagatgaatctcttaataaaaacctggcccagaacatgagcagcctctctctctcactctcactgtctctctttctgtcacacacacacacgcacacatacacacacacacacaaatatggccaagaaataaagtaaaatgttatttctaatgtaataagtaggtcaaaatagaaaaagaaagcatcacaccttcctttgcaaagtatttgggttccttttgcttttaaacacctgggtcagctggggtgtcgagaaacagaaattctcacgttctgcttgtgggcatatatgttaataaaaccaagcttggcaatatgcctgcaatatgtatctaaagcttcaaagtatgtatagctttgaccaatcaatatcacatttcggaataagagaaaaagaaataatgaaagtgaaaatcataagagatgtagaaacatattcttatacaagaattccttgcagccttatttataataaattttgtgaacaaattatatatctaaaaataagagattggttgaaaaaattatgcagcagccatgctattgataatcatgttagatagaagcatatttaaaggcatggaaaaattgccatgttttatatgggtttttaaggttataacacaatgtatagtgggattccaattcctgtatatacatagacttatatgtctatattgattaactctggatgagtctcatgtcttctttttgctttcttctattatccatattttatacgatgtgcctgcatttcttttttgtaacagatggtcaatactagaatcataaacagatcttgtttgtttattggcaaatgtttcccgttagaaaaagatgcatttttcttttaaatatttttattttatacaatgattacaagcttataatagaaatttgaaaattatatgtgagtacagggtaaaaagttgaaagaatgggattgcacgctacagatctagctgcttttagcacgcctgcgtaggaccttgctttctctagacctctgttgcagtctctctgcctacctcctcacaacgtccatcccccgcggtcactgtcgtgatgccagcctccccggccttcatgtctctaaggagcaccagcgcggcaattagcgccctttgccttggtggtattctggcttcacagtcacatgggagatcaatcgtcagcttttctgtttgaaatctaaattcttcctgactgcaggggacctcgggacccatgaacacctctagtttactatgtcttcacagtaaaagatatctgcatgactggactctttaacaaatttggtggttaacctactctttctatatagatatagcacttcgaccttcagacttctcaatactgataaaaagaaaacacgacagatgacaggaaaacctttgcagctataatttgtaatcggccaattataaaaactgcaaaaattgaccagatagctaaggttttacacagtcatgaaagtgatctgcactgttaacatttcaccctctgtgcaccattctgtgcttctctctggtttggagtctagaaggttttatttacaggctatgacttaacaatcccagaacggctgacacatgcagtcactcaagactggacacagcaaggaagtagtgggtccatgccaaaggctcagccagacgagacactctagctgtggcaggagatgccagggaatgctccaagcctaagcagattgtaaacaaggaacctcaaattcatgaaaaattcttgcttatgtggcccatgtcagtaattactctctgcctcagtttccgcagctgacatgtaaataaaagcagttcatggttcatcttcttttcttatcggggtctcaagtgattctacaaaccagccagccaaacaatcagagaataagttgaaaagattgtcttcatttattgaatgtgcttaactcaggcccgggaaagggcgtcatcagtttctcatcatttcactgagatatgcatctattacttttacatttcaggccaaaagtgtgatccaagctgtcccaatgggagctgctggggtgcaggagaggagaactgccagaaacgtaagtcagtgaacagcctcagacccatgtgtgaccgcccctctcttccttcacttgcttaggtgattggatttgttttccctctgaagactccaaagagttactttattacagggtcagatgtgaaccagtaggtgaaggacagtcttgcaaatctcaccgcatgcagttaatccagggtgggctattttgggagcttcagcctatcacaaataagtgaacatcagcaggggctgggcgcggtggctcacccctataatcccagcactttgggaggcggaggcggtcggatcacgaggtcaggagatcgagccattctggttaacacagtgaaacctcgtctctactaaaaatacaaaaaattagccgggcgtggtggcgggcgcctgtagtcccagctactcgggaggctgaggcaggagaatggcatgaacctgggaggcggagcttgcagtgagccgagattgtgccactgcattccagcctgggcgacagagcgagactccgtctcaaaacaacaacaacaacaacaacaacaataagtgaacatcagcaagtaccccagccctgtcctctgaacacagcacactttcccaggaatggaagacttgctcctgttgacagcagtcaccagacttcttgtttcctctccctccctggctttctttggtacccacctacacagaagcctgagcacgggttctcatggggacttttccatgtggaccctgctttacgatggagagggccattctcctaggtatggttgtctggctcagcctctcagtggccaaggaacctggggacatgagctcaaaaacggacactatgtccttaagctgaattgtgggggggctgttaggcccttctaaacactacttcccagcaggtatttttgttctttgtatgtgctttctgcattgcccaagatgcatctaattatttagcaggtctcaaagtctagacttgatctcatgagttctcttaagtgattaaaaataaatcaggagaaaaaagaggcaatcagaaaagggcatggtttgacttagtttgaatgtggtttcgttggaagcaaatgtgtcttcactttttcatgaaaaagtctgcaagtgctctgcgacatccctgggaaatgatcctaccctcactcttcagctcacagggaacctttgctctttttcagtgaccaaaatcatctgtgcccagcagtgctccgggcgctgccgtggcaagtcccccagtgactgctgccacaaccagtgtgctgcaggctgcacaggcccccgggagagcgactgcctggtaagatgcccctccagcagcctccctggagcaggctggggctgcacccgccccacccacaccaggacagaagacttcctgtgggggagctgtcaattagcatttgtcataacagacaggatattgccctctgcctggtgacaaagtatctttagtatcctgcctccaccactcactgagaccttgggaaaatgatgggactaccatgcctccatttccttacctgacaatgatgcataacaaagtctctcccagttgaatgcttaaatgatgagatgcctgtgatgtccgtcattaggacctgggcacagaacaagcactaaatactacatgcaagtatttgtcatgaatgtgccttgttgccagcagcacactctctttattgtttgacttcggctatacctctagagacttgacactgtgaggtccctaagagacccatggagagccacacaggtcttgctggctggggctgggttagggcctcctgacacggatccctcggctcctccaccactgctcaggcacctcctgagctgcaccctgccctcaaggggtcctgaagtactcactgtcgccccattgctccagaaagtgccagcagaagccttgctgccccagcgggctctgagcagcactggagggtacaggtcagaagcgtcttggaagtcctggagacgccaaggctggtggatgtgactcctggagtgggagctggtgtgacgaagcccttcctaagactaaatccagagcactctgtggtttcagagaagattcctaaattccagagtttggacccagacccaggaattgtgacttggttggcctgagctgtttctaatgtgagccccagggagaagactgtgcgtggggttggtcctaggaaaagccctcgctgtattgggtctggctcctttacacggcattgttctagcaaggctttctgccattcagcaatacattataaaatataccctcaattgtactttataagggaagcccaatgtcctttataagggaaattaaacataatttcattccatagtcaccgctataatgtgtgaactccatcatctatacgttagtaaacagacgtatttttatcataatccataaattatgataggtgggacagtgcacctaagaaaaaaatggactttttagagaagggtctttctgactctgcagagggcgccagctgggttttcccacactagtggaacactaggctgcaaagacagtaacttgggctttctgacgggagtcaacaccgtgctgcgcttcctccgtgtgtggcgctgagtgtacttacctcacttgcccagcgtgtcctctctcctccataggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtgagtcctcctctgtgggccctctaactggtcaggcatccttgtcccgctctgtctcctgctgagccctggagtatcccatcttggagagtctttgggtggatgtgtttgccttgcttggaggaggcgaccctgtgcccgtccaggcacacaggcgaggggaggggctggcttgctaccgaggagcgggcaggtggtggccatctccacccatgggggctgctcagtgcacagggcagatctgggtggccaggccacctcacaggagaaacacctgctgctcagccctcaccactcatccagcagccacagccgtgggtattcagttgtctgctgggcacaaagccgtgggcatgccactgtttagtgcttgtgccaagcaggtatttaatacaccgaaatcagagagtctatcagaagacctgccttcttgagtggttaaaattctagtgaaagttatgcctcttaggagtattgcagaggttttgtttttgtttttattttgttttgttttaatggtttgggtttgagttttgcttgtttgtacttacatttgtactggtggctccagggtttagggaaattgtgacataaaataattcctgacagagaaagcaaaactttgtctaatgaaagagttttagaagccactcttgatctctagaaggggagattaactgagaaaaaaaattgaaagaacaattatgagggggagattttaccctgccagatttgtgtacatgaaaaattttacattccgtatggaaaaaaaaaacacaaaataataagccattataaggtaaatgacaaacaaagctaaagaaaaatgtgccacagtgatgacacagatatatctttgagatagggcttaacagagctttaaaatccataggaaaacacttcgagcctgagataccaagagcagatggttcacagaagaatcatcaatgtcctataaatatttttgaggatcttcttggggaacttaaaacaggaacaggccaggcacagtggctcattggctcatgcctttaatcccagcactttgggagactgaaggggctggattgtctgaggtcaggagtttgggaccagcctggccaacagggtgaaacctcgtctctactaaaaatacaaaaattagccgggcgtggtggcgcacgcctgtaatcacagccgctcaggaggctgaggcaggagaattgctttaacccaggaggcggaggttgcagtgagctgagatcacaccactgcactccagcctgggtgacagagcaagactccatctcagacaaacaaaaaaggaagacatagagctcctaaaaataacgcagaagtctgctattaatacaaatgaattactttaaaggtgagagcaggtggaggagagggctgaggtgcctgctgggacgcaaaacagctggcccctcaagggacccagtgtttcctgccatgatgaaacacctgtattgtccacattgcggcctagaatgttattaaactcttgaacgggattccttctctatttgcaacctttcattctttgtccttaaagtaaataaagccaaaggaggatggagcctttccatcacccctcaagaggacctggaccgcctgtgtgaggcccgagcacctggtgccaccgtcatcaccttcctttcatgctctcttccccaggtaattatgtggtgacagatcacggctcgtgcgtccgagcctgtggggccgacagctatgagatggaggaagacggcgtccgcaagtgtaagaagtgcgaagggccttgccgcaaaggtaggaagcccgccggtgtgcggacgaggcttgttctcggctgctgaggctgggctctcatgccacctccaaaggaacacatcttcctcttctcattaaaaaacaactatacatatcgtttctttaaaacagaagataaagctgtaaagctaggttaggcaatgggaaggcactgaaggttgtgacggggtggggggctctgatgagaacagtcacagagccagccccgctcagcagctgccaggtgcccagccctggggagaatccagggaaggcagagctggaagcagtgcagctccaagcggcccatgggaaataatgaggagaacgcaaggtcagtgtgaggtgacagggatggcatctcctacaccgccgtagccccaaagtgtactataggtcctggtgtccccccttcccgcctgcactctccccagccccttcagtgtttgttgagtgaatgaaggatgatgtggcagtggcggttccggtgaccggaattccttcctgcttccctctgcctgtggatccctagctattcttaatccaacaaatgtgaacggaatacacgtctctcttatctctgcagtgtgtaacggaataggtattggtgaatttaaagactcactctccataaatgctacgaatattaaacacttcaaaaactgcacctccatcagtggcgatctccacatcctgccggtggcatttagggggtgagtcacaggttcagttgcttgtataaagaaaaacaaaatctgcctttttaactggtagagattggtgatcaataatcaccctgttgtttgtttcagtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaatggctgatgttttgatatttttcaaaagtgcagtttctcctgcaggcaaaaggggacacgttaagtccaggcttgggtcattcactgcggtgtaaacacgctttctccctcccgcccggccccagccagctgccttggtggcccataacccctgagggtagagggaggggacaggggtaggtgacaggcagcctgggcctcaggcttttgaaactggacgccagagccttgtggggccacgggcaagcctcgggtctatgactgccgcctgagctccgcttccttcctctctaaaatgggaagattagaccaaaataacaagactgttttaaggttggaatcaaataaggaaaatttgtaaagctccttgtatgtgataccagatccacaattggcagataatcgcagcaggagcctcttcggggtaatcagatacgcggcgcagcaggggtctcagggccacagccaggggggcggcgggagacatgcggaatcgcagcggaaggcgggaggcagctgtgaactgtggctcggcctgcgtccgccctgcgcatgtacactcagagaagatgataatgaaaaagaaagcaaatccaattttcccacttactgttcatataatacagagtccctgagagtctagagtaatgtctcatacaaaaaagaaactcctacgtggtgtgtgtctgaagtctttcatctgccttacagggtttttgctgattcaggcttggcctgaaaacaggacggacctccatgcctttgagaacctagaaatcatacgcggcaggaccaagcaacagtaagttgaccacagccaaagcctggtagattacatttgcctttttagttggaaattaggcttaacaggagagttgctaagatagggcacagagctcctgcatctctcgccggcattcccaaatgctatctcacatgagcaggcacagggagcaagactgcacgaccactggcacaggctgtccgctaaaccacagacttctcagcgctcgccagtgcttctgcttctgtgtccactccagatcccacattgcacttagttgtcaaatcttttcagtccatttctaacctatattagctcctgtgtctttccttgtctttcacggccttgacacttacaaaacgtgtgggtcaggtactttgcacactgtctaaccatgtctgttcagctggtgttttctcaggatgcaattgaggttatgcacatcttatcacagggaccagagagactttttagcaccactcttcaagaatttccactttttcagctttgacagtggaatagacatgcaggtgctcacacacaagcatctttaatatggtaatggtaatcatcagtttagtggtgtggaggaggagatgggaatctcttagtgaaacccgccttggaagcagcctcgttatgagaactgctgcccctacttgactcttaaagcactagataatactgtgcaacattaaagagaataagagtgcgtgaaatatgcattgcctcccataaactcccttggctctgaatctctgatactaaatatgtggctaccgttgcttcccagaaaggcctttttgctctgaattctctggaatgctttctttgaccaagattcttataaaaataagagatttagagcaattttcttggatggctggtatgagccagttggcttagttgtagggatttaaacaagataagggttacttacttttcacatttaatgagaagtctggtgattccagctcctactgagacagggtggccacacgttccagggtgtgactcactgaggccccagacctgccctgcaaggaaaacctggctctgccctggtgtcctggcctccctgggcatatgtgggggagaattcctaatggtattggttacaggctcctatgcgagaccactcatctgtgtaggagaaaggaaaaagatgggggaaagaagagcagcagggagaggagaagcctctggatgatactctaaccccctgccatccaacacctgaacatcagtctcttcatccagtgctctcagctggcccagcccccagcctggggtcagatgagagcttcctgcaaatgcagatctctttcctgtggctccttctcaattacagacagctcctccacaaggtgcactctggccttgtgctccctccccaaaccagcccagccctcccagcctgcatcatcgtggtcctgtaggggctagaggttctcacacccatcgtggtctggcagaggctggtggttctcacacccatcgtggtccggcaggggcttagtggttcttatacccatcgtggttcaggaggggctagtggttctcacacccatcgtggtctggctggggctagtggttctcatgtccaccgcgtgctttcctgctcctccaggtggctgaggacatccccccttcggtctgaatgacttccatccagtcatctgatatacacattggaccacccaatagcatcctagtgtcatgttggatggtgaagaaaatgccacagttactgctttcagggcctcacaaccttgggcatagctttttggaggaaggccccacttcccaggcatccctcccagacctggtcagaggcccctgctctttgcttccatgttgcccacactcactgtgctcttcacaccggctcaaaatgatctgcttacggggttgtgtcaccaccagatcaagcgtcctggagaggaggaaacatatttaacctgcacagaatttgggacagagaacctctagtgtttgttcaataaatatatgaatggatagagggacaggttgggtggtggatagatggatgaacccacacctttgaagtgtatttggctgtttgagaggttagaatatgttctcaatttccaggcaaaatgaaaatggagaaaatataatgacattaaggcattttattcatcctccccatctgccactgggttaaagatactaaataaacaaggaactatcttttgcctggaggaactttaaaaacacctgcagttttcaaaaggtgcagtgtgtgcctcccacagcatgacctaccatcattggaaagcagtttgtagtcaatcaaaggtggtctggagaaacaaagttttcagggatacattgtttttataatttttcaccacatgatttttcttctctccaatgtagtggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcagtaagtcaccgctttctgtttagtttatggagttggttctaatgggtcctttatttgtatttagaatattgaagggctattcccatttaaattacttttttcagttccttaagaagcaaattaaaatcttaagattcctaactgtgaaattaccatgtgaattccattaaaactttttccagatcattaccattcaatgggatgaatttaccctgaggtttaggctaccaattatttgtaatgtaagtaactaaatttagtattagttatattaccttttagttgtaggtcactctctgctcatttcagcctgtaaagactacagctacacacatacacacacagaggaatggaatgagcactttacatcaacacttcctgttctggctctagagcctcagcttttgaagctggtgagagcctggcctgtgctgggccttggccacgggcagcgtcagctttgagtcaagtgctggtctggcctccctagctttgagcctctgtcaattcccttaatctgtttaggctttggcttcctcatccatagaatggagatatgaatgattcctacgccgtagtgctttgagagaattcagtgaaattcctgtgtgtaaaacccttccatggtgcctagcacacagcacacagccaatggcccaatggctcctatcagctgtgggatttgtcatcagaacaccaccagctctgctccaggctgccctgggtaccatcaaaacacaccctgtgcccagcagcacctgctcctctgcacacctggttccttcagcaggggcagtggccgtgggagcacagaaaacatggagtcccatctggtttaattgatgccattgccaaaggggaggactcacggcaccccctctcgggtgccagggtgcctggctcccaccaggaggaagacctgtcctccactgtcaggcacatttcagtcttcccagcagccagcacaactactttgtccttccagtcacggtcggcctctgggaagcccagtctgtgtcctcctccttcaggggtagccagcatgtctgtgtcacccaaggtcatggagcacagggcccctcccgggaaggtgccgtctcctccggcccctcgggtccctgctctgtcactgactgctgtgacccactctgtctccgcagaggccacaggccaggtctgccatgccttgtgctcccccgagggctgctggggcccggagcccagggactgcgtctcttgccggaatgtcagccgaggcagggaatgcgtggacaagtgcaaccttctggaggggtaggaggttatttctttaatccccttgcgttgatcaaaaataaggctccaggttgttgttatagctttacaggcattctgtttgattttctcttccttttattctttgcccttggcttttggaggttttgggttttctgtggggagacgggaagttgtttgattgcgttatttttggcaaatttaagcacaataggaaataagcaagtattattgcctaatataatccaataatttatagaatctcttttcctggaagtatcttaaatttttctaagctacaaaaagttcctaagacaaatgagacagtcatcaatggttcatctagccaacaccgtggccatttgggcttttctttgtagtgcccgattcctggtgtgtgaaaataaattaacacaaattatattgccaagttaatatctgttttatgtgcccccagcatgtgttgaacatcaaacagtaccagggactttaaatatacccacggacaaagaaataattcataatgatgtttgttgaatttagttgcaatcaataaaaagtgcagtttgtgaatgctctgaggttcttgatattgatgtaaggctttgaacgacaaatgaggacaaaacataaataggaaagtaaaactgaaggatagaggccaaggccatgttttagaagatttaaagaaaaagggaaatttggtgagcaccataggaattacagatggctgtaggaattcttcctgttttactctctgggcatggaccacagcttggatccagaaatatttaggagcaggataagaggaccaagttcaattctataggaatcctttagctgataggctcagaacaaatcacataattgatagtgctgcttcaacttcaagtaaggaatattgatgcaatccttacagctacaaatggacagtggtctcatgttttcagttttcaagtgtttcttaagaggcaaggtgatgaaaacgcccacgtggggagccccatgtccttccattagtgtagagaaacctggtgtccagcagcacctgctccctctgcaagcccagcccccttcagcaagggcagtgacccagagaagaagcacagaagacacaaccctgtatcacattttgtttaatggtgccattgaccaaaggggaggatgaaaggcacacacttttttgttgttttttgagacagagtctcacgccatcacccaggctggagtgcagtgatgtgatctcaactcactgcaacctctgccccctgagttcaggtgattctcctgcctcagcctcccaactagctggaattacaggtgtgcaccaccatgtccagctaattttttgtagttttagtagagacggggtttcaccacgttggccaggctggtctcaaactcctgacctcaagtgatctgcccgcctcggcctcccaaagtgttgggattataggcataagccactgcacctagccaaggcacacactttggagaataaacactccttgttcgctgctggagggtagaactatgcttgactactaggcagagtccagtcttactgacaaacagccgtacatctgttctgtcttttcaatcaaacatcagcttcttgcttaacattgatgtgtacatcttgagggatgtcaaaatattgtaagctaagtttttcatacctgtgttccacactcaccatttttagtaataaccattgagcgagttcattctccctccttcctttttctatcacttaatctaaaattatcatttttccagcttaattttgataaccatgaatctggtattagaggcagggaacacctcctcaggactatcttttcttttatcatttggcttgcttacccaatatgcaaaaactatgctgtagaaaaagcagaaaagatatcttgattatgaatgaagctcctgtgtttactcagagagaagatgacccaggattcagttaacaaaatcagctgattatattactatatagtcctggagtcccaactccttgaccattacctcaagttatttggaattttgaagaggtgatttgtgttcctgcaataatgtctcaggggtgggctgacgggtttcctcttcctcctctcagtgagccaagggagtttgtggagaactctgagtgcatacagtgccacccagagtgcctgcctcaggccatgaacatcacctgcacaggacgggtaagagccccttgctgctatccacgtccatttcatgggaagggccttcacagaagccgaacagtgatgatggcccagggcatcctgtgtgggcaggacggccatcagagccacttcccagaggagacggcaggcgctgacagcgctgtccgggcagggtgtcggtgacattagcacacacattagcctgcgatgaacattcactctttctgctgacacccccaaccttatctaagcttatcaaatcctcacatttaacggaggctgttttcacctggtttcccccatccctgacctagtcagcattgctttatcgctttcatcaaacatcctcaaattcttaacattagcttgtaattaattgaagaatttttaaagaaattgctagcaaaactttttaaactgcacaactttgtatctatatgttcaataacatatagatacaatattctttacaataatcttttaaagaatatgagtgagaattcgggcccctctcacaccaaatgtcctgatgttgttaattctcaatgttattatatagggagctctgttttcttgtgagcttcaacagccagttctaaatctactaactgaaaacattttttagacattctctaaattgggcagaagatgacaggactgtgttttgagggataggctgccagcgtggctgcttacaaagtaaagacttggtttataggtttgcatggtgttgggttaaatttctgtcattaaaataattggcgatattgacatagtcatctaattatgctggctctgggcacacacagcccttgagtggacaaaaccaacatgagagaacttagccaaggggaaagcctttccctgctggttttatttctgctacttctgaagtgtggggcacacaacctgagcagtgcttttatttgagtcccaatgcttttatttgagttttgcaaggttattccaagttttacaaatagaaggtagcgtatgactcagtccttgatatgccaaccactgcacagagacttgccaccttcctgtcactggagaaacactcatgtgggttttcttaaatttgcctccctctgagcttccctttaacttcaactataatatgcaagaaagactatctgaccataaatacacatttgggccaatcaagatggttttgccaaggaaagatgcccacaatggttaagcagaatgcaataatgtagagaatatcatttctttcatgctggtgtatatcatatgcattcaaaaacagggagaacttctaagcaactaacagtgaccatatcaagcaggtgcaatcacagaataactggttttctcctttaagaatttttctatcatttggctttccccactcacacacactaaatattttaagtaaaaagttacttccattttgaaagagaaaagaaagagacatgcatgaacatttttctccaccttggtgcagggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacgggtgagtggaaagtgaaggagaacagaacatttcctctcttgcaaattcagagatcaaaaatgtctcccaagttttccggcaacaaattgccgaggtttgtatttgagtcagttacttaaggtgttttggtccccacagccatgccagtagcaacttgcttgtgagcaggcctcagtgcagtgggaatgactctgccatgcaccgtgtccccggccgggcctgtgttgtgcaatgctgcacatcacaacaggagggtagggggacaaaagagcacaggtcctggcagctgccacagtctccaggggcttttgcgtttctctccagatttctaaggttaacatggggattagctgttttgcaatgaataaaaggtaacattgcctggaatgttgcttaaagacacttttttaaagctagttgattgttaagctgttgctacttaaattaaaactactttgggccagacgcagtggctcacgcctgtaattccagcactttgggattccaaggcaggcagatcacttgaggtcaggagcttgagaccaggctggccaacatggtgaaaccccacctctactaaaaatacacctgtagtcccagctactcaggaggctgaggcaggagaattgcttgaacccgggaggcagaggttgcagtgagccaagatctcgccactgcactccagcctgagcaccaagagcgaaactctgtcgcaaaaaacaaaaacaaaaaaaaaagctactttgactggaattagcagaagcactctgattgtgtgtatcttatttactggaataataaagctgtcaatcaaactggatcccactcaacaatcagaaagagaagttgagctgtcatatagtagttcacacttacttctgtttctcaaaatcctcagctttgtttggaactgttactcattctttctctgaatccatctgtatgagttgtgtgcccttgggcaagggtcttaccttctctgtgcctcactttcttttctgtaaattgggataataatgctgcatagctcacaggatttttatgaccatgagttaagatatgtcatatacttaaaatggtgcctggaaaatggtgaatactgagtcaatgatagcatcattgatggtgggatggtgatgaggaggtgggagtcacaatggtggtgttgatggtggtgatggtggtgaggaggtgggagtcacagtggtggtggtgttgatggtggtgaggaggtgggagtcacaatggtggtggtgatggtgttgatggtggtgaggaggtgggagtcacaatggtggtagtgatgatggtgttgatggtggtgaggaggtgagagtcacaatgttggtggtgttggtggtggtggtggtgaggaggtgggagtcacaatggtggcagtgttggtggtgaggaggtgggagtcacaatggtggtagtgatgatggtgttgatggtggtgaggaggtgagagtcacaatgttggtggtgttgatggtggtgatggtgatgaggaggtgggagtcacaatggtggtgatgagggtggtgatgatgatgaggaggtgggagtcacaatggtgtcagtgttgatggtccgatggtgatgaggaggtgggagtcacaatgttggtggtgttgatggtggtgatgatgatgaggaggtgggagtcacaatggtgtcagtgttgatggtggcgatggtgatgaggaggtgggagtcacaatggtggtggtgatgacggtgttgacagtggtgacgaggcgggagtcacaatggtgtcggtggtgatggtggtgaggaggtgggagtcacaatggtggtggtggtgatggtggtgatggtggtgaggaggtgggagtcacaatggtggtggtgttgatggtggtgatggtggtgaggaggtgggagtcacaatggtggtggtgttgatggtggtgatggtggtgaggaggtgggagtcacagtggtggtggtgatgagggtggtgatggtgatgaggaggtgggagtcacaacgttggtggtgatgatggtgttactggtggtgacgaggtgggagtcacaatggtggtggtggtgatggtggtgaggaggtgggagtcacagtggtggtggtgttgatggtggtgatggtggtgaggaggtgggagtcacagtggtggtggtgttgatggtggtgatggtggtgaggaggtgagagtcacaatggtagtggcgatgatggtgttggtggtgaggaggtggaagtcacggtggtggcgatgatggtggtgaggacgtgggagtaacaacagtggcagtgacggtgattgagacatgatgatgatttgtcaactttctaggaaaacaatcatataatctccaacagtgatatcttaatatcttttccaaaagtatcagatcatattataagggccaagtttccagaataatatcagacataatgacagtggacatcagagcttggcatctaaaggtaatgggaatagctctaatgtctcagcgtgaaaaacaacatttgctattagtctgagatactaattatctagttaaggaagtactcacctatacctagtttttaactgttttttaaaatctggaattgattttgaattttaacaaatatttccctgggaacaatgtaagattcttcatattttcgcctttgggtataccaacatgccagctctgttggccactttgtgagctcgatgaagcatggtataaaagatgctttgctagtgtttcacgtaatctatttctataagcaattttggagctaagcctctgaaacagaattatattatctgtatagaataaatgttttatcttcccccttttctttcttctggaatagatgtgcatcagtatctctgcatcaatatctctatatcagtatctctgtgtcagtgagcatatgttgctgggcttaggggaggtccagaaagtgattgggttttggcattttcaatacacttactttgtataagaaatagtttgccaaatatagaaagaggggatttagtcaagatttaaattaaaaatgttagtggtcatttttctaatgtctttctattttttcccaggtcctaataaatcttcactgtctgactttagtctcccactaaaactgcatttcctttctacaatttcaatttctccctttgcttcaaataaagtcctgacactattcatttgacatatggaattttataaatattttctttagtatgtgtgattacattcctgattctgagcctttttagatgagtatatagtttgatataatcttgttattgccacctgtgtcttctcccaaagccattaattatataggaattacacgatagaaatgggtttaatttttaaaatacggccaagtgttgatgagagggaaaatttttttaatttctttcactgagtatttatgacgtgcacaacattcctgaatatattgtctctctcatttctcagatgggatgtattgccttctccatttctattgttaaagaaacacttacaggggtttctttaacaacttgtgaacagcagcatcagagcccagactacagcataagcagctgctgattccaaaagccctaccttccaaccgggcaggtgcagccacccagacgagggggaggaaccctggaggaatagctatttcttttttttttttgtcgagacggagtcttgttctgtcaccctggctggagtgcagtgccgtgatcttggctcactgcaacctccacctcccaggttcaagcaattctcctgcttcagcctcccgagtagctgggattacagacacctgccaccacgcctggctaatttttgtatttttagtacagacagggtttcaccatgttggccaggcttgtcttgatctcctgacaagtgatccacacaccttggcctcccaaagtgctgagattacaggcgtgagccactgcgcccagcaggaatatctatttttaaatggaactgtgttttcatagtacacggtgaggagaaagttgctttgaaatctttatcctaataaaccaaataatatgaaaatttgcctattttaattatatgtaacaaagtttagttactgctataattgcaaatatgtataaattccttaccaaaaaaaaaagaatcaagtgggagccagagaataatttttctgacagaattaaataacatgctatagctgcttgagttcatactcaatagtcatttctgcagagttaccgagggcctcatcagcgtcagcaggagcccctcgccttctgacgctctcacatccttctctcctgcagccccgtcctgccactgtccttgtccagcttctcttcaagggtcaactggtctacctttccctacaagtctgtcacagcttcttgttagcaatccctatggttgcccaaaagcattttcagagcctgcataagactgcatcttgtagaaaatttgcagtttcaatctgccctccctctgccgggtgttcccattgtattgcattcagcaggcagggagagactgctattaggtctgttcctgagtgactgctttctgtctcagactgtttggtgtctgtaggaggtagtggggtgggcagtaacgaggtctcctgtatattccacccctacgaagcctgtgtgtttggtttatgaactaagctcaaaagcaccacaggggtaagactgcagtacatgacaccatggaaaagagggagcacccagacccccaaattaagaagagcagtgtagagaacagagacctggagagcagagatagaaactgttaggatcagattatagtgttacaccagggctccccaggcctctcacatattgaaatgtacttgtccatctttctccaggccaggaaatgagagtctcaaagccatgttattctgcctttttaaactatcatcctgtaatcaaagtaatgatggcagcgtgtcccaccagagcgggagcccagctgctcaggagtcatgcttaggatggatcccttctcttctgccgtcagagtttcagctgggttggggtggatgcagccacctccatgcctggccttctgcatctgtgatcatcacggcctcctcctgccactgagcctcatgccttcacgtgtctgttccccccgcttttcctttctgccacccctgcacgtgggccgccaggttcccaagagtatcctacccatttccttccttccactccctttgccagtgcctctcaccccaactagtagctaaccatcacccccaggactgacctcttcctcctcgctgccagatgattgttcaaagcacagaatttgtcagaaacctgcagggactccatgctgccagccttctccgtaattagcatggccccagtccatgcttctagccttggttccttctgcccctctgtttgaaattctagagccagctgtgggacaattatctgtgtcaaaagccagatgtgaaaacatctcaataacaaactggctgctttgttcaatgctagaacaacgcctgtcacagagtagaaactcaaaaatatttgctgagtgaatgaacaaatgaataaatgcataataaataattaaccaccaatccaacatccagacacatagtgattttaattatttaagagtagtttagcatatattgctttatgatttaattaaaaatctccaaaatatatgccaaagaagtagaatgagaaaaatgtatatttctctttcacttcctacagatgcactgggccaggtcttgaaggctgtccaacgaatgggtaagtgttcacagctctgtgtcacatggacctcgtcaagaatgaccacactgctgtgggtgaagatgctttcctgcatttctgactgtcctctgtcctgatcaagtttctatggctctgggccagcctaccctcagccagggtttctgcagagactgcccagctggttccacgtggctccacgtgccaactttgtcctcagtggagggaaagttggacacacagtgctggggctgctccctgctccgccgttgctcgatgcatggcctgcctctgaattccttggttccactggttttgctgggtccttctgtgcctctagctcctctttttttctgtccacttaccccattggtcccatcacaagcctgtgtgtgagtggcctttctgttcgatgacaacctccagcataggggagtgtttctccttgctttctttcccagacacactgcccagcaaaggcaaaagggcttccttcaacatcagctctggccagtttgccagagcaaagccctgagaaaagcaaggttgaaaagtcttattcaaactcaccaggaaagagtggtgttactctcgatggcgtctagccaggaatcatggaattatacaccgagcacctgtttgccattttggatgtttccaaacatgaaccaaacttccaggcccctctgccatctctggtaacatttacaaagtcccttcctcaccactgcccttccttcattttggcatgctcctccgcccccgagttgacagccatagctctctctcctgccaccagtgtcacatgatcgaggaagaaggcaacttcaaaaagactgggtccccttccactcccatctcttcagtgagctgctaggacacccagcagaacttccccactccacactgcaatctcagggatcttagtcacggggctttccaccatgtctccacctggaaaccagtcatggccattccttcttacatctgctcttttccatctttttcttctcctcctgttcacccgcccttactcttgtggcgccctatggatatgcgctccatagcaaatgattctttatatcttacggtattctagtgagctggcacatgtggcttctggtttcctctctctggaactagacatgacctctgtgggagggaggattaaatgcaccctacagtctgaggctgcatgatgacatcactcatcacaatgatgctttctatgtctgaatcctattcctttataacccctttcaagctcgttcagagagtatttcacacaatccatgtgctcatcttaaaagccaaggacccagaggagtctcagcattgccaaaaagtcccttcacccagcctggccagaggcagtgcctggtccatgtgtatggactatggcacttcaattgcatggaaatactcttggaatgaacaaaataccaatccatgaaaaagcattattgaagtctaagttattttttgaatcatattttgttaatcaacaaattgaaaaatactcattatatggagaggtccagataaagcctcaattttaaaaaatgaggaaaagtgtgcctggtaggggactggggagagcttgagaaagttggaaacgttgccttagaagcctgttttttctccttttagaagctacatagtgtctcactttccaagatcattctacaagatgtcagtgcactgaaacatgcaggggcgtgttgagtgccaaggccatggaatctgtcagcaacctcacccttccttgttcctccacctcattccaggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggaggtgagtgccagtcctgggtgggctcaggagccctcgcaccccgacaggaacaagggccagccccgagaacgggccattagcagttgtgtatgttagatacataattgtattatgatgcagaaagaatctctgaatgtgcagttatacccagttggtgacatgttggtacatccatccgaggaaatggcaatgtttctaggctgcacccttcaatgtccacaaagctgtgtggcatctgcttaggacccggtgcctgtgtgtgcataggagggaggccaggaagcctggctgttgatcccatgctggcactgtggcgaaggcgagagattcctgctttggaaaacaccattgtccacacagtggctttgtccatgatggacttcgccacagcccagtcctgtgctggaagccatgttctctggaaagagcaacccagcggctcataagcataagcgcgtgtgatgtgccccaaccaaacgaccgccatgcacaacttccctaccggagttttcaatccagttaataggcgtggaaacagacatagaaattgtgtttgttgaaaggtagctgttcagttaaagaacacctgtatcagagcctgtgtttctaccaacttctgtcaagctctgtagagaaggcgtacatttgtccttccaaatgagctggcaagtgccgtgtcctggcacccaagcccatgccgtggctgctggtccccctgctgggccatgtctggcactgctttccagcatggtgagggctgaggtgacccttgtctctgtgttcttgtcccccccagcttgtggagcctcttacacccagtggagaagctcccaaccaagctctcttgaggatcttgaaggaaactgaattcaaaaagatcaaagtgctgggctccggtgcgttcggcacggtgtataaggtaaggtccctggcacaggcctctgggctgggccgcagggcctctcatggtctggtggggagcccagagtccttgcaagctgtatatttccatcatctactttactctttgtttcactgagtgtttgggaaactccagtgtttttcccaagttattgagaggaaatcttttataaccacagtaatcagtggtcctgtgagaccaattcacagaccaaaggcatttttatgaaaggggccattgaccttgccatggggtgcagcacagggcgggaggagggccgcctctcaccgcacggcatcagaatgcagcccagctgaaatgggctcatcttcgtttgcttcttctagatcctctttgcatgaaatctgatttcagttaggcctagacgcagcatcattaaattctggatgaaatgatccacacggactttataacaggctttacaagcttgagattcttttatctaaataatcagtgtgattcgtggagcccaacagctgcagggctgcgggggcgtcacagcccccagcaatatcagccttaggtgcggctccacagccccagtgtccctcaccttcggggtgcatcgctggtaacatccacccagatcactgggcagcatgtggcaccatctcacaattgccagttaacgtcttccttctctctctgtcatagggactctggatcccagaaggtgagaaagttaaaattcccgtcgctatcaaggaattaagagaagcaacatctccgaaagccaacaaggaaatcctcgatgtgagtttctgctttgctgtgtgggggtccatggctctgaacctcaggcccaccttttctcatgtctggcagctgctctgctctagaccctgctcatctccacatcctaaatgttcactttctatgtctttccctttctagctctagtgggtataactccctccccttagagacagcactggcctctcccatgctggtatccaccccaaaaggctggaaacaggcaattactggcatctacccagcactagtttcttgacacgcatgatgagtgagtgctcttggtgagcctggagcatgggtattgtttttggtattttttggatgaagaaatggaggcataaagaaattggctgacccttatatggctgggatagggtttaagccccttgttatttctgactctgaaacttgcattcaattcactccaccaagttatctcatctttgaaatggctttttttaaaggtgcctagaatatgatggcgtgcagtctataaactgttgcccaccttctgtactttctctcagaataattcacattcttctccagtgtctgttgattgttactttgtggaataagttcttggaaaattccacaagattattgttatcttcttactaccaattctattgaactttctccaccttctctgggccttccccagccagtggtgggaagatgctggctggagtctgacagagcctcttctacactggcctgggcttgctgtgagttggtggaaacctttgctcttgtcccaacacagagcaagtgaaagaggaggtcaaggggctcaggcagcggactagggaagcagaatcgaggaaaaggaaaaatggctgacttattacctcaaaactctagagaatttagttgatcttacagccaagaaggacaaaagccagagagtaatatcctccgcctcatgtctaacccacagaatacatagcaagtaaagagaacatgggcctttataaaaatgtcttaagatacaattttttaattggaggaaatctacagtttaattttctctgggcagcttttcttccttttattatagtaggggaaatcccatgttgatatacttctaaatgaaagatgatgaattgatataatacaataaaaaatctgtaaaattgatgatatacttatcaagaaaaattagctttcattttaacggtttacaaattgagtcaagtcctagtaacaaaatgttaagtctattaacataaccacaagaaatacaggaagacgggcaatctgtgaagcctttcacttacaatctctggcccctcacctgtgctgtgtaggaaaatctttgtgcacaatttgcttccttaattcattttttattcattcaacacattctaataaattatacaaaatcatgttgaaatgtgaatttcagtggtatttataaatgcagtgtgaggagggtttggatgtattctaagacaatagttgtgctttgggaaggaagcagtgttcactgaaaagtgcccccaggaccttttaattggaggaaatatgcttctgtggagttggaaatggggtagaagatagataaggtcaaggcttaaaagttaagtgcacccaacatctgaagcgtccatgggcctggcatggtggctttcgcctgtaatcccagcactttgggaggctgaggcaggaggatcccttgagcttaggagtttgagaccagcctgggcaacatactgagacccagtctctacaaaaaataaaaaattagctgggtgtggtgtctcatgcctgtagtcccagccactcaggagatgggaagatggcttgagtccaggagatctaggctgcagtgagctaaaatctcaccactgcactccagcctgggtgacaaagcaagaccctgctcaaaaaaatagttagatataaatattaatatagatacctatatatatctgaatatagatatctatatatactctgtatatagttatttagatatataaatatatatgatatatatttagagagatatatatttagagagatatatatttagagatttatatatattttatatatatttagagatatatatctctaaatatatatctctctctaaatatatatatatctctctctaaatatatatatatccctaaatatattaaataaataaaagaaataaaagaaagctcagtttggcctcctgcttgtcctgtctcctcatcccctcttccccctccatcattttatttccttgccccatgtttcttcactgcggccatgtcccccctcctctccaatgatggatgtcatgtctgctgcagtcagagggcgacaagcctggagtgttccctgaagcctgtggtttgtggtttgtcctgcagctcaggctgcccaggcctcaccagcaatcctggcgggcagggcaccacactgggatggagagggggaagctggaggaggcactttctggtaaagaaagcaaaagccagcagtgcccaggccaatttcaacagggagttaaatagcaccttaatcctgtggcaggacagctcatggggccatgtgtgctcttagaaagactcacatgcacgcatgcacggcagcaatgactccatactcacgttcccctgcagacaccaggcccccacagccggcacacacactgcagccccagttccatgttgctagcagtggcttagtgaatgagtaaagttcttaaaatgcaggggacacctgcccttcattcataaggctggacgtacacctctccttaaggagttcaagagctagtggaatcccaattcatacggtagagccattcacagatgagagagacaagccagaaggaaggaaccaaaagtcatgtcagcagttaggacaaaataacaggctttcaaggtcacaaagcctcagggacactcctgcggtgggactgggctaggagccatgggggctccaactgtgcgctctgcctgccagcctgtgggtgctggggctccacgaagattgttgtggaataccaagcatgcttgctgtaggtcacggtgcacgtttactacttccaagacaaacagccgagaacaaagctcgctttagcttctgcgtacaccgaacgggacacacgactgaacagcgttcccattgtgcctgctgggtggggaggaagtgatggcccagtgggtctatcagatgttagtaggatggggcctggcggggctccaggctctgtgtggccgacacccacgccccccgctctgctccccattcccagccccaggtcagccctgcgaggccctgcagcagatgggctgctcaaactgctctggtttgcagatttttcttccctctcaaatgaatacaatatgttttcaagtctcaaccagatcttgagaaaataggaagagccagagggtttctttggtgttatggttgtacagcttcccagactccgggggagagatgtgatttgtgctttctggcaatcccatggcgtattaaattttcataggctttccagtttaaatttagggtaggcaatggaagggaacgcaaaacagatttctaggtgtactgtgtgtgtgtctcccacgtctaaagtctgttaactggagcacccaacaggccccacaggctgccttcacacagaggacctggggcgcctccgacccattggggtgagcagtgggccatggagggagccagggtcaggagacctggttgtgggcctgacctgaccctgctcagggtggcctcaggtgggccgttcacctcgtcagcctcagcttaccctctgactacagtgacctcagacaaaatacgcttcctggccctgtccagttctgactttttataaacaagcacttatccaagttaaagggatattttcaatatctactgagtccacagatattaaatatctcctctcttctttaaaattgtggcattatctttagaatataaaaggaaaataacacacactctccttgaaaatagagagcctaaacactctgcaggaaatatttaaagctatagtttttgtttgtttgtcttgaatgcaagtggcctggactttgacttgctttgagtctttgaccttcatgacttcagtacagttcaaccctgacagttttgaagtaggtatgtgcctagatctgccctagtccctgctggaatgttgaagaagcaaaggtccaggccctcagagcacttgccacgtacttgccaacagatacggggcggagacttgagtcaacgtaagagcaagtgtgtgccgggtgatccgacactgcagagcgccagctagaccctaagcgtgtgctaggggctgaccaagccgttctttcctcaaaaacttggtggggagggtatttttaaaatcacacaaatatttaagtacagattatgatgactgcctcaaagcagtggctcttcagcttcatcaagcttcagagtccagagggtttgttcatatggaaggctaggcctgtctcctgcatttcaccctcttggcctgggggcgggacccaagaatgtgtggctctaaaaggttcccaggcaatgctgaggctgctttctgaaggaaaaactgcaagataccaggagagtttcatttagattgaagagtcgaggaaggctcctctgagaaagagtctgctaaggaaggaggaggtgggttctggggacagaggttctcccgtgggtaagggtggagggaagctctcctggggagaaggtgggcaggaggaccagaggctggagggaggagggcagtcagcctcggggcttcccaggaacagggacggccagggcagggtttagggcaaggaaagcgtgtgagcatatttgtattttagtaaatatttacagtttgccctccatgtctgcagtttcatatccatggattcaatcaaccacaatgaaaaacgttggggaaaaaaattgcatcggtactgaacatatacggactttttttcttgtcattattccctaaacaatacagcataacaattattcacatagcatttgcactgtattaggtactataggtaatcaggagatgctgtagatgggaggatgtctgtaggttacacacaaatgctgtgccactttatatcaggggcttgagcatcctcacattttgatatttaagggaggtcctggaaccaattccccagatactgagggtccactgtctgtgtcccctcgccccaccttgcctttgtctcctgtctcctatctccaccctgcctcccgccagcctgttgctcctgacctgcccgggcaccctggagcagcaccctatctcagagcctggctcagtgtgttcacttctgcagagaaactaacttgcccaagtccacactcaaaacataggcattgctgagatgtgaaaagcagctgtggatgctttctgctacagtctgtgtgttcttttccatatctgaataaaaggtcaccaccatttgtattttaaagagaaagagaatttatgggtggaaattggggattccctcattctcagtcagacagaaaagagggccccattgtgtgcctgattgcaaataaatttagcttcctcagcccaagaatagcagaagggttaaaataaagtctgtatttatggctctgtcaaaggaaggcccctgccttggcagccagccggaattagcagggcagcagatgcctgactcagtgcagcatggatttcccatagggagcctgggggcacagcacagagagaccacttctctttagaaatgggtcccgggcagccaggcagcctttagtcactgtagattgaatgctctgtccatttcaaaacctgggactggtctattgaaagagcttatccagctactctttgcagaggtgctgtgggcagggtccccagcccaaatgcccacccatttcccagagcacagtcagggccaagcctggcctgtggggaagggaggcctttctccctgctggctcggtgctccccggatgccttctccatcgcttgtcctctgcagcacccacagccagcgttcctgatgtgcagggtcagtcattacccagggtgttccggaccccacacagattcctacaggccctcatgatattttaaaacacagcatcctcaaccttgaggcggaggtcttcataacaaagatactatcagttcccaaactcagagatcaggtgactccgactcctcctttatccaatgtgctcctcatggccactgttgcctgggcctctctgtcatggggaatccccagatgcacccaggaggggccctctcccactgcatctgtcacttcacagccctgcgtaaacgtccctgtgctaggtcttttgcaggcacagcttttcctccatgagtacgtattttgaaactcaagatcgcattcatgcgtcttcacctggaaggggtccatgtgcccctccttctggccaccatgcgaagccacactgacgtgcctctccctccctccaggaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaaggtaatcagggaagggagatacggggaggggagataaggagccaggatcctcacatgcggtctgcgctcctgggatagcaagagtttgccatggggatatgtgtgtgcgtgcatgcagcacacacacattcctttattttggattcaatcaagttgatcttcttgtgcacaaatcagtgcctgtcccatctgcatgtggaaactctcatcaatcagctacctttgaagaattttctctttattgagtgctcagtgtggtctgatgtctctgttcttatttctctggaattctttgtgaatactgtggtgatttgtagtggagaaggaatattgcttcccccattcaggacttgataacaaggtaagcaagccaggccaaggccaggaggacccaggtgatagtggtggagtggagcaggtgccttgcaggaggcccagtgaggaggtgcaaggagctgacagagggcgcagctgctgctgctatgtggctggggccttggctaagtgtccccctttccacaggctcgctccagagccagggcggggctgagagagcagagtggtcaggtagccctgcctgggtgctggagacaggcacagaacaacaagccaggtatttcacagctggtgcggacccagaaagacttctgcttttgccccaaacccctcccatctccatcccagtcttgcatcagttatttgcactcaacttgctaagtcctatttttttctaacaatgggtatacatttcatcccattgactttaaaggatttgcaggcaggccctgtctctgagaatacgccgttgcccgtcatctctctccgacagcagggcagggggtccagagatgtgccagggaccagagggagggagcagacacccacccggcctgggcaggtcctcctcattgcttgcatccgcctggttagcagtggcagtcagtcctgccgagtcattcgtgaggcgctcacccaactccaggcagatgtaaaaggtgacctacaagaagacaaacaaaaacatctggagcgctcttatgccagcatctgcccttgacaccaccaggcaggctgttgctgggagccgtggtgcttgggtaagctccttcccatggcagagctcctgggacgcattgtagaagcagggaccacctcccaggataaccagatagcagcacaccctgcacagccccttttactccagcatcatcgggcattgatatctcagctgcagccacaggcggcccccagcaccccaggaagtggggagcgctcatgcttctctgagcacaaaaatcactgaatatttttgccattctcatggtcataacccgggccacagagtagaacactcctatcactgttgttagacagtggtcctgggagagggtcttgtgtgcctcggatgccagggcctctttttattgggaggtgcttgttatttctgtgtgtggctgcatttgtttcccaagactgccacaacaaatcatcaccaacttggtagctcaacatagcacagctttattccctcctggctctggaggccaggtgtctaaaaggccatgctcccacaatggttctgaggaggatccttcctgcctctctggcttctggtggctccagcatccctgggctgtggctgcacctccccatgtcaacctccgtcttcacaaggccttttcctgtgtctctgcaaccacaggcccctctcctttctcttaataaagataccagtcattgagtttgaaaattgctaagagagtctgttgtaaatcttcttagcacaaaaaaaaatgacagatatgtgaagtggtagatatattaattagtttgatttgatcactccgctatgtgtataaatgtcaaaacaaacattgcactccataaatatatatattaaaaaagatcccagtcattgcatttaggacccaccctaaatccaggatgatttcatttcaagacttttaactagatttgcaaaaccccatttccaaataaggtcacattctgcagttttgggtagacgtgaaatgtggagacactgtgcaacccactgtcttggggagggggtggtcagcctggggcagatgttgctgggtgtggagctacatccactcatgccctgacctggaacccagacctgcttccccagctctcctcctggttatctgaagcagggaatggagagcactgccctccttgcccaggcagtctctatcacctggttttagtttcttcttagcacatattgccccagaatatctggttggtttatggcttacttgagtttgtgcctacctgtcccaaccgggaggtgagccctggctattccccaaacccggccctgcatgtgggagctgcccttcctccgttcatcagagggggccaacagtccacagctgttcttaatcatctcccagtaacccccagctccacaaaggtgactccttacatggtggagaggtggtcgggccatccgtgtgaaatgtgtatgtgaccgttttccttaaggggcacgtagtcttggcaggtttcgctcaatataggatgagctcaggactccagtggactgtggattcagatctggattctggcgcattcgccgtgtgaacgggggcacgttgctggcctgtctgcgcctcgtctcccgactgtggagtgtgttctgccccttgtctttctgggaggtagggagggcagtgagccccttcgcatcgcccaccacaggcccagcacatggctgatccccactgagtgttcttttcctcctttgatcccctttggctgacctaggttggagcagccactaaaatatacccagaaacatcttcctaatctacatctgtgccaaccctcattccctggcgcagcatgaccatcacatgcccgccattgttcctgatctctgctgctcatgacctgctctccagcgctccttctcatgctcacattccagttggcctgacctagataagtggaggtttatttgaccccaaaaattagccttctacaaacgaatataatagtgtccattacagagaataaacttagtgcgtgtcccatttaagcagaagttactgaaagcctgagtttaagtttccagggcctgaaagttttccatgacagttttctgcataatattacctacaatttcaatctgttatttaaagccattcttgtgtttgttgtactttgattagctttattttgatttgaagtccttttacattacgggcagttaacgctttgtctctgttagatttgctttttagttcacaagagaaacctcattcctctgtatttgaatagttgcaatgatggaacagctgtccctggagggaaatgaaaacagtgattccccaaattgtgacaatagaaatttgctcttgggttacttacaatgtatctgagtattaaaaaattttctttttaaacgtttgaagtaaaactacccagaaacacttagtggctgaccagaaactaaactcctggcatcctcaaaatgggatttattggcttataaatgtcctgtgttgactcacaaaggcacaaactatctaggtaagttttcttctaaatgttgatgggagagctggccactgttatgcaagtttcattgtcctgactaaactgccaaagagattacataaaattatatcaactagacaaaaggaaaaaggaaaaaaaacagaggtgtcttgggaggaatccatatgagaccagtagaccatgagagagacatcccttgccatctacaaggaaaatggattttgttctccatatgcaaaaccatctcaggagcttgcggagacaccacttgcttactagccagaaagagcaggtgcctcctaaattccccacacaggagctcacagtggctttcatgcactgggattaagttagacttaagaaagcctgtctactcttcctgggatttacaagccagctagtaaatcccagaataaatcacacggcacagtcatccaaagatcccgtcatccgtgccgtttggaaagccctgctcctgtgccaccctctccccgtggagcctcccatgcccaggactgcagagtcctgccattcagactgcaactcatctcacattcttccaaactatttggacaacagagctttctcatcacctaatgcagattacagtctcacagaattgagtgttcaggcagacactgatgtggttctgtagtacagcaaacaatatcagtttacagtcctgaggccaggcctggtgaacaacgcacggtagcggtggggcagggttctcagaatgaaactggcttacacatggcactctctgaccacaactgtataagcaccaaactacacttagttccatctatgaggtaaaatttaatgcagatgaacatcaaagaaaacgtcaaaggctcctttttacaagtacgtgggctacttaatttggtccaagtccattttaaaaagccctaggtgctttcacggctctgctactgacaagaagccccagtgcctgtgagctgctaatgggagggagaggaagatgagctgagtgggccgggctatcccgtccacaccgggagacagggaaggagactccaagctggtggtgccagcacattccaggccactcaggcctattcctaggtgccaggtcacgaaaaccacgctgacagatcgtgctgtgtgcgtgtcatagcacacaagcaggactgtgagagagtgaaagtgacactgggtggagcactgaggaagggccacagtgtgttggtggagataggctgtcatggagaagagaccctggcttgctctacattgcttccaatgcaactgcaaggcaggtcccagagggctccggccttcgtcatccaggtttgctccctcccctcatggctttcccatcctcagatgaggactcggcagagcctacccctgctgactaactgtggccccagggtggtgactcagccctgcacctcctgatcccgtctgcactgggccagagaggatgacttacccagcacgttcacatcacacagctttgtggattcctaggtccaaggaccagagatttcagttatgtgagttattttttttatttgttcttgcgtattccacaaagggtcgcagctaaacttaacctaatgatcactttagtatatcactaaaaagacaaagctcacagtgctgttgaagcacattcatcatctttagacattttgactagttatttcttaagcatttacctgctagtgttaagcatcacatgaaatacatatagaagtaagacaaaatttcttatctccccaagtttgccaacaaatacagagcaggaagggaagcaggtcagagcaggaggcgcagctatagtgaggccaccatgcaaggcacagggagggtgagctccaagtttgaatggaatgggtctgtcagccaagccccctggctctgggaagatagcagtgaacaagccagatggcccctcaccctccagagccgtgagtcctgcagaccaaacagcgtgacaggtcctttccctgtccaggaggcctctgtgggtgagagttggctgcggacagggcgtgaaggcacttgagggtggggaagtgactctgactgggagatgctgaggacagggaggaaaccaccagataagggacactggggaggaggggtggacccctcagggccaagcacatggagcctcatcacaaaggcaagatggtggccaaattcaaggtcgctgcaaaaggaatggagaagagagaatagatttggcatttggaggaaatggtgacaatcatgagcacctacccgggactctccatgggtgctatctctacataaactcattccaccctctgattaatccattctacatatggggaaacaaaggcatgcggtgtttacgtcacttgccaagatctcaggatttgatccaggtggcctggttccatggtgcagcctctcagcctgcatggatgccccagctcagagcatgactctcaggacaggggtcccagcagccctccctccctgagcagcagggtgcccgtgctgcaccacttctgtctaggaataggacattctgacactttcctgcctcttccgaggtctagcacttactctatgcctgcctgggaaggtggcaagctggcctgaggaacagactcttccattttttagggagctcaaggccacagatgctctgagatctggagtccagagacaggagcggaggcttctcctggtgaccactctgcttaaaaacttcatcagatccgtagtttcagagcccccctgaaccccatcccttacctctaccagttgcaggtgggtctctggggtggggctgccctccccaccagcaccccaagggctaaaaggttgaggggagaacaccatcatttgtacagggggatcctggaagatgaggcctgagaaagccctgcggggcccctcaccttctccctagctgtggccaagagtgtctggccttgcctgcctcaggaccagcccaaagtggaggtgagaggtgagccccagcccccaggggaagggtgatggtggtcttggtctcagcatggttctggtagaggtgggttattttgaagatgatgaaccttaagcctctttctgatcttgctttaaataaatacttctgaacaacagcaacaacagaatagtgttgataggaaagccctccactccaccagaaccacgcggccttctcgtcctcccctcctccacttccttcctaagtcactgctccatgagctcttccacaggagatttacaaaatagaacacaaacaatccagttcccgcctctcactctgaactcctcccaagactcgtggggtgcggcagcccctgggaacacccagcccttcaaggtcaaacacagcccccgcccctcactctggggtaccctgccagaataagccccgacagccatgtggagcagagccttcttttttgtaagtggaagttccaggctggcttttcaaatccccttttaacctcagtgctgtatttcaaaattcattccagttttcctgtagtaattaacaaaaataaatattttaatttcaattaaagtgagggtctcggagaagaagcaggaactgagtttcctgagaggccccgctgaggctttgttgatatttcttcctgcgacctctgctcggaccctgggagctcacaggccgtatcgcagctcttatctttggggaccagttaaagcataactgcgccaggcacagagttgtcctttcaaatgtgccggcagtgggacggagacccatgcgtcaagtctcctctaagttcacatgggattctctccttgtcccaaagctgtctctgacttaaaaccctccaactgattacctgaattccagaatatgtcctgtgctctctgccctttcccacgcctttggtgaagaccggtgttctgaggaaacagacactgtgtagaaatggctcaggtcctttaaagccctggtgtgaggagtggggaagggctgggccagaggtcagctggatttgttagattgacagagtgacgcggacttccccagaggcacgggaccaaggtgcatgctcacgctgtctcatgctctcacacataatgtgtgtgtgtgtgtgtgtgtatatatatatacacatatacatatatatatatacacacatatgcatatatataaaaccccaagcagcctctggcttagcaggtgcatttcccagcagggcaattaaagccatggtcccagtagtggtcttggggtctcagggtatttggtctgtgcagccacatgcttcagtctctggaccccaggtcatctaacgaggtggtcgtgtggggactgggatagaaaaggtgtctgcacggacgtgtgtgaaagggctggcacatcgccagtgctcagcactgtcagctgctatcaccagtcattcaatcattcattcattcagttgttcattcttcaacaggccgttttaaaaatgtgcccagtataccaaaatctccgctaagcatttaaagaggcagaatgaaagttagcagtggtggtgaaacgaagctgggaatgtgctctgagggcctccttgtgggcttaatgaatatgtagaaaccacgcattttaaatagagagggagaaagggagaggttcctggtcctctgcatggggacttgtgtgtggctctttactgtaggcctgtgccactcctgctcaacagctaccacagaggacgccttcaacaaatgtgaagaacgaacaaaaggtacaaatgtgaagaacgaacagggtagaaagaaaggagaaagcaagggtgagggtgagaaatcaagggacagagaagagagaagaggagatagcctgggagttcacacagccaagaaggtagacactcagttgaaccagcaagaggctgagcctaactctccctttcgaatgggcaggagttcatgatatttaataaacagaggccttgctctgtaagagacagggtaccaggcagagagcaagtcagcatcgcaggagtcaaacgaggcagacagcgggggcagggagcttgcctctgaaggagacccaggctgccagagtagcagggagtctgggccagtcctcttttgggaagcgcttcctcggcttctgccccccctctcctctccctttccacccaccatcctgacataatacttcctaatctggaagtgttgtccagagaagaacctgctcatttcctcttaagtaggcagggaagcactaacgtccagcagcatcggaaacccgtaggagcgctctcggcagtgcagggtgaggggacagtccatgtagtcatgagacgtgggtgtcaggcaagcgtctcttttccaaaagagaaaaacattaaaggcctcacaaacggcgcccaaagactaattctgcatagcatctttgcgagaccctaggttcttatgatgactggttttgcctgagaaagaaaaaattttaattttgctctgacatgccaattcaacaaatcattttcacataatattcatgcaaaaaaaaaacaatttgccagaaaacttgggaatccatccacatctacagcttttccctgcagtcacactacagtgggatccctccatacaggagcggcagagtggagcaggctagagatgcctgtttgtttctgtttgctgcaccgcagcaagcatttctgtcgtgcccactctgtactagaaagtacatgaacatcagccataaagggaactagaaaggtggcccaccctcttggtggagagagaagagagtgtggtagaaacaataataagaagtctgcagaacttgacccctcccagcctctcccacctgccagcctggcccttgcagagagatgcaggctgccattcttaggccaaagcctgggacagttgggctcagcaaggtaggcatccgtcaagcaaggaggagcaggggtcagcagtgaccccagcagccagcagggagaaaggtgcatgtgacaaggacaccagaggccgtgggtcaggatcagccagggtcagggtagcatttctaggaattcactctgttgggcgctgtgctggctgcttctcacatattattcctttcttactctcagagcagagatttcaattgcagcgagattgtggaggcagccagggaggtggggagggtggtgtcttctaaaagcattttcagtatccatgtggtttcagtaataataataataataaaccagtgaaaagtaaaacaggacaaaaatcttcataggcagtgaaccatatcagagagtccaagaaagcacaatgagagtgtggcttaaaaaccctgaacgacattcctttgcaccagcttggtgaggagggcatggtccccgccaccccccacccccactttgcagataaaccacatgcaggaaggtcagcctggcaagtccagtaagttcaagcccaggtctcaactgggcagcagagctcctgctcttctttgtcctcatatacgagcacctctggacttaaaacttgaggaactggatggagaaaagttaatggtcagcagcgggttacatcttctttcatgcgcctttccattctttggatcagtagtcactaacgttcgccagccataagtcctcgacgtggagaggctcagagcctggcatgaacatgaccctgaattcggatgcagagcttcttcccatgatgatctgtccctcacagcagggtcttctctgtttcagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtaaggaggtggctttaggtcagccagcattttcctgacaccagggaccaggctgccttcccactagctgtattgtttaacacatgcaggggaggatgctctccagacattctgggtgagctcgcagcagctgctgctggcagctgggtccagccagggtctcctggtagtgtgagccagagctgctttgggaacagtacttgctgggacagtgaatgaggatgttatccccaggtgatcattagcaaatgttaggtttcagtctctccctgcaggatatataagtccccttcaatagcgcaattgggaaaggtcacagctgccttggtggtccactgctgtcaaggacacctaaggaacaggaaaggccccatgcggacccgagctcccagggctgtctgtggctcgtggctgggacaggcagcaatggagtccttctctcccttcactggctcggtttctcttagggaccctcacagcactaaggggtgcgcgtcccctgtcaggccctcgaatgccctcccacagccaggcccctctgaggtttcactctggcctgcttggctcctagcagccaccaacccatgatgctgggccctgaaaacacacgcagacctggatgagtgaggccactgggcacaaccagggctcccagctcaccagagcagcctgggacacagagggtgctcagaaacctaccagagcagccctgaactccgtcagactgaaatcccctgttgccgggaggaggcgccgggcctgggggacgggtcctggggtgatctggctcgtctgtgtgtgtcactcgtaattaggtccagagtgagttaactttttccaacagagggaaactaatagttgtctcactgcctcatctctcaccatcccaaggtgcctatcaagtggatggcattggaatcaattttacacagaatctatacccaccagagtgatgtctggagctacggtgagtcataatcctgatgctaatgagtttgtactgaggccaagctggcttttattgttagttaatttacattatatcctctgacatgcaagtattttctttcgagataatgactaatgataatgtaatcattgctgtctatctattgtactgagaaaacacggcagaggaaatcgagtccagctgccgtccaaaagtcactggagattgcaatgagctcgtctggcagggtggggggtatgggagggaaagagcttaggaaacggctctccctgcaaagtccaaccaaactttaacgttaaccaaaccattaatgttgccatgaatttgaagtgaaccagagggaggtggcagaagaagcttaatggggaatagttccggtagagaaatgaggcttaagatgaactaccctggcccttatgtgtcagagagaacggcttgacaaacacacactgaggatgtctgcagggataaaagaagaaagggagatgacccttgcttctcgctctcgggaggaccatctggtccggccctggggattctctgtttcctcttctgaatcccagtgttgcccagcactggcctgtacccatcctcacgagggccgctctcctcacccggccctaggtccctgccctgtcctgagcctacaggggcctcccatgttgagaaagtgttgctgacacattgtctctgaccgctgtgccaggcattttctgctgaattaccgcacttggtccttgaatttcacccagcaacttactgaaaggctggaacccatgaacctaccccttcactgaggaaaataagttaccccagccatctacagcgacaggagcaagggaggagtcgcctcacctctctagaaatgtgtatttgaggagaacactattgaaatgaatttccaagaataatctagtcagtattacaaaagcaaaattatttgggatatcgtccttttttacttagtattttttctttttcctatagcattattaactttctgattttccaaatacatacacatttttaaatttcctgagtctttatctcttctgttaaaatgtaagatttatgatacaaaggcagagatttgtgtccatgaataagtgaagtttggtgtgcacctgtgagctgagccacctcaattaatggaacagataaggaaataaaggtctgctgatgcattgttatttacagccattttcagaatgtatctcctctccacgagggaactgcagggtcctgccccaagccatttattttgtcctcaagcagcccgcccctcccactccaggcacagcccggtctcctgctggtctcccctcttcccacttgctccccctcatctatgctccagacagaggccacatatattttttaacttttttttttttttttttgagacagagtcttgccctgtcacccaggctggagtgcagtggtgcagtctcggctcactgcaacctccacctcccgggttcaagtgattctcctgcctcagcctcctgagtagctgggattacaggcgcacaccaccatgcccagctaattttttgtatctctagttgagacagggtttcactatgttggccaggctggtctcgaactcctgacctcatgatctgcccgcctcggcctcccaaagtgcatattttttaactttatcagacttttcattctctgctcaacatctttctttggtcctccaggtatgttcagataaaacctgagcacctggccatgactgatgggttgctgggccatctggccctggcaactctcccgtccaccaggtccccctcccgtcacgctccaggcatagcctgtgtgtgccagcgcaatgcccacactccatgcacaagtggaagccctctcaaagtcagtggcttagtgccttgatgtggtcacacccattctcaggaagtccgttcccactgaaaacattgtgtgttttcaacatcattgaggctgccacggcagattataatcactggcctaggcagcccactggaactaccagaccatgagcctgaattttttgtttaaaaatcatatcctgttttctctactctctagtctctagtcaaggtgaattattcaatttaataaattaggggcctagtgtgttgtaccaaggagctaaaaagagagaactcgcaacaccttccagcccattctccacctaacactggctatactggctctcctctctctcgctgtttgttccaaaatctaataacctgtcttcccactagaattcatcatacatgtttaaaaacctagttaaatagtagttaaactgactgcatagatctggaaatgagacagtctttcttttacaaatccatatagactatgagttgggggcaggggatgacacaagaatctattttcttgcccccaaaccattgctttccttccaatgttaagcttgtattctgtgtattaattcaggtggttccgtttgggaatggcctctgttacccagagatgggagggccatcagaactcggggttgtctgaaaaaacactggttctaaaattatcactgctttcacttgtttttaaccatcatagttgtttgattttgaaggaaaaacatgagggtttttattctatgcttgttatatctatattgtggtttcgtattttttagattttagtacctgacatttttttaacttttattttaggttcaggggtacatgtgcaggtttgttatataggtaaatttgtgtcatgggggtttgttacacagattattttatcacccagggattaagcctagtacccattagttatttttcctgatcctctccctcctcccatcctccaccgtcctatagaccccagtgtgtgttgttcccctctaagtgtccatgtgttctcatcatttagctcccacttataagtaagaacatgcggtatttgattttctgttcctgcattagtttgctagggatgatggcctctagctccatccatgttcttgcaaagtacatgatctcattctcttttgtggctgcctagtgttccatggtgtatatgtaccacattttctttatccagtctgtcattgatgggcatttaggttgattccatgtctttgctattgtaaatagtgctgcagtgaaaatacgcatgcatatgtctttatggtagaatgatttatattcctttgagtaatgggattgccgggtcaaatggtagttctgtttttagctatctgagaaattgccacactcttttccacaataattgaactaatttacattcccaccaacagtgtaaaagcattcctttttctccacaacctcaccagcatgtgttgggatttttttttttttttacttttcaataatagccatctgactggtatgagatggtatctcagtgtggttttgatttttatttctttaatgatcagtgatgttaagctctttttcatatacttgttggctgcatgtatgtcttcttctaaaaagtgtctgctcatgtcctttgcccactttttaatgggattgtttaattttttcttgtgaatttacttaagttccttatagatgctggttattagacccttctcagatttgtagcttgcaaaaatgttcacccattctgtgggttgtcttcactctgatgatagtttcttttgctgtgcagaagatcttcagtttagttagatcccatttgtcaatttttgcttttgttgcaattgcttgatgtgttttcatcatgaaatcttagcccattcctatatccagaatggtattacctaggttgtcttccagggtttttatagtttggggttttacatttaagtctttaatccatgttgagtttatttttgtgtatggtgtaaggaaggagtccagtttcaatcttcttcatggctagctagtcatcatttattgagtagggagtcctttattcattgcttttttttttttgtcaactttgtcaacgatcacatggttgtaggtgtgcagccttatttctgggctctctattctgtttcattggtctgtatgtctgtttctgtactagtaccatgctgttttggttactgtatccctgtagtttaaagtcaggtagcatcatgcttccagctttgttctttttgcttaggattgccttggcaattcaggctcttttttggttccatgtgaatttttaaattgtattttctagttctgtgaagaatctcattggtagtgtgataggagtaacattgaatctataaaatactttgggcagtatagtcattttaatgatattgattctttctatccatgagcatggaatgtttttccatttgtttgtgtcatctctgatttctttaagcagtgttttgtggttcttattgtagagatctttcactttcctggtttactgtatttctaggtattttattctttttgtggcaattgtgaattgaattgcattcctgatttggttctcagcttgactgttgttggcatattggaatgctaattatttttgtacattgattttgtacaactgagtcttcactgaagttgtttatcagcttaaggggttttgggtcaagactatggggttttctagatataggatcatgtcatctgcaaacagagatagctgttttcctctcttcctgtttggatgtccattatttctttctctcacctgatttatctggccaggacttccaatactatgttaaataggagtgttgagagagggaatccttgtcttgtgtcaattttcaaggggaatgttttcaacttttgcccattcaatatgatgttggctgtgggtttgccatagatggctaatatgttgaggtttgttctttaaatacctagtttattgagaattttaaacatgttgaattttattgagagccttttctgcatctattgagatgatcatgtggcttttgtccttagttctgtttgtgtggtgaatcacatttattgatttgcatatgttgaaccaatcttgcatcccagggatgaagccgacttgattgtggtggcttaagctttttgatgtgctgctggattcgatttgccagtattttgttgaggatttttatgtctatgttcatcagagatattggcctgaagttttctttttttgttgtatctctgccaagctttggtatcaggatgacattggcctcatagaatgagttaaggaagagtccctccttctcaatttttttggaatagtttcagtaggaatggtaccagctttttttgtacatcttgtagaatttggctatgaatccatctagtcttaggctttgttttggttggtaggctatttattactgattcaattttggagctcattattggtctgttcagggattcagtttcttcctgaggtttttatttttatcaaatggaacttaagctttttcatttccaatttttttatgatctaaaaatgtgcagtttacagccctgttcagaatctgcatcttcctcattctgcagatacaggtccctcagagcaggtgactgagtgtgtatcctgtctggagcataatacttatgctagtagagttactgttgtctttattgttaattaccaaagtttaccacttatcagtcacttactacttgctgggcattgcactaagcatttcagttgtattatcttgttgggtccttacagcaatcctgtgaaacagatactgctattaccccactttatagagaggtagactgaggcttccagcattgaagcaaattgcccaagactacagaaatgtaggtttctaaacatcaagaaacagtaaccagtaatgatgactaaagcaagggattgtgattgttcattcatgatcccactgccttcttttcttgcttcatcctctcaggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgtgagtgactggtgggtctgtccacactgcctagctgagccttggtggctgctcttagccaaacagctgaggcctttgcatccctggagaaatgtcatcacattacttaaggcaggcacacaaatccagaaacatctgtaaataccccttcaagcattcttttaaagacacttcttgactcattgggcagtatgacctgacatttgcccatgtttgcaagcaaataaataaaactaaagtcttccgcaagccattacaccaaaatattctattcgctgagttactcaatgaaataccgagttgccctatattttgaagcctgttaccagagagactgaatgtttttaaatgcatggcagtgagtaacaacataaggctaatagagtcaacatttctgctttgacttaaaccttttaaaccagtggatttatgtgaagtctctgcagtgtggcatttaaacatttcaatctaaataagagtgtgtaatttgattgatgctattattctaccagattcacgagtgcagtgggctctggaggtagcattacatgcatgggatgagcatttgcaaaagaaagttgtatagggaatatgacagagccaagttaatgtaaatattaatgcctttctgaactctaggccacagagttgatcttttttaacttccttggtttgggctaaggaagctgtgatccagagaagccacgtgatttgtctaaggtcacatagcagtctggcctaaaatagcttgatatgctgtggatggaaaataaatgtgatccctcaagaggcatgaggatttccaggcagtagccatacctccaaattgtttaatctggatttagattgttgggtagtcacatgcagcagcacagttaacagtgtgtcctcctgtggaagttgccagcacagccagccctctcacttgcatgcatgcccaccagccttctcacttgcatgcatgcccactgggtatgtgctgtactggagacgccgggggtaggggcccagtcccaaccccaaattctttaaagcctatttttctaagttgcatctggtttcctacctgaaggaatgctaagggtggatgttgagtgaggaccttggtgcagggcaccctgcagtcaggatagttcatggagagcaattgtacagacccacactgctccatcccctcaggcgtaacacaggatgctgaccccaggaagagtgggcgtagaaaaactagagggcattattgttattctgattcaaatgtacagtgctggcatggtctttaaacagtaaccagtactagctggccaagacagaaaagtctaccacaaagacttggttctttcatcacttatttgactggaagtgtcgcatcaccaatgccttctttaagcaatgccatctttatcatttcttccagtgttctaattgcactgttttttctcattccttccccaggctggatgatagacgcagatagtcgcccaaagttccgtgagttgatcatcgaattctccaaaatggcccgagacccccagcgctaccttgtcattcaggtacaaattgcagtctgtgcttccattgggaagagtccctctaatgagcatctcatgtcactgtgttctgtcacatgccagcctggcctccctgtgtcccagatcgcattattaaaccctccagcgcattagagcaagcctcagtaaggcgcaggccacatcgtgaactaagcagcatccgtgagtggggcccacccaactccatctccccctccccgtctgaactctcctctggtgctcgtcctcactgtccggctagccaaagcctcagctgggtctaagagagaagcatggtctattgggctttggtgtcaggcagacgtggcttcacacccctgactctccacttcttcgcatcacccaggcagccgatccacctatctccttccataacacaggaataccaaaaccaagctcacaggattgtctcaaagattcaataaaatatgttgcaaaatacgctccctaacacctcacagcaaggtgcacactcgatgaatgctgcagcttcttccctttctgtttcctcagaagctatttgaatctcatgtaggggctttcaagcatcaaaggatggttcatgttttattttaaggcacccacatcatgtcatgaggggaggcagctataatttagagaaccaagggggatttcattataacaaaattggcaaacacacaggcacctgctggcaatagacccctgctcctatagccaagaagtggaatagcatctctacgggccattctaatagcctcaaaatctctgcaccagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctggtatgaaatctctgtctctctctctctctcaagctgtgtctactcatttgaacaaattgaattttagggaaaataaccatctagtgaaactcacatggatatgaagtcaattttaaccaaatggtaaaatcaaaatcaaaataaattaagtgtattaattattttgttgcattgcaacaacttgattgtaagccttttaggtccactatggaatgtaattaaatcaaaactaaacctagttgctctaaaactaacgattaagacaaaaattaaacaccttcacaatataccctccatgaggcacaccacctgcattcaggaaaagtggatgagatgtggtacaagcattccatgggcaacttctctgtttctttttcagagtgcaaccagcaacaattccaccgtggcttgcattgatagaaatggggtatgtatgaacaccttataagccagaatttacagctctccactatggctctattttacatggaaaatgccttaacctaaataattttaacccagataatcttgagttttcttcctgtgtgggtttttccctgcacggctgtcacgcctcacagtgccgttcaaagcgtgactcctggaccagtagtagcatcgcctggccttgttagaaacgccatttttcaggccactgccccagtttgaccaaatcaggacctctgggggtggcacccagtagtctatgtttgagccactttccaggtgatgctgatgtctgttgaagtgtgaggccgtggtctagaccgcactgtgccatgcagaaaccactagccacatgtggctacttcaacttaaatgttaatgagttaaaatgaaataaaatataaaattcagtttctcacacatgtgaagtgtccagtagccacacgtggctagtggtgaccgtattgaagagcaccgctcatagcacacctccctcactgcggaaagttctgctgtacagcacccagcacagccctgctgcccaccctgcagcctgtggcccagtagcaccagcacccaccagggtgcagactctcaggcctgcccaacctactaatcagaaccagcatctcaaggagatctcgggtgatttttgcaaacactgaagttggggcagccctgaccggagtaaccttccctcatttcctcctgcagctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagatactcataacctgctaacacacacacatatacacacacatacacatacacacatatacacacaccacacacatacacagacaccacacacataccatacacagacacatacacatgcacacacatatacacacacacctcaaatacatacacaccacacacacatacatgtatacacacatacacacaccacacatacaccacaaaaaccccacacacatacacatatacacaccacacacaccacatacacacacgtatacacacatatatacacacatacaccatgcatacatacacaccacacatacatacagacacaccacacacacgtacacacaacacacaacacagacacgtacacacactacagacatgtatgcacacatacacacacaccacacatacatacacacagacacatatacactacacacaccattacatacacacgtacacatacaccacacacaccacacatacacacaccacacacacatacgccacacacacaccacaaaaaccgcacacacatacaaacatatacacactacaccacacatacacacacacaccacacaccacacacacacatacacacaccacacacaccacacatacacgcaccacacatacacacacgtagacacaccacacacaccacagaaacacacattaacacaccacatacacatatgtatgtgcatatacacacccacaccccacacacacatgtataaagatttagatatatataaaacatatgttatatatatgttgatgtaatatctaatatctatatatctaatatgtagtttattagctatctaatatctatgtcatatatatcaaaatctttatatataaaaatatgtagaaatctttatacatatgttatatgtatataaagatttagatatataacatatgtaagttatatatatgttagtgtaatatctaatatatagtttattggctatctaatataatataaacagattatcaatattataagctattagaaaaatgcaagttaaggcagatgatatacctctttacacaccaactacacacaccaactacacacacacatacacacagacacacacgacacacaccatacacatgtacacacacaccacatatacacaaacgtacacacacaccacacacacatacacaccacacacacaccacacatacatacacatccacacaccacacatgtacacacgccacacacacacatacacaccacatacacatatgtatgcacacatacacaccaacaccacacagacaccacacatgcataaacatatagacatatacacaccacacaccatatgtacacatgtacacacacaccacatatacacacaacacacacaaatacacacaccacacacacaccacaaaaaccccacacacacacaaacatatacaccccacacatacgcatatatacacacacacatacacaccacacacatacacaccacacacacaccacacatacacacacgtacacacaccacacacacaccacagacacacaccacacatacatacacatacacacaccacacacacgtacacacaccacacacaccacagacacacatagacacaccacatacacacccacaccacacacacacaactcataccacacatacatacacaatagaca

SEQ ID NO: 22 - DNA, 158924 bp, Artificial Sequence
  Synthetic BAC sequence
gcttaatggggaatagttccggtagagaaatgaggcttaagatgaactaccctggcccttatgtgtcagagagaacggcttgacaaacacacactgaggatgtctgcagggataaaagaagaaagggagatgacccttgcttctcgctctcgggaggaccatctggtccggccctggggattctctgtttcctcttctgaatcccagtgttgcccagcactggcctgtacccatcctcacgagggccgctctcctcacccggccctaggtccctgccctgtcctgagcctacaggggcctcccatgttgagaaagtgttgctgacacattgtctctgaccgctgtgccaggcattttctgctgaattaccgcacttggtccttgaatttcacccagcaacttactgaaaggctggaacccatgaacctaccccttcactgaggaaaataagttaccccagccatctacagcgacaggagcaagggaggagtcgcctcacctctctagaaatgtgtatttgaggagaacactattgaaatgaatttccaagaataatctagtcagtattacaaaagcaaaattatttgggatatcgtccttttttacttagtattttttctttttcctatagcattattaactttctgattttccaaatacatacacatttttaaatttcctgagtctttatctcttctgttaaaatgtaagatttatgatacaaaggcagagatttgtgtccatgaataagtgaagtttggtgtgcacctgtgagctgagccacctcaattaatggaacagataaggaaataaaggtctgctgatgcattgttatttacagccattttcagaatgtatctcctctccacgagggaactgcagggtcctgccccaagccatttattttgtcctcaagcagcccgcccctcccactccaggcacagcccggtctcctgctggtctcccctcttcccacttgctccccctcatctatgctccagacagaggccacatatattttttaacttttttttttttttttttgagacagagtcttgccctgtcacccaggctggagtgcagtggtgcagtctcggctcactgcaacctccacctcccgggttcaagtgattctcctgcctcagcctcctgagtagctgggattacaggcgcacaccaccatgcccagctaattttttgtatctctagttgagacagggtttcactatgttggccaggctggtctcgaactcctgacctcatgatctgcccgcctcggcctcccaaagtgcatattttttaactttatcagacttttcattctctgctcaacatctttctttggtcctccaggtatgttcagataaaacctgagcacctggccatgactgatgggttgctgggccatctggccctggcaactctcccgtccaccaggtccccctcccgtcacgctccaggcatagcctgtgtgtgccagcgcaatgcccacactccatgcacaagtggaagccctctcaaagtcagtggcttagtgccttgatgtggtcacacccattctcaggaagtccgttcccactgaaaacattgtgtgttttcaacatcattgaggctgccacggcagattataatcactggcctaggcagcccactggaactaccagaccatgagcctgaattttttgtttaaaaatcatatcctgttttctctactctctagtctctagtcaaggtgaattattcaatttaataaattaggggcctagtgtgttgtaccaaggagctaaaaagagagaactcgcaacaccttccagcccattctccacctaacactggctatactggctctcctctctctcgctgtttgttccaaaatctaataacctgtcttcccactagaattcatcatacatgtttaaaaacctagttaaatagtagttaaactgactgcatagatctggaaatgagacagtctttcttttacaaatccatatagactatgagttgggggcaggggatgacacaagaatctattttcttgcccccaaaccattgctttccttccaatgttaagcttgtattctgtgtattaattcaggtggttccgtttgggaatggcctctgttacccagagatgggagggccatcagaactcggggttgtctgaaaaaacactggttctaaaattatcactgctttcacttgtttttaaccatcatagttgtttgattttgaaggaaaaacatgagggtttttattctatgcttgttatatctatattgtggtttcgtattttttagattttagtacctgacatttttttaacttttattttaggttcaggggtacatgtgcaggtttgttatataggtaaatttgtgtcatgggggtttgttacacagattattttatcacccagggattaagcctagtacccattagttatttttcctgatcctctccctcctcccatcctccaccgtcctatagaccccagtgtgtgttgttcccctctaagtgtccatgtgttctcatcatttagctcccacttataagtaagaacatgcggtatttgattttctgttcctgcattagtttgctagggatgatggcctctagctccatccatgttcttgcaaagtacatgatctcattctcttttgtggctgcctagtgttccatggtgtatatgtaccacattttctttatccagtctgtcattgatgggcatttaggttgattccatgtctttgctattgtaaatagtgctgcagtgaaaatacgcatgcatatgtctttatggtagaatgatttatattcctttgagtaatgggattgccgggtcaaatggtagttctgtttttagctatctgagaaattgccacactcttttccacaataattgaactaatttacattcccaccaacagtgtaaaagcattcctttttctccacaacctcaccagcatgtgttgggatttttttttttttttacttttcaataatagccatctgactggtatgagatggtatctcagtgtggttttgatttttatttctttaatgatcagtgatgttaagctctttttcatatacttgttggctgcatgtatgtcttcttctaaaaagtgtctgctcatgtcctttgcccactttttaatgggattgtttaattttttcttgtgaatttacttaagttccttatagatgctggttattagacccttctcagatttgtagcttgcaaaaatgttcacccattctgtgggttgtcttcactctgatgatagtttcttttgctgtgcagaagatcttcagtttagttagatcccatttgtcaatttttgcttttgttgcaattgcttgatgtgttttcatcatgaaatcttagcccattcctatatccagaatggtattacctaggttgtcttccagggtttttatagtttggggttttacatttaagtctttaatccatgttgagtttatttttgtgtatggtgtaaggaaggagtccagtttcaatcttcttcatggctagctagtcatcatttattgagtagggagtcctttattcattgcttttttttttttgtcaactttgtcaacgatcacatggttgtaggtgtgcagccttatttctgggctctctattctgtttcattggtctgtatgtctgtttctgtactagtaccatgctgttttggttactgtatccctgtagtttaaagtcaggtagcatcatgcttccagctttgttctttttgcttaggattgccttggcaattcaggctcttttttggttccatgtgaatttttaaattgtattttctagttctgtgaagaatctcattggtagtgtgataggagtaacattgaatctataaaatactttgggcagtatagtcattttaatgatattgattctttctatccatgagcatggaatgtttttccatttgtttgtgtcatctctgatttctttaagcagtgttttgtggttcttattgtagagatctttcactttcctggtttactgtatttctaggtattttattctttttgtggcaattgtgaattgaattgcattcctgatttggttctcagcttgactgttgttggcatattggaatgctaattatttttgtacattgattttgtacaactgagtcttcactgaagttgtttatcagcttaaggggttttgggtcaagactatggggttttctagatataggatcatgtcatctgcaaacagagatagctgttttcctctcttcctgtttggatgtccattatttctttctctcacctgatttatctggccaggacttccaatactatgttaaataggagtgttgagagagggaatccttgtcttgtgtcaattttcaaggggaatgttttcaacttttgcccattcaatatgatgttggctgtgggtttgccatagatggctaatatgttgaggtttgttctttaaatacctagtttattgagaattttaaacatgttgaattttattgagagccttttctgcatctattgagatgatcatgtggcttttgtccttagttctgtttgtgtggtgaatcacatttattgatttgcatatgttgaaccaatcttgcatcccagggatgaagccgacttgattgtggtggcttaagctttttgatgtgctgctggattcgatttgccagtattttgttgaggatttttatgtctatgttcatcagagatattggcctgaagttttctttttttgttgtatctctgccaagctttggtatcaggatgacattggcctcatagaatgagttaaggaagagtccctccttctcaatttttttggaatagtttcagtaggaatggtaccagctttttttgtacatcttgtagaatttggctatgaatccatctagtcttaggctttgttttggttggtaggctatttattactgattcaattttggagctcattattggtctgttcagggattcagtttcttcctgaggtttttatttttatcaaatggaacttaagctttttcatttccaatttttttatgatctaaaaatgtgcagtttacagccctgttcagaatctgcatcttcctcattctgcagatacaggtccctcagagcaggtgactgagtgtgtatcctgtctggagcataatacttatgctagtagagttactgttgtctttattgttaattaccaaagtttaccacttatcagtcacttactacttgctgggcattgcactaagcatttcagttgtattatcttgttgggtccttacagcaatcctgtgaaacagatactgctattaccccactttatagagaggtagactgaggcttccagcattgaagcaaattgcccaagactacagaaatgtaggtttctaaacatcaagaaacagtaaccagtaatgatgactaaagcaagggattgtgattgttcattcatgatcccactgccttcttttcttgcttcatcctctcaggggtgactgtttgggagttgatgacctttggatccaagccatatgacggaatccctgccagcgagatctcctccatcctggagaaaggagaacgcctccctcagccacccatatgtaccatcgatgtctacatgatcatggtcaagtgtgagtgactggtgggtctgtccacactgcctagctgagccttggtggctgctcttagccaaacagctgaggcctttgcatccctggagaaatgtcatcacattacttaaggcaggcacacaaatccagaaacatctgtaaataccccttcaagcattcttttaaagacacttcttgactcattgggcagtatgacctgacatttgcccatgtttgcaagcaaataaataaaactaaagtcttccgcaagccattacaccaaaatattctattcgctgagttactcaatgaaataccgagttgccctatattttgaagcctgttaccagagagactgaatgtttttaaatgcatggcagtgagtaacaacataaggctaatagagtcaacatttctgctttgacttaaaccttttaaaccagtggatttatgtgaagtctctgcagtgtggcatttaaacatttcaatctaaataagagtgtgtaatttgattgatgctattattctaccagattcacgagtgcagtgggctctggaggtagcattacatgcatgggatgagcatttgcaaaagaaagttgtatagggaatatgacagagccaagttaatgtaaatattaatgcctttctgaactctaggccacagagttgatcttttttaacttccttggtttgggctaaggaagctgtgatccagagaagccacgtgatttgtctaaggtcacatagcagtctggcctaaaatagcttgatatgctgtggatggaaaataaatgtgatccctcaagaggcatgaggatttccaggcagtagccatacctccaaattgtttaatctggatttagattgttgggtagtcacatgcagcagcacagttaacagtgtgtcctcctgtggaagttgccagcacagccagccctctcacttgcatgcatgcccaccagccttctcacttgcatgcatgcccactgggtatgtgctgtactggagacgccgggggtaggggcccagtcccaaccccaaattctttaaagcctatttttctaagttgcatctggtttcctacctgaaggaatgctaagggtggatgttgagtgaggaccttggtgcagggcaccctgcagtcaggatagttcatggagagcaattgtacagacccacactgctccatcccctcaggcgtaacacaggatgctgaccccaggaagagtgggcgtagaaaaactagagggcattattgttattctgattcaaatgtacagtgctggcatggtctttaaacagtaaccagtactagctggccaagacagaaaagtctaccacaaagacttggttctttcatcacttatttgactggaagtgtcgcatcaccaatgccttctttaagcaatgccatctttatcatttcttccagtgttctaattgcactgttttttctcattccttccccaggctggatgatagacgcagatagtcgcccaaagttccgtgagttgatcatcgaattctccaaaatggcccgagacccccagcgctaccttgtcattcaggtacaaattgcagtctgtgcttccattgggaagagtccctctaatgagcatctcatgtcactgtgttctgtcacatgccagcctggcctccctgtgtcccagatcgcattattaaaccctccagcgcattagagcaagcctcagtaaggcgcaggccacatcgtgaactaagcagcatccgtgagtggggcccacccaactccatctccccctccccgtctgaactctcctctggtgctcgtcctcactgtccggctagccaaagcctcagctgggtctaagagagaagcatggtctattgggctttggtgtcaggcagacgtggcttcacacccctgactctccacttcttcgcatcacccaggcagccgatccacctatctccttccataacacaggaataccaaaaccaagctcacaggattgtctcaaagattcaataaaatatgttgcaaaatacgctccctaacacctcacagcaaggtgcacactcgatgaatgctgcagcttcttccctttctgtttcctcagaagctatttgaatctcatgtaggggctttcaagcatcaaaggatggttcatgttttattttaaggcacccacatcatgtcatgaggggaggcagctataatttagagaaccaagggggatttcattataacaaaattggcaaacacacaggcacctgctggcaatagacccctgctcctatagccaagaagtggaatagcatctctacgggccattctaatagcctcaaaatctctgcaccagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctggtatgaaatctctgtctctctctctctctcaagctgtgtctactcatttgaacaaattgaattttagggaaaataaccatctagtgaaactcacatggatatgaagtcaattttaaccaaatggtaaaatcaaaatcaaaataaattaagtgtattaattattttgttgcattgcaacaacttgattgtaagccttttaggtccactatggaatgtaattaaatcaaaactaaacctagttgctctaaaactaacgattaagacaaaaattaaacaccttcacaatataccctccatgaggcacaccacctgcattcaggaaaagtggatgagatgtggtacaagcattccatgggcaacttctctgtttctttttcagagtgcaaccagcaacaattccaccgtggcttgcattgatagaaatggggtatgtatgaacaccttataagccagaatttacagctctccactatggctctattttacatggaaaatgccttaacctaaataattttaacccagataatcttgagttttcttcctgtgtgggtttttccctgcacggctgtcacgcctcacagtgccgttcaaagcgtgactcctggaccagtagtagcatcgcctggccttgttagaaacgccatttttcaggccactgccccagtttgaccaaatcaggacctctgggggtggcacccagtagtctatgtttgagccactttccaggtgatgctgatgtctgttgaagtgtgaggccgtggtctagaccgcactgtgccatgcagaaaccactagccacatgtggctacttcaacttaaatgttaatgagttaaaatgaaataaaatataaaattcagtttctcacacatgtgaagtgtccagtagccacacgtggctagtggtgaccgtattgaagagcaccgctcatagcacacctccctcactgcggaaagttctgctgtacagcacccagcacagccctgctgcccaccctgcagcctgtggcccagtagcaccagcacccaccagggtgcagactctcaggcctgcccaacctactaatcagaaccagcatctcaaggagatctcgggtgatttttgcaaacactgaagttggggcagccctgaccggagtaaccttccctcatttcctcctgcagctgcaaagctgtcccatcaaggaagacagcttcttgcagcgatacagctcagaccccacaggcgccttgactgaggacagcatagacgacaccttcctcccagtgcctggtgagtggcttgtctggaaacagtcctgctcctcaacctcctcgacccactcagcagcagccagtctccagtgtccaagccaggtgctccctccagcatctccagagggggaaacagtggcagatttgcagacacagtgaagggcgtaaggagcagataaacacatgaccgagcctgcacaagctctttgttgtgtctggttgtttgctgtacctctgttgtaagaatgaatctgcaaaatttctagcttatgaagcaaatcacggacatacacatctgtgtgtgtgagtgttcatgatgtgtgtacatctgtgtatgtgtgtgtgtgtatgtgtgtgtttgtgacagatttgatccctgttctctctgctggctctatcttgacctgtgaaacgtatatttaactaattaaatattagttaatattaataaattttaagctttatccagatactcataacctgctaacacacacacatatacacacacatacacatacacacatatacacacaccacacacatacacagacaccacacacataccatacacagacacatacacatgcacacacatatacacacacacctcaaatacatacacaccacacacacatacatgtatacacacatacacacaccacacatacaccacaaaaaccccacacacatacacatatacacaccacacacaccacatacacacacgtatacacacatatatacacacatacaccatgcatacatacacaccacacatacatacagacacaccacacacacgtacacacaacacacaacacagacacgtacacacactacagacatgtatgcacacatacacacacaccacacatacatacacacagacacatatacactacacacaccattacatacacacgtacacatacaccacacacaccacacatacacacaccacacacacatacgccacacacacaccacaaaaaccgcacacacatacaaacatatacacactacaccacacatacacacacacaccacacaccacacacacacatacacacaccacacacaccacacatacacgcaccacacatacacacacgtagacacaccacacacaccacagaaacacacattaacacaccacatacacatatgtatgtgcatatacacacccacaccccacacacacatgtataaagatttagatatatataaaacatatgttatatatatgttgatgtaatatctaatatctatatatctaatatgtagtttattagctatctaatatctatgtcatatatatcaaaatctttatatataaaaatatgtagaaatctttatacatatgttatatgtatataaagatttagatatataacatatgtaagttatatatatgttagtgtaatatctaatatatagtttattggctatctaatataatataaacagattatcaatattataagctattagaaaaatgcaagttaaggcagatgatatacctctttacacaccaactacacacaccaactacacacacacatacacacagacacacacgacacacaccatacacatgtacacacacaccacatatacacaaacgtacacacacaccacacacacatacacaccacacacacaccacacatacatacacatccacacaccacacatgtacacacgccacacacacacatacacaccacatacacatatgtatgcacacatacacaccaacaccacacagacaccacacatgcataaacatatagacatatacacaccacacaccatatgtacacatgtacacacacaccacatatacacacaacacacacaaatacacacaccacacacacaccacaaaaaccccacacacacacaaacatatacaccccacacatacgcatatatacacacacacatacacaccacacacatacacaccacacacacaccacacatacacacacgtacacacaccacacacacaccacagacacacaccacacatacatacacatacacacaccacacacacgtacacacaccacacacaccacagacacacatagacacaccacatacacacccacaccacacacacacaactcataccacacatacatacacaatagacacatacacaccacacacaccatacatacacacgtatacacacaccacatatacacacacgtacacacacaccacacacacccacatgcacacaccacacacacatacaaatatacaccacacacacatacaccacacacacggtgcacatacacacacatatacacacaccagacacacataccacatacacatcacacatatatgtatacatgcatacacatacacacacacatacacacactctcctcaaggcagtttatcctctgagaactttaaatttacaaaagacacatatgtccattactttgagaaggacaggaaagaacccactttcttttgcagcaacagcaagagggccctcccgaggctcctgctccctgtcataagtctccttgttgaggacattcacagggttcagaacccagggatcctgcatgggatggtgctttgctgattacttcacctctgatttctttccactttcagaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctattatgctctcaaatacccctaagcatctatactagcctggtatgggtatgaaagatacaaagataaataaaacatagtccctgattctaagaaattcacaatttagcaaaggaaatggactcatagatgctaaccttaaaacaacgtgacaaatgccagacaggacccatcagccaggcactgtgagagcacagagcagggaggttgggtcctgcctgaggagacctggaagggaggcctcacaggaggatgaccaggtctcagtcagcggggaggtggaaagtgcaggtgcatcaggggcaccctgaccgaggaaacagctgccagaggcctccactgctaaagtccacataaggctgaggtcagtcaccctaaacaacctgctccctctaagccaggggatgagcttggagcatcccacaagttccctaaaagttgcagcccccagggggattttgagctatcatctctgcacatgcttagtgagaagactacacaacatttctaagaatctgagattttatattgtcagttaaccactttcattattcattcacctcaggacatgcagaaatatttcagtcagaactgggaaacagaaggacctacattctgctgtcacttatgtgtcaagaagcagatgatcgatgaggcaggtcagttgtaagtgagtcacattgtagcattaaattctagtatttttgtagtttgaaacagtaacttaataaaagagcaaaagctattctagctttcttcttcatattttaattttccaccataaagtttagttgctaaattctattaattttaagattgtgcttcccaaaatagttctcacttcatctgtccagggaggcacagttctgtctggtagaagccgcaaagcccttagcctcttcacggatctggcgactgtgatgggcaggtcaggagaggagctgcccaaagtcccatgattttcacctaacagccctgatcagtcagtactcaaagcttggactccatccctgaaggtcttcctgattgatagcctggccttaataccctacagaaagcctgtccattggctgtttcttcctcagtcagttcctggaagaccttaccccatgaccccagcttcagatgtggtctttggaaacagaggtcgaaggaaagtaaggagctgagagctcacattcataggtgccgccagccttcgtgcatcttcttgcatcatctctaaggagctcctctaattacaccatgcccgtcaccccatgagggatcagagaagggatgagtcttctaaactctatattcgctgtgagtccaggttgtaagggggagcactgtggatgcatcctattgcactccagctgatgacaccaaagcttaggtgtttgctgaaagttcttgatgttgtgacttaccacccctgcctcacaactgcagacataaggggactatggattgcttagcaggaaaggcactggttctcaagggcggctgcccttgggaatcttctggtcccaaccagaaagactgtggcttgattttctcaggtgcagcccagccgtagggccttttcagagcaccccctggttattgcaacattcatcaaagtttctagaacctctggcctaaaggaagggcctggtgggatctacttggcactcgctggggggccaccccccagtgccactctcactaggcctctgattgcacttgtgtaggatgaagctggtgggtgatgggaactcagcacctcccctcaggcagaaaagaatcatctgtggagcttcaaaagaaggggcctggagtctctgcagaccaattcaacccaaatctcgggggctctttcatgattctaatgggcaaccagggttgaaacccttatttctagggtcttcagttgtacaagactgtgggtctgtaccagagcccccgtcagagtagaataaaaggctgggtagggtagagattcccatgtgcagtggagagaacaatctgcagtcactgataagcctgagacttggctcatttcaaaagcgttcaattcatcctcaccagcagttcagctggaaaggggcaaatacccccacctgagctttgaaaacgccctgggaccctctgcattctctaagtaagttatagaaaccagtctcttccctcctttgtgagtgagctgctattccacgtaggcaacacctgttgaaattgccctcaatgtctactctgcatttctttcttgtgataagcacacacttttattgcaacataatgatctgctcacatttccttgcctgggggctgtaaaaccttacagaacagaaatccttgcctctttcaccagccacacctgccataccaggggtacagctttgtactattgaagacacagacaggatttttaaatgtaaatctatttttgtaactttgttgcgggatatagttctctttatgtagcactgaactttgtacaatatatttttagaaactcatttttctactaaaacaaacacagtttactttagagagactgcaatagaatcaaaatttgaaactgaaatctttgtttaaaagggttaagttgaggcaagaggaaagccctttctctctcttataaaaaggcacaacctcattggggagctaagctaggtcattgtcatggtgaagaagagaagcatcgtttttatatttaggaaattttaaaagatgatggaaagcacatttagcttggtctgaggcaggttctgttggggcagtgttaatggaaagggctcactgttgttactactagaaaaatccagttgcatgccatactctcatcatctgccagtgtaaccctgtacatgtaagaaaagcaataacatagcactttgttggtttatatatataatgtgacttcaatgcaaattttatttttatatttacaattgatatgcatttaccagtataaactagacatgtctggagagcctaataatgttcagcacactttggttagttcaccaacagtcttaccaagcctgggcccagccaccctagagaagttattcagccctggctgcagtgacatcacctgaggagcttttaaaagcttgaagcccagctacacctcagaccgattaaacgcaaatctctggggctgaaacccaagcattcgtagtttttaaagctcctgaggtcattccaatgtgcggccaaagttgagaactactggcctagggattagccacaaggacatggacttggaggcaaattctgcaggtgtatgtgattctcaggcctagagagctaagacacaaagacctccacatctgtcgctgagagtcaagaacctgaacagagtttccatgaaggttctccaagcactagaagggagagtgtctaaacaatggttgaaaagcaaaggaaatataaaacagacacctctttccatttcctaaggtttctctctttattaagggtggactagtaataaaatataatattcttgctgcttatgcagctgacattgttgccctccctaaagcaaccaagtagcctttatttcccacagtgaaagaaaacgctggcctatcagttacattacaaaaggcagatttcaagaggattgagtaagtagttggatggctttcataaaaacaagaattcaagaagaggattcatgctttaagaaacatttgttatacattcctcacaaattatacctgggataaaaactatgtagcaggcagtgtgttttccttccatgtctctctgcactacctgcagtgtgtcctctgaggctgcaagtctgtcctatctgaattcccagcagaagcactaagaagctccaccctatcacctagcagataaaactatggggaaaacttaaatctgtgcatacatttctggatgcatttacttatctttaaaaaaaaaggaatcctatgacctgatttggccacaaaaataatcttgctgtacaatacaatctcttggaaattaagagatcctatggatttgatgactggtattagaggtgacaatgtaaccgattaacaacagacagcaataacttcgttttagaaacattcaagcaatagctttatagcttcaacatatggtacgttttaaccttgaaagttttgcaatgatgaaagcagtatttgtacaaatgaaaagcagaattctcttttatatggtttatactgttgatcagaaatgttgattgtgcattgagtattaaaaaattagatgtatattattcattgttctttactcctgagtaccttataataataataatgtattctttgttaacaatgccatgttggtactagttattaatcatatctaaccaactgtaggtgttctttcctgataacttttttaaaaaatcaataaattatttttagagcagttttaggttcacagcaaaactaagcagaaagttcagagagccccccctgtcgctaaccagcctctcccaccatcaccatcgcacctcaggaaccagagaactttttaatggaaaaaaaatccaagccagctcggaggcttcctcctgtgtctgggccagcccctcgggctctcagatgcattccaactcaagctcttcacatgccagagccttccagtgcccttgagacccctcattccaaagatctcttcatagtttttctccttcacagagccaagagggaattccctgatggaacagatttttctatggcaagcccaggttttatttcttcagagtaccaaaataattagaagtttgccctgattctgctaaaaatcagaggaattaagtgggtcccagcatgggcaaggggcctcccattcagctgccccactcaccgccaacctctcttacatgtgggtggtcccaccctccacccagaactttcatggcaggagctctcactgccgtgtttaatgtaatgaagccactacctgcacatcgggaatagccacggtgtggcaggggagggttctagggagtccgagctcagactgcagtcaggcttccttaccacaggagcatgttctgagaaatgcatcattaggagatgtcatcaccgtgcgagcatcacagagtgtacttcacacatctagatggcacagcccagcacaagcctaagtgatacggcgtagtctgttgttcctaggctaatgatctgtacagcctgggactgtactgaatactgcaggcaactgcagtacaatggtaaggatctgtgtatataaacatagctaaatgttaaaaagacacagtgaaaacgtggtattataatcatatgggaccatgtgaacatcgttatgtggcacattatagaaaacccaggttctgtgtctaaacgcttaaacagataaatgagtacagatagttttctcagttctagctgtaaaagtagagttaggggatttgaactcaacacctgagaaaaagcaaacctgttgatgaagcagatgatgctaccaaagaggagagaacagcttcccaaaacccagcatcaagggccgagcagccaggaggctgggtggggatgcacagggcgaggagggcaggcagggtgcctcctgcaggcatcagagagtggaccagcaccagacgcagctcctctctcctgatgggatggccctggggctcctggtggctctgacttctgtaaagcgtctccctccggcgcctttccctccaccagccggtggctgcacagtgccctgccttgtttctttcacacagaagtgagggcaggaagcaggctgtgccagctcacaccacccctaatgctcgcagcgctgactctaattgtttccaggaagatcgcagctttgcttttgtgctgttcctggtgaatgccatccgttgtctatgcacaaacatggggctgagagtaaaccacatttccttgtggaagcaggacttcaggatagccaggtccacgaacaatgagaaaatccggagcttcccagcattctgctcaaggcccagcatcccatatcggaacccgccgcacccactgctctctcagctcctgagcctccacaccctggctgcctgggaacacctcaggcacatgcaggtttaatataatcaaagccttcaattagggggtttagtccatatggaggaagtccagattctgcagatgagacaagcatggggagcattctgaggtgctggctttctgagcctgaaatgttcccccaagtggaggccacggccggccatcccactgaacagccttcacctcagggcagactcagtggcaccactgatttgtcactgaccgtcacgattccagctgaagctgggtgcagatggggtttcagctggaagaggttttccctttgggccagtaatcctataaaagtcatcatacctgtctggggagatgggcgatttccctagaatggagagtccaacgtgcaggagggagctgctcttcctgtcgggccttgggtgcacccctcatagggctcaggtcccactgctccagaaaggacctttaaacactcaggtcgagaagcagcaagatcacatttggtatttgccctagtcttaaaaacaataaacaaagcatgatagggagcccatgggcagatgtctgcaatttataaatgtgtgccctgaagcaccctcacccttctgtgctcatcacctctgagccccggggacatgcaccccggggaggccagccctgccctcactgccttctgtggcctctgccttccatctttctctctacatggacgcagggctaggaaacctagagactgggttctaaaagaaatagaaacctcttttttaccctgctcctgagagtcaacccttctgagctcaagcaaagggcattcccggtcctcagctccttgcccccacatagatctgaagtgagcctgtaccgcccacctctcagttctcaactgtcgcttaatcctgccccacaataggccacccctgggctacaacttgagcttctaggtgtgcacactgaaggctctgaacaggctcacagcccggggacactcggcaaggactccccacattcccagcacctgagcgaggcccagaaaagagaggggcaggcaccagattggcagctttgtatcctttctgcccacccccagggaaagggtgtagcccatatatggggaaggggggctggggaggccaggggctctgcaagccagggtccacgtcacttaggactgaaggcggcactgcccaggcaaatggcacctgaaaacccaacaggaacctggaggcccaaagcctccaggcgcctaaaaacccattcacttttctaaactgcatagtcccttatttgaaccagtaatgtccttaaaacctccagtgcagctctatctcggagggagtggaggtgggacctgggaaagccatccctctctcactccagatggcttggggccaccccttactgactattttcattctaaagaggttgcttctgtcaccctttcagcttctccagacccctctccttccatctttctctcttgtataatctaacctttcctgaacccaagcagaaatgcagtgacaaacccacaagatattcaagtgctggcacgcttctctctgcacttgcactttgcctgggctgactggcttctcaagggcaagtctaagggaacactggccagtgccacatacagactttaggggtcagggacaaagagatgtgatgtgtgatctacagcgtttctcctgtagatcaatgacacagaagacgccggaagggcaggccccattgctgaaacgtttgccaggtccaaatggttttggagcacacttgcaaactttcaaagaacagctaatttttgtattaaagtgtttcagagcacaaaaagatgggaagtttctcagtttattctacaaggtccgaatagcactaaaaatcagagagatactagaaaaagaaaactatagctttattcatgaatgtagatgtagaaatcctaaatgaaatgtaggaaatggaattatttattctaggaattaaaagatagctcattttgtttatacacgtgaggaaaataataggtgaaatgttaatattaactcatgttcataaggcatcaataacgcccaatcacattgctgttaaaatctcttagtcacttgggaatagaggacaacatgtttaattggattaaagtatctgtcaaaaattaataagaaacatcaaacataaaagtgaaataccaagaacctagcaccttaaatcagaacaagacaaggataactattatcacatctattattcaacactccagaaatccagtgttttgggggacaagagaagacatattacttaaatatgatatatttgcatcattagaatatagtcagaaaaccaaatctagtcagcagcctatttctatgaggttttattaggacacagccatgcctacttatttatgtattgtctgttatgactgcttttatactacagtggcaagttgggtagttggaactgagatcctttgacctgcaaagccaaaaatattccctgtctgactttttacagcaaaagtttgcctctcccaaaataattaactgaaaacaaaattaaacaagaaaatcagtagggtaagcacatagaaatataatcagtagtttttctacataccatccatcattaattagacaacataatggaaaagaattccatttaaaatagcaactaaaacaacaaaatatctagaattaaacttaaatgtgtgagaataatatgaaaacaaaaactaagaatcctttctgaggcataaaaggagactcaaaaagatatattacattcatggacatgaagacgatgttataaagataccaattatccctaaatataacatacattcaatgcaattcaaatgaaaatttcagtggttattttggggagtataagctttagaatttggaatctagaatagaaaatgtaccacagtagccaacaacatttggaaaacaattgagtagtgaaggaatgatacaaaaatatactatataaaaataataactaaatcagcacagtaattaacggaaacatagtttggaagcagatacgtgtgcataggaatgtgtccatgataaagaggacatctccagatgggggacatgacagactacccagcaaatgattttggagaaaacgcctatacatttgaaaattaattatggttctatttcacactctacccaaagacaaatttcagatggaccgaagatctaaacataacagccaaaacaaagtattgggtaaaatctatgtgaatatttttgaatctcaggaagaggaggtgatcctagtgcatagcacaaaaccccaaaggcataaagaaaaagatggacaagaaggaaatccaatgtttttcagtttttaaaggaaaaataactaaccactgaagaaaagccaatatatatacagggagaaaaactttaagatatatcaacaattaataccctaaaatgtgaagtattccaatgaatttgtaaaaaaattaaacactctattaaaactttaacagtgtatcaatggacaatttatggaaaaaatacaaacggcaaatagcactaataagtatatagcctacctcactaacaatgaaagaaatgccacttaaaacagaatgataacctttcacccacattttggtgggaatgtgaattactataaactttttgaagggcaaacaaaattttacatttgtgtatcctcttgatatggcaacttcacttgtaaagataaattctgttaacatattcaactatagaaagatatataaattagaatgttcactaaaccacagtttgtaatggagaaaaaaatggaaacttttaatgtccatcgaaagggaaactatcccataagtcatggaacatcataatatagaagtctgtgcagttgatagagcaataaatctggccaggtgcagtggttcatacctgtattcccagcactttgggaggccgaggcaggcagatcacttgaggtcaggagttcaagaccagcctggtcaacatggtgaaaccccatctctactaaaaatacaaaaattagccaggcgtggtggcgggcgcctgtaatcccagctacttgggaggctgaggcaggagaatcgcttgaacctgggagacggaggttgcagtgaaccgagatcatgccattgtactccatcctgggcgacagagcgagactccatctcaaaaataataataataataataaatccatctgcaatagcatggaggtatatctgagagagagagagagttttaaatgaagcaaaacaagttactgaataatagttttgttttgaaaaaaagcttctatttgtgtatatgtctgtgtgtgtgtgtgtgtgtgtgtgtgtgtgtacaatctgaaaacctcttggaaatattaatgtcaattaactaatggtggagacctctagtgagtaaggagtagaatgtgaaatgatgaaatgacaaagaggaaattttactttttattgtatacacttctgttgcttgaatttttataatgaatatatattacttctgcaattgtaataggaaaaatattatgtgtcagttcatggcctttccccttccttccacttgcaacagaacatttagcaatttcttatttaattttctcttcttcctgatctctctcccccagaacaaaatccttgctgcacacctccctgtgggaggagccctgagtggaagcgatgcaggcctagtgggccgaggtggtggggtgtgtgtttcctgttgggaccacttcaggtggaatgccctggctcctgggagaccaggacggcccatgtaggcacaggggtgagatccccattggtgtaagagggcatcagccagctggcactgccctcacagagtgctgtgggcccagtggctgacacagtggtgtttacttctcacagtcctagagtgtggaagtctaaggtcaagatgctagctgattgggctcctggtgaaagagagagggagcactctggtgtcccttcttaaaaggatgctaatcctatcctgagggccccactctcatgacttcatctaaccctactcacttcccaaaaacttcatctccaaataccatcaccttgggaattagggctccagcatatgaatttgggggggacacaattcagtccataacagagaggtgtctttattttaggctgcaagagaaaaaggaatgatagaggactttaatcaaagtatatgcacccaaccgcgtaagggacagccaagaattacctagaatgtatgtctgcgtcctgtttctttttttgagatggagtctcactctcgccaggctggagtgcagtggcatgatctcagctcactgcaacctccgcctcctgggttcaagcgattctcctgcctcagcctccagagtagctgggactataggcaccagccaccacacccagctaatttttgcttttttagttgagacggggtttcaccatgttggtcaggatggtctcaatctcttgaccgtgtgattcacccacttcggcctcccaaagtgctgggattacaggcgtgagcccctgcgcccagcttgagtcctgtttcctgaagtgagatactgatccaagtctcagccatgatgggtcaacgtttcaatacaacacattttaaatcctaagaaacaaataatatttttaaatgtattgcttacaggaaccagcaacagaaagagttgcaatgtgcttttatttttttttttttttttaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccggacggggcggctggccgggcggggggctgacccccccacctccctcgcggacggggcggctggccgggcagaggggctcctcacttcccagtaggggcggccgggcagaggcgcccctcacctcccggacggggcggctggccgggcaggggggctgaccccccccacctccctcccggacggggcggctggccgggcggggggctgacccccccacctccctcgcggacggggcagctggccgggcagaggggctcctcacttcccagtaggggcggccgggcagaggcgcccctcacctcccagacggggcggctggccgggcggagggctgacccccccacctccctcccggacggggcggctggccgggcagaggggctcctcacttcccagtaggggcggccgggcagaggcgcccctcacctcccggaccgggcggctggccgggcggggggctgacccccccacctccctcccggatggcacggctggccgggcggggggctgaccccccacctccctcccggttggggcggctggccgggcggggggctgaccccccctcacctccctcccggacggggtggctgccgggcggagatgctcctcacttcccagatggggtggctgctgggcggagaggctcctcacttctcagacggggcagctgccgggcgggggggctcctcacttctcagacggggtggttgccaggcagagggtctcctcacttctcagacggggcggccgggcagagacgctcctcacctcccagacggggtctcggccgggcagaggcgctcctcacatcccagatggggcggtggggcagaggcgctccccacatctcagacgatgggcggccgggcagagacgctcctcacttcctagatgtgatggcggctgggaagaggcgctcctcacttcctagatgggatggcggccgggcggagacgctcctcacttcccagactgggcggccgggcagaggggctcctcacatcccagacgatgggcggccaggcagagacactcctcacttcccagacggggtggcggccgggcagaggctgcaatctcggcactttgggaggccaaggcaggcggctgggaggtggaggttgtagtgagccgagatcacgccactgcactccagcctgggcaccattgagcactgagtgaacgagactccgtctgcaatcccggcacctcgggaggccgaggttggcggatcactcgcggttaggggctggagaccggcccggccaacacagcgaaaccccgtctccaccaaaaccagtcaggcgtggcggcgcgtgcctgcaatcgcaggcactcggcaggctgaggcaggagaatcaggcagggaggttgcagtgagccgagatggcagcagtacagtccagcttcggctccgcatgagagggagaccgtggggagagggagacggagacggagacggagagggagggggagggggagggggagggagagggagagggagagggagagggagagggagagggagagggagagggagagggagagggagagggagagggagagggagagggagagggagagggagagggagagggagagggagagggagagggagaggctaattggcaactctgcaatgtgcttttaaaagggagttgaagcagcagggtgttgggtgttctcagtcccacaagagaatttatccctgatgcatgcaggaatctactgaaaataattaataccttctctcctacccttctagaattgtgctagttatgcatcatccttgggggaatagagacaacggtcacctatttgttttttgtagggcttagttctctcctgggaccttagttgagaaaggcccactagcattccagaataaaagatgatttcaaacttcatctactaccttaaccaaaagaaagacatataataatttagtaaagttctaattgaacagtgaaagaattacaactaaggaaataataagtgattatatagagagagagggagagttttaatatagacaagacactgtcctgagtgtacatctaagacagaaattattatttccactttacagatgaagaaacatttaaagtgcaatattacactgctattttggacacagtagcatagatctactacatcagtgttttaccttcctaagaaattcaatagggaaaagtcaggtcaaccttgctggggaccaatgcctccacagctggatatttcctggagatcagctaccacactgcctggacaccaaccccaaactaaaaccagtcagctctggggtagaccaggacccagggctccctgagagcgatcagacccacagtcttatgccagcatgcgctgaagacgcttagcccaccgcagcacacatttactggcctactctgtgccaagtcaggtgtttagcactgcggaaatacctaggccagtgctccaaaagaaacctttacacccgcagatgtgcacacatgcacctgcgcacacacagacacacacacacgaaatttggcgaggagccctgggcagagataaccctaccctcacctgacagaggaggattctggcaactggtgaccaccaggctgagctcctgcaacctggtaaactgtcaaagtattgggtaaaatgtatgtgaatatttttgaatcttaggaaggggaggtgatcctaatgcataacacgaaactccaaaggcataaagagaaagattgataagaagactgtttgatgttttttaatttttaaagaaaagaataattaaccacagaagaaaacaaagtgggaggagaggctgactctttccatgttaaagaacgaatcaaaaactcagcatgggctctaaaacagcattgttcattataaaaagtacagacataacacagaagataaagcagcatacttctgtgtctagaaaaacgtaaagatctccttaatgaggtcctggaaaagctaaaaccggggaggcagtataaagatgcatgcttgcagggagccagcggggagggacagatgaatccgctgaacacgggggattttcagggcaggaaattactctgtatgagcctgtaatggtggatatatttgtccaaacccagagtatacaacaccaagagagaatcctcatgtaaaccgtggactttgggagatcatgataggtccatatattgtaagcaatgaggctctctggggcgggatattgataagggggatacagtgcatatagggggacaagggctgtatgggaaatctctgtgccttctgctcaatttggctatgaacctaaaaccactctaaaaataaagaatttttttaaaaatcactttaaggggaaaaggacactcattttaaaccaacttttttgtactcctggcagagtctgctagagcgcaagcttccccgccgtgcctccctttcttgcacatgggacgtcgcacttccctgccccagaggcaggtgggccacgtgactcgctctgacccacaggctgaaaaggaagtgacacaggaaactcccaggacactgcagtgcagatgccacctgtgtcctaatgactgctggagcctgtgtgcagatgggaacagagagggcccatttcaggcttctgccgtgacccatggatgtggcttagagcctgcgttttgaagggttcctcttctgggcctgcttgctgtcccttcactctgctgcttccactacatctatacttctgcacaggctcgcattttcagtccaaagcagggggctgttgactcaaggggttgtcatctttcagcacccattcatgatggcaattctttctttccaaaaatagctttaaacatctactttgttccttttgagcattttctacaaaagttacctaggatattagccaggtcaacactacttgttcatatcttgccactaggaagttttccatccagccagccatccacccatccatccacccacccatccatccatccatccatccatttgttcacttatctgtgcattctcttgataagtattactaagcacctacatgcccgctactatgctagacactgggaattgaatgggaacaaagccagcaaagccttgtccctaccaggaaactgcagcttatttctatgtccctctctttcctggacacacaggactttaaaaatgtgagcctgaagtcaccatggagttccagaatagccatattgctttctttagatggttctgtttttctcagggatgtatttgcttattttaaatacttccaaaactcctcattgagctttcctatagaaggtcacacctctctcctcttgaaaagaattccaccttgccaggtctagtattatctaaataaccccgacttcccctcgctctttatcacaaactaaagcaatgcagaccttctatcatcttccacttggacccctgggtgagcccaccaacctgtcttcctgactctgcaagtgggtccctcacatccctcctccacaccaccccttcccagatctcaccacagctctcacctccttcaactgcacattgccttggggataaagcccaagctcctcagctggacgcccattccacacctcagtgtcctgtctgtgccatacgctagcatcctcctcaccctatccagctcttactcgtccatcaagacccagcacaggtgccatcacctacagaaagccacctctgcaccccaggtggggctaagccccgcctctcagagccttcatagcaccctgtacttctatcctcacatgacgtgtcaatattgaatatcccactgtgtagatttttttcggactagaaaaaggctccttggaaccagggactgtgtcatattactctctagttctctggtgcctggatcagcaaccggcacatagtaagtgctccataaagggttgatgactgagccagcacagccactgcctgcaccttctggcacagctcctgcctgcacctgtcttttactgaacaggcaatccttccacttagatccagaacagggcagctcctgtagcgactttctccttgttttgtgaaattaacttctcagtgatcaaagggaagactttcagcaaaatgaaatgaccagcacaaatctaattaaaacccctcatcaggaaagggcctgaatcctgtctccgtctgttgagcagcatcaggaccacctcatttacccatcagtaccctacacccatccccagtggcaggacaccctcctcctgccactctgtactgtcctaaatgctgcagtctcgcctacagtcttggatatgcacatccatgtaacataggctgtacaaggatacagccttcttcttaacaactgcaatgtcatagatgctactggatcttcttttggtggagagggacacctactccatcataattctgcatcttgctgttttccctcagcactgccttggagacctttgtttacaacataaaactctaggttgttctttgtaaatatcacatagtactctacagtgtgactataactttttttacacagctatttccctgttgatagacctttggaagcctttcccctgtctccactattataaataattttgcagtgaacataactgcatctcctgggtacctccaaatgctctctcggaaacaccacaatgaggactcgctttgtccaggggtatggagatgctgtactttcaatagatactttcaaattgctgaatgatataagggggcccatttcttcacatccttgccaatgcttaatactatcaaatttcataatttgtgtcccttcaaggatttttcttttggtttttgccttgtcctactgaaaatgggcattgtttctcatttttatataaaaatatgcttatatttacatagtataaaatttaacatgttgaaatattttttctttattacccactgaaatttcttctgtgaccttttccttttggatttgtcttgtcttttttttctttgatattcctcctcttgtgcttttttttgttcaacttttattttaagttttggggtacatgtgcaggatgtgcaggtctgttacacaggtaaacgtgtgccatggtggtttgccgcacagatcatcccatcacctaggtattaagcccccatgcactagctgttcttcctgatgctctccatcccccaaccccagacaggccccagtgggtgttgttccacctcacgtgtccacatgttctcatcattcagctcccacttataaatgagaacatgtggtgtttggttttctattcctatgttaatttgctgaggataacagcttccagctccatccatgtccctgcaaaagacataatctcattcctttttatggctgcataatattccatagtgtatatgtaccacattttctttatccagtctatcattgatgggcatttaggttgattccgcgtctttgctattgtgaatagtgctgcagtgaacatacatgtgcatgtatctttataatagaatgatctatattcctttgggtatatactcagtaatgggattgctaggtcaaatggtatttctgcctctagatctttgaggaatcaccacactgtctttctcaatggttgaactaatttacactcccaccaacagtgtaaaagcatttctttttctttatatcctcaccagcatttgttgtttcttcaatttttaataattaccattctgactggcatgagatgatatctcattgtggctttaatttgcatttctcattgtggttttgatttgcatttctcgaatgatcagtgatgttgatttttttttcttatgtttgttggccatatgaatgtcttcttttgggaagtggctgttcatgacctttgctgactttttaatggggttgtttgttttttctcttataaatttaagttccctgtagactagatattagacctttgtcagatagatagattgcaaaaattttctcccattctgtaggttgtctgttcactcagattatagtttcttttgctgtgcagaagtttaattacatcacatctttagtttaattacatcacatttgtcaatttttgcttttgttgtaattgcttttggtgtctttgtcataaaatctttgaccattcctatgtcctgaatggtattgcctagattttctgctaagggctttatagttttgaattttacatttaagtctttaatacatctggagttaacttttgtacaaggtatgaggaaggggtctagtttcaatttctgcatatggctagtcagttctcacagcaccatttactgaatagggaatcccgtccccgttgcttgtttttgtcaggtttgtcaaagatcagctggttgtaggtgtcagtcttatttctgaattctctattctgatccattggtctaagtgtctgctcttgtaccagtaccatgctgttttggttactgtagccttgtagtatggtttgaagttgtgtagcctgatgactccagctttgttctttttgtttgggattgtcttggctatttgggctcttttttgggtccatatgaattttaaaatagttttttctaattctgtgaagaatgtcaatggtagtttaatgggaatagcattgaatctataaattactctggacagtatggccatttttatgatattgattcttcctatccatgagcatggaatgtttttccatttgtttttgtcctctctgatctctttgagcagttgtttgtagttctccttgaagaggtccttcacttccctcattagctgtattcctaggtattttattgtctttgaagcaactgtgaatgtgagttcattcatgatttggctctctgcttgcctgttgttggcatataggaatgctagtgatttttgcacattgattttgtatcctgagactttgctgaagttgcttatcaccttaagaagcttttgggctgagatgaaggcatttttctagatataggatcatgttatctgcaaacagagacagtttgacttcctctcttcctatttgaatacgctttgtttctttcacttgcctcattgccctggccaggacttctaatactatcttgaataggaatggtgagagagggcatccttgtcttgtgctggttttcaaggggaatgcttccagcttttgcccatttacgatgatattggttgtgggtttgtcataaatggctcttattattttgaggtatgttccttcaatacctaatttattaagagtttttaacatgaagagatattgagttttattgaagtccctttctgtgtctactgagataatcattggtttttgtctttacttctgtttatatgatgaattacatttatttatttgcatatgttgaaccaaccttgcataccagggatgaagcctacttgattgtggcagacaagctttttgatgtgctgcttgactcaatttgccagtattttgttgaggatttttgcatcaatgttcatcagggatattggcctgaaattttctttttttgttgtatctctgcaaagttttggtatcaggatgatgctggcctcatacagtgagttaggaaggagtccctcctcttcaattctttgaaatagtttcagtagaaatggtaccagctcttttttgtatttctggtagaattcagctgtaaatctgtctggtcctgggcttttcttcgttgtaggctattaattactgcctcaatttcagaactcgttattggtgtatttagggatacaatttattcctggttcagtattgggagggtagatgtgtccaggaatttatccatttcttctagattttccagtttatgtacatagtaatctctgatggttgtttgtatttccttggtgtcagtagtgatatcccccatattatttctgattgtatctatttgattcttctctcttctcttctttattagtctagacagcagtctatccgttttattaatttcttcaaaaaaccagctccagctgggcatggtggctcatgctggtaatcccagcactttcggaggccaaggcaggcggatcacctgaagccaggagttcaagaccagcctgtctgagatggctaaactccatctcttctaaaaatacaaaaagtagccttgtgtggtggtaggcacctgtaatcccagctacttgggaggctgaggcaggagaattgcttgaacccaggaggggaggttgcagttagctgagatcacctcactgcactccagcctgggtgacagagcaagactttgtctaaaaaaaaaataaaaaataaaataaaataaaacacagctcctggatttgtttgtttttttttgaaggttttctcatgtctctagctccttcagttctgctctgatcttggctatttcttgtcttttgcaagttttcaggtttgtttgctcttggttctctagttcttttagttgtgatgttaggttgttgatttgagatctttctagctttttgatgtgggcatttagggaactatagagttccctggtagcactgctttagcagtgtcccagagattctggcacaccatctctttgttctccttagtttcaaagaacttcttgatttctgccttaatttcattatttacccaggagtcattcaggagcaggtcattaaatttccatgtagtcttgtggtgttgagtgagtttcttaatcttgagttctaatttgattgcactgtggtctgagagactgttatgatttcagtgcttttgcttttggtgaggaatgttttacttccaattatgtggtcaattttagagtaagtgccatgtggtgatgtgaagaatgcattctctgttgttttgtgggggaaagttctgtagacatctatcaggtccacttgatccagagctgagttcaggtcctgaatgtctttgttaattttctgtctcaatgatctatctaatattgtcagcagggtgttaaagtctctcattgttattgcgtgagcctaagtctctttgtaggtctaagaacttgctttatgaatctgggtgctcctgttttgggtgcatatatatttaggttagctgctcttgttgaattgaactctttaccattatgtaatgcccttctttgtctttttttgacctttgttggtttaaagtctgttttgtcacaactaggattgcaaccgtgctttgttctgttttccatgtgatggttaaattttcctccatccctttgtcttgagcctacatgtgcctttgtatgtgagatgggtctcttgaagacagcataccaacgggtcttgactctatcaagtttgccattctgtgtcttttaattggggcatttagcccatttacatttaaggttaacattgttatgtgtgaacttgatcctgtcatgatgatgctagctggttattttgcagacctttttatgtggttgcttcatagtgtcactggtctgtgtacttcagtgtggttttgtagtgtctggtaatggtttttcctttccatatttagtgctcccttcagaagctcttgcaaggcaggcctggtggtgacaaattccctcagcacttccttgtctgaaaaggattatatttctcctttacttatgaagcttagtttggttgaataagaatctgggtcagaaatcattttctaaaaggaggtttaatattggcccccaaaatctcctctggcttatagggtttctgctgagaggtccactgttagtctgatgggcttccctttgtaggtgacctggcctttctctctggctgctcttagtattttttctttcatttcaaccttggataatctgatgattgtgtcttagggatgaccttctcatggagtgtgttactggggttctctgcatttcctgaatttgaatgtagatctgtcttgctaagttgcggaagttctcctggataacctgaaatatgttttccaacttgcttctgttctccccatctctttcaagtatcccaatcagtcataggttcaatctttttacataatctcatatttcccagaggttttattcatcccttttcattcttttttctctattcttttctgcctgtcttatttcagaaagacagtcttcaagctctgagattctttcctccacttggtttattctactcttctattaatacttgtggctccattgtgacattctcgtgttgtgtttttcagctccatcaggtcagttattttgctctgaaaacgagcaatgctggttttcagtttctgtattgttttattataattctttgcttctttgtgttaagttaaaacatgcttttttagctcagcaaagttttttattactcaccttctgaatcctacttctgtcatttcagtcatctcagcctcagcccagttctgtgcccttcctggagaggtgttgcagtcatttgaaaaaaaaagggactctaactttttgagttctcagcatttttgcgttgattccttctcatcgttgcgggcatatctaccttcaatctttgaggttgctgacatttgaatggagtctttttgttgttgatgttgttgatgtttgtttttcttttaacagtcaggccacttttccacagggctactgtggtttgctaggggtccactccagacctagctgcttcagtccttcctgcacctggaggtatcaccagtgaaggctgcaaaacagcaattatgacagcctgctccttcctcttggagctctgtctcagggggaccctgacctgatgttggcccaaacagtcttgtaggagatgtctggagacccttcttggggggtctcactcagtcaggaggaacaggatcagggacccacttaaagaagcagtctggctgccccttggcagagcaggtgcactgtgctgaagggaacctccctcatgcagactgtctggactttctagaaccaggaggctggaaaaactaagagttggctcaatggcagagacagaggctgctcctccccctgggggctccatcccagggagatcagatttctgtccatataaccctagctagagttgctgaaattcccacagggaggccctgcccagtaaggagggatggaccggggtcccacttaaagaagcagtctggccacagtctggcatagcaatgtgccgcattgtggggagcgcctctcagtctggaccactcaggctccccagagccagcaggctagaacagctgactcaaaccagagagatggtggccgccactcccccctggggaactcagtccatcttaggcagtctccagcttgctgccactagctgtctagaatgtcaagccagtgggtcttaaattgtgaggtgcagcagaggggccacagaatgatgccacttggctcccctagatttagcccccttcctaggggaattctgccttgccagaattaccggggctagagtatgcaaaactcctgggtctccacatgtgcatgagtggccactccactgagactccacacagctctgtgctttggacctaatgccccggtggaatgggctcacgaggggatctcctgatctgcaggtttgcaaaaatccatgggaaaagcatggtttcccagacacggtcgcacaatcactcaccacctcccttggctgggttgggggctcccctggctctgccactctcaggagacccataccccaccctgtacttcattgctctctgtgggttgagcactacatctcgtcagtcccaatcagtcccagtgtaagaacctggatatgtcagttgaagatggagaattcactccttttatttattttcatttttcaagactgtcttgctctattgcccaggctggagtggcggatctcagctcactgcagcctcggcttcctgagctcaagtgatcctctcacctcagcctcccaagtatctgggactataggcagttaccacctcgtccagctaatttttgtagtttttgtaaagacaggatctccttatgttgcccaggctagtcttgaacttctgaacaatcctcccacttgaacctcccaaagtgctaggattacagttctgagccactgtgcccagccttctctttttattgacttataaaagttcattatttattctggattttcatttttaattttctgatcacatggattatacattgtaaatattatctttggtaaaatgtaattttaaattttttacatcaactttattttttgataaatgtgatgctttgtacatcttgctttagaaggccctcattttccccatagacataaatgttctcccatattcttgtctagctccagggaactttcatttttgacttcatgactccagcagaagactgcctctggctgcccccaatgtggctgcttctctcattccaggcccaaccttcagttggcatttccaggcccaagtcccagcccgccaggcctgccatcctcattgccatctgctcacgtccacccttacaatcgcctattgctcccagcatctcagcgtgtgatgaaaggtggatggaagcattcccagtgcccccaccgccttcagaatgcaggccctgactttctagctctggcgaagaaaagcctcccaccacccatggcacctggagaccgaggagcaacctgggtcttgaagggtgggagatgcatgcaatccctggacagctctaaaagatgcttctctggtgcttccaggcagagaactagcagcagcgggtggttgcaagggtctggaaaatcttggcgggctcggtcacagcctgcacaatctttcccagagaattgccacagccctgttggaagaatcagccctaccaccaggcctctcttcttccagggccagctccctcacccaccgcaggcctgggaagccccttaggactccccacttctctggagcctgggcagacctcttactactgccctttttccacaggagagaactctttcctctgtccttgtctgtctctgctgggcatctgacacgttcacctgggctgcaccttgaggaacactctgcctaagtcccaggtcaacaaggaagggagaaggtcacttaggaatgaatctggcacaaatcacagaaaacaatgtgattccaaaacgttcacgctttaaacaaaaaggggttaatttccttacttaggataagccccaagggagtcagcccagggcagatggaagagctcagcatcgcccagaggcaccgccctgactgtgccagctttcatcatcgtaccagcttgcaaggttgctgctgcccctcagctgacaagttagaattccaggcaggaagatgagggacgaggagagaggaatggtgagtgaacccagccccgttggatcagaaaacctagacgccgggttgtgtatcatctgccaggtcactggccccagataaagagagctgcccgagtttcgtagggcagccgcgttcctccaacctgggttgaggaggtcaccctcccgggattaagggtttccaccaatgaccctaacagctggggctactgttagcagaaaataagagggaagaaatgtagctgggcagacagtacccagggcacacacaggagaaacccaagggagaacagggccacggcagtggacacactctctaggctggaggtcggggccccatcgcagcctccgtcaggcaaggtgggagatggaggctggacatgagcctgcgcagtgggtcagggtgcgttcccaggcttctggggatgccagggatgtcacactcccacagctctgtggagcagaacaccagggggctaatgggggcccagagagcagagtccaacccatcaggaaggccctgggaaacaggagcaggagggtgaagagaaggcctagagagcagcctcgggaggaaactcacaggcacggggcagcccaggcagggctccaggcggaggtaaccaaacccaaggtccgctgctcgctgctcgaatccaaacacacgagagaactggtgggaggaaaagagtgccagcaagccaagaagatggccaactagcatcctacagcaccacctcgagtcgctacaaactttaggctattttatgttaagggcaggagacagaggagggggttgggatcaagaggtaatggaggaccgcagacacctgggagccagcacgggtccaagaaggtggagaatggctttgtcacagtgctcttggttacagtgctcttggtcaggtcacagtgctcttggaaatctttcacaaaacatagttgtttacatacttctcctttagtcccaaagctagttttaaaaactacatgattgctgttaattttctctgtactctaaaattatcctcccctacgtgcaagaatgggtaaagaccccttaaaaatggagttgtgttcttttgctgtttcactgtcatagcattacagaggaaagccgtgactttggagacatagaggggctccgcattgctcccaggtgcgccccaggagttctgggaacaagatcagggcaggaaggccgattctagacctcacacccggcgggagcgagctctgcccttgccggaagtgaccaggttgcggttgcggttgcagttgcagctgacctgcactaaggcagcccggctgcagagggagagcctgggaagtgcaggtaatgcagtcctcaggcctcctccacaccccatttcagtcatgcagaccccaaaccctgcggggctctgtgccaggggcttcaggcctgcggtggctctagcgggaaggtggggaagaataccctcttttcttgactcaccatgacccccggcccagcctcctgatttgggtttgattttctccattgtaccagacttgggcactctctggcttatttgtgcatcatcgcctccactccctgtgggagcgctgcactcacgggggcagcctggggtgtggaaggcctgagagccctgcagaccgctcatgcttcaggccccatggccaggacctggaacccctttgctttttccctgcccccttcttcccacctagaattctaacgtttgcctggaggtgcagcagccatcttgcaaccaggagggatgccaagcacctagtgtgttagttttgttacctggagcctttccttaagactccttagtccttcccagcttgctctgtttccactctcttccccctcagtctctccagctcctccctttagtagcacagaacagtgaataatcacagtggtcattcactgcagaacaagaaataacgaggtgccgcggcacagagcctcatttattttggagttttcattcgtaaacaagatagaattgagtatcctcttgctagtaaattatctgaaatcattggcataacgcatcttgcttaataaagactgcaaggctgctacaaagtcagaagttctgtccagaagttggtttggtatcttccttcttccctacttttttaactcacccccgaatttacaaacaacaccaattttctgtgcctctcctacacagcatcccccctgcagccctctaaacatggccactgtcccaaattgggtgtctatcatgttcttgctttttaaaaacagttttatcacaaatgaatgcatttctaagcaacatgtttcattttgtttgatttttgttgattcttagtttaggtggtcacctttctccacttgagactatgctggtaagattacccatgttttgtcaaagtacattgaatttatttcctgggctgtagtttcgtttgcattcaaacaaaagatgacgagaattataagccccttcctcctgctttagcctaagtggcattctgtcctccacggtgaattttgcagatggctcacatcatcacaggcacagtgtcaggcctcactcaaggatagttttttccgacatcagggtatttcccctgcgagggaagcaaggactgccacaggtgtgaaggttgtttagtgaaatgagagtgattttaataggtcataaaaagtgttattgcttctctcatttggaattgctctgcagaaaacagaaacgatcattttatttctcaggaatgcatttcattagctctaaggtgatatcatcatatcgacatagcctgtactgctaagagagagggtgaccccacgatttgctcagcggcccaacacagaaggatcttgtgatcaattgcatttctcttggtcctgaatgcatgtaacttcagcctcaactcgctttccatatggtctcaataaacaaaattcagcaaaaaaatgagtgccctaagcactgcaggcactaagcatcctctggagcaagagctgcgagatctggcctggtcctgggtttgtgagccattcgcagtgtgccctggagtggcccttcccctctggcctcagttagctcatctgtaaaatgaggacactggaccagatggtcttcactaatatcccttccagctccacaattccagaatctttcaacttagaaagaaacccagagagtagaaacgtgactggcgaattccagggtgggaaaagcgttccagccggtggcctgcactgcatgcatattcatggtgctcgcagcagccagagatgccccattgctttattaatctgcttcactgagcccaagtttgggttggaggtagaccaagactaactggcaggtgatggaacttcagttttcctttctccctaacaaaacaacaagatccactgcctggtccagcctgcccacacgcattttgcaataacaaagactctctgaggcagcttcgaaagtaggagctatgcggactctccagattctaaagttagaaggtgaaagcaatcgcctgcacctgtcctgggattgagcatggcctcatctcacaggaggacaggagcacagcccctcctcctgatctgaggccggggttgagcacagcttcatctcacaggaggacaggcgcacagcccctcctcctgatccgaggctctgattaagaatggcttcatctcacaggaggacaggcgcacagcccctcctcctgatccgaggctctgattaagaatggcttcatctcacaggaggacaggagcacaccacctcctcctgatccgaggaactcatccaggctctgctactcactaatgggtaggaccttggcaaatcctgcatcccctgtacagtgagatgtgggaccagagggtccctaaggctaccccatctctaacggattgagatcagacaacctgtctataataaaagaaacaaatgcagatgcctattcagagagatataaatgtatatacaggaaaagaacttggaatcgagatgctgccttcctccgtgtctgggatattcatcaagcacctgctctgtgctggactcaggctttgtgtccttcaaacactatgccaaggttaagcagacagtaatattatataacatatggaatacacaaatattccatttcacagatgaggaaactgcatcttaaagacagtagtaactttcttaataacacgtgtattagtcacacaaatacaaaatgtcactgttaggaattgaaccggggcctgacccaaagtacaagctacataaacaatagatcttggatgtttttgcatggtggaaaacaccacgtgaagaaactgctgagctcctcatggtggggcactgcccgcagtctaggtggagcgtgtgctctgggctcgcacctcccagcaaaccggcttctctctcagcatcccccgtctaaacactgtaattgggaggaaaaagattgacaagtgactcagttatggctgcacttctgtgatgagctgcacatagagggtgaaaaggagcagttctgcttacctttgaatttttatgaaaaaagaggagcagagatgcattaagcctgtggaagcacttcctggcactgcgagtttccaattcaccactggagcgatttttacacacctacatgaaataaagacccgacagttggggtggcttcgtcacatagaaaaatctgtaatgattctgtggaaatgagcttagtaatttttaaataactcatctagaaggaaataggactttttaatatgcaggcacagctttcttctcagcaattcaaggtaaatattttatagaatgcccacagtgctctcgcctgttcccaaacattagaaaaaccataaaccataagggtcccccaatgccatgcacagtattatgtaaaatgtgagtctcttttataagtgggaaagaagcataagctgaaaagacatacagctgtttggatttcaatttggggaaccaagtgtatccgcctcataggacaactcagattctggtgaaaagcaataaccacattatggcagcagaacaaggggccaaaagggagaaaaacaaaacgcagtggctgcctgtgccttccctcccttccttctccctcagtccacttggtcaaggagtggagagcagatgtcatgagcagtgcaaggttagaaataaccaggtccatgcacgtttgtgtctttccacaatatcagacttctactgatgctatttcagtcactaaagccaggagctccatggagttcccaaggaggcattctccttagtacaccttgttcactcagcagtcagagctatgggcacacaggctcaggccactccaccagtcagacaatattgcaaaccatacttcatcaatctgtaaatattacagggtccatattctgcaaaaaacaaagtaacatttaacagcaagaggaaaaggagatagtaaaaagggttaacgagccagtccaggggaagcgaagaagacaaaaagagtccttttctgggccaagtggtccatcagtcttggaaggaagagtcttagaggtggcagagccttcagtggcagatgccaagttctcaccatgagtgactgcaagacagtgtcagttaagatgaccatttggagctgccaaaggcttagtgtttgtgcccttatctggttggatgcagtctttattttttgtgtattcatgtttttgttttatttatgttgttgttttattgtctattgttttttatttgtttatttagacaaaacgtcttatccttgttggcagagtgtttgtgaaatataaaatgggagtgttttctaggctggagttagttatgtcaggggtgttctacacagcagcggggaagaagcggatgtcaggccaagtgcctgcccaggacagcgaaaagccactggcttccagggtggtgctagaccagccacctagggttccagctgagactgtggaacaaggctgagctttattagcagattttctggagtcagaagtgtctcggcaaggtgacaggagagccaggtggctctgtccatggagatgcagggggtagggagggggccgcaggtgttcagtcttgccggacggatgccaggcttgcgctcgttgtgctgtgaagaattgagaatcccaccgtcaacagatcaatctgctccgccctcctgctgcaagcctgaaacagggtaaatcacgaaatgccaggcagagatgcgtgctgaagccttttacagcagtacacctgagttcgtggatgaggaagttccttttcttcacccatgaaggcaaagaagagagacatgacttctggcaatttttggccagtcacccagaccccctcattttcatgttttcctgattgctcctcttcatcctccctgccacacctgctcaggcctttctccttctgcctcttcttttcggtttttctctcttttaaatatatcttcactggtgtgatccagtgagaacactggccttgggcacacatgggctggaatcctgactcaacccgaggcagtcttgtgatcacagacaattgacttaccctgctgcactgtgtttttctcacatatgaaatgaagataatgccgccaatgactggcgtgacagactgcaggagatgtgtgtgagacattgctggctgcgtcatcacagggctgccacttgcacctcctcagtcactgatgttacagcagccagttgcccgctgaaagccaccgccctgtcctttgctcccactgaccacctgggatgtctctcccacctgtccttgagcacgcagaagagaggtgtgcctcctgctgaaataacacgtggttcagaggaacacggagtcactgcatctgatcacacactcttgaaagcagaggtttcctgcctcgtgttcagccagtcatgttcctatcacagggacgggttgcctaatgctggccaaccccaccaggcatggcacctctgccactgtgagtcccaggagcagttgtaaatgcaaattttagtcattgccacgtaggttcttatttgtgataggaaaagctgtaaaagcagggggttagccctaagtggttgtaaggaggggtcacgggcacgcacctcgcaggttcatagtgaacactgagtgagagagagtgtgacaaggctagcatgaggcctggtcccagtgagtgccggtcagtagtgctctcccttccctattgtcactacttctttatccttgtccattcagacgtcagtgaggaatacataacaaaaaacaaacaaacaaaaagggcaaaatcagaacaaaatgcatgaatccaatgttttcctcttcgtgtggatctactgtatctctcgtccaacttacaactcggactccacgaagacagagactgcccttctggcttggcagctatagcagtcaatatattatcaatgccctgtccaatgtcagtgccaaggagactttaggagtgaccctgagggtcctgccagggagtgtcttctagacatgcatctccatttttgttgagtctgtggaaacaacttttgaaacaacttttcagtagtacatgggccaaaattgtacaatattataaatattgttgaatgtcctgaaatgaaaatattgcactgtgttacaaactcatcccattccagtcagagaccaaatgaaactgaaggtagagaaaatgccaagtgagggagcaggacctcttccctcatggctcagcttttccaggccgggtacagggagggcttgcggcaggcccagccaccatatagccctgtggcttcagagcctgatgcccagataggagccagctggtgacaggcacagaaggcccgtctgcagccagaggcagaaacatggggcggaaagcagcagacaagggtgagctccacaggactttctggccaaattcgtaacaatctgaagagccaaataaatgatgatggcaaaagattataaaccagtgggtaaacaggattcatgagtccatagtgacaaataaataaaagtgaaaggacttccttcaagttgaatgccaactagtaattacagaataaagggtggaaaggtcgcatgctgaccctcaccctgatgggcatggccgccagggcctctgcagaagtcagggcctcggtgcccgctgttctggtgggcactgcactcttcacaacgcatgcaccgtagtcaacaatcagatagcaacaacaatagtaaagaaggtcagtccactgaagaatgttcttgacaaagtgccaaaaattattaatttcattgtcttattttaaaccattgtatggagggctgatggacttgtacaaagctgtgcatatttcatgtgtacatcacaatgtgtctggggatacgcatgcagcctagaaaccatcacctccaccaaggccataaacacatccatcccctccccaagttcctcctgcccctttgctattattactgttttattggggatttctttgtgacaagagcactccatgtaagatctacactgttagtgaattttcagcactcagtacagagctattagacacagacaccttgctgtaaattagatctccagaatttattcagccagcacagcagaaactgtgtgcctttgactatctcacccttgcccagccccagtaaccaccattctgctctctgcttctatgagtgtgaccacttcagactgcctgtaagatcatacagaatttgtctttctgtgcctggcttatttcacttaatataatgtgctccaggctcatctgtgtggtcacaaacgacaggattttcttctcttgaaggatgagtcacattgtctcatgtatgtgcaccacattttccttttccacttttccattggtggacataggttgatgccgtatctttgctgttgtaagtagtgctgcagtgaccatgggagtgcaggtgtctctggacacactgattccatttcctttgggtgtatagtagtgggattgctggatcacatggcagttctatttttaatatttggggaacctccatgatgtttccacaatggctgtatcaaatgtatttccaccaacaaagtagagaagttcttttgtgctgtatccttgcagcacttacctttgttgtttctgtttttttaatactagacatcctaacaggtgtgaggtgatagctccttgtggttttgatttacatttccctggtggtcagtgatgctgaccatcttttcatatactccttggccatttgtatatcatctttggagaaacgcatgcataaagtacttctgctgaatgctgagccatggcaatcatcctaaggaaaagcacttgtgctaaattttttttttttttttttgagacggagtctcactgtgtcaccaggctggagtgcagtggcacaatcttggctcagtacaacctccacctcccgggttcaagcgattctcttgtctcagcctccctagtagctgggtctacaggcatgtgccaccacgccagctaattgttgtattttaagtagagacagggtttcaccatgttgggccaggatggtctcgatatcttgacttcatgatccacccaccttggcctcccaaagtgctgggattacgggcatgaaccactgcccccggccgctaaatttgatttacaagcgaagctagccagctttttcatggaataccaaattcacttaaagaatgaatgacagacaaatatgttatttacacttggatgttaggcagacatgtgctcagaaatgaacaaactgggcctgttgctttaaagaaaataactctagttgccaatgagaaaattcaaggtttttaatgaacactaaaattttggaaaacctgcagttcactagaaactcaaggtacagaggcagcctcaggccaaatttagtttgatttaacaattctcaccctaggagactcccaatttattaacaaattaatgtttttgaagaatctgtcaagaagaaaataaatgttttcctccaagcatacttgtccaacacagcaattcttaaactttttgatctcaagatccctgttcatgctttaaaattattacgtgaaggagtacgagagattccagcaggagaaaagggcattgtgtctgggatttgtagcagccagtagccggaatgagcagaaattggatctgaaggcctgattccagaaagaaagaaactcagggcatggaagaaacagctgtggatggtttcagaactttgccaagcaattcctcaacatatctcactatgctcctctgcttactcggattgttctccatgacaagacccccagaatcattccttatcccatatttatctggaccaagtgaaaacccgagcgcagagatcacggatgaggtccttcctgtttggatacactctgctcccggtgtctgtgctcttgagtcaccacaagcccatcaccctctcataagggctctgcttcatcattccccagctgctgctcttattgggctaagggatgaagactacacaggctgtcgagttctcctccaggatactcactgactcccaggtggcctactctatcaacccatgagcatggtcagccctgagacactgtcaggaagtgagaggccactgtaggagtgtcacgctaacagctaacccagcggcccccatgaaggctgacgcttggcatccctggagaatgggtcacacttttacctcatcgcatagccatagtctctgcctccacagccttcattttctcactttttctatcaatgcccaagaaaagaatgtttttccatgcaaaacccagcaaagaaataaagtccccaagcctgtgtgcagggttaaaggaacctcatgagagtgaagcactaggctgcgaaggggagaaacccacttgggaaaagcccaccacttcggggaacctggatgacggcccatagagcatagtgccacaaacagtgactctgaaagttcgtgttccatggttccaagatttgaagtagtgttactcctcagaggcctttgttactaatccccacggtgggctttttccaccacaggttttaacctagctttgaactatgttcaagtcctatgaggttgcaaagcaccaccccaatattcttatacctataacggggcacagaagctactgaagcatttggtagggctgtggctgcctgtgcagtgggctatgtgaaaatcaactggagtctcctggagagtgggctctggaagtctcctcagtcatcaacgcaggctcttgacctctcgtgcactatatgaccaaagtctacgcaggctatgtgggctatttgcgattcaagtccagctatgtgctgcttctaacccaggcagtattccagactgcagtccagctgagcgtggaatgtgtatcctggtgcccggattccacacttcactgccttggtgattcagccgaccctcatcactgtgactgcaattcatcagaaagggctcagcctgtgatcagcattcagtttgtagtttataggagttattttgcagtcacttctagaattttcctaataagaagaatatctaatgcctatcagccaaatgccaagaggaaggagttcagagccccgctatgagtcagaacccagatgggccgcacccaaaggagctgagcagtatcacgcgaacaaagttctaaccctacaacatcaactactgcagtgctttgcaaagttactgaatgaaaacgcagggttttgagatggatgtcatatgttttgccataagttgacacactttgcaagtctggattctaatgaatctttttttttttttttttgagacggagtctctctctgttgtccaggctgaaaggcagtggcacaatctcagctcattgcaatctctgcctcccaggttcaagcgattctcctgcctcagcctcccaagtaactgagattacaggcacgcatcaccacgcctggctaatttttgtatttttagtagagacaaggtttcaccatgttggccaggatgatctcaaactcctgaccccaggtgatctgcccgcctcggcctcctaaagcgttgagattacaggtgtgagccacaacacccagccctgattttaatgaaccttttcaaaaccacaaaaaaaaaaacctcagttttagatcagacagctatgtgcccgcctgaactaaactcagttgacagggcccattatcacaattcaacaactcatgttgaagaccccgtgaagagcagtaacaacaattctagttgtgatcacttgcaagggcatgctaatggcacagaaaccaaccatgggaaaactccagcgctcccggagttgacgttccccacctgtcagcacaaatacaaactggaccaaccctgttgcttggcttcaatacttgtttgatcttaccagagcaggcaacacatggacatttttgtctcatgagccattttcctctgttgaacttatgattctctgagaacctgagaattacaataacagcattatttacaagctgtgatttgataatgtgccacttaatgttttacatgattattttgcattttgtgctttgccgagctttgttgttgaagctccatgtcaagaatagcaccacacgcccctgtgtgtctgcaaaatgacagcctctgcaattctctgaggcccgggagggacaatgagccttctccccacatgaccctacatgggggtttcaatgctatgtcagtgcaatatgtctacaggaggaggcatacaaggaatctccagaggtttctaggagtatttgtaagtaaaacagtaatagaggtgaggatggtgggaataaacacctaatttttaaatggtagagattgtgctaaataaaatgtattcaaaaaattactaaagactccaaagagctttggttatgtggtttaaatctatcagtactcgctgaagtagaaattaaaggtaagaaacttttcaagtatttattaattcatttaaaataacaataataaactacacgttaacataaatgaaaaaattattttaaaaaataatgattttcaaatgaaaatttagtaaggggagtggcacatttatgttttcacaaatatctttaatctgttgtggtatgctatcatgattgaaatatttgcataaaatccagaaaagggaagagtattcatctttttggggtaattgtggatattctttttgatattacaccaaaacgcaaaaatagtagtttatcaaaggttccttgcgatgtggaacgtgaaaccatgtcaattaaggcttcttattctgtcacactcatatccattgcagcttgaatagatcttttactcaagcagcattttgtagcaaaatgcactggtcatttggaaaatactggatccttgagttatgaattttttcaaatgttgtcacatttcattatacgataccacaaatcacatctgttcatgccactgcttatctcatcagagaagtcattaggtattgcaaaactgtcaggctcatgggggcagacataagttttccaaaatcaaagttatttctttataaaatataatcactgtttatttattaatcaaagtcaaaatgggaaataaaatatttaccagatcactgcactaatcccttttctgctctgattcataatttaggattcctagctatcagagatagcagggtgccagctggggtcaggtttcctctccatcttagcagttctgtgctgaaaaatgtagtttcttttcatggtgtgacctttttatgagtcctaagtatagactggccatttgtagttgagcttctgtatgggagccttctggtatcttcacatagctgtgttgtgtgtttggggaaagagctctgcttttcccacattgaggaaaactcactgcttcctaggactggtgcattactgtcttccaggaacttctcttcagagttctcttggtttagatccactatttcctggatcgcacagctttttaaaatttgctatttgtttttgccaggttacagccttgcagtagttttcaagaaagatacagaggagtgaaagcagaggtctcaaggccctcactggcatgggtggcttccaagcccttggccttaaattcacatgactaatatttttgtaaaatttgcaaaaataaaaccattccttttctacactatcaataaaaaacaaaattttgggccgggcacggtggctcgtgcctgtaatcccagcactttaggaggccaaggcgggtggatcacgaggtcaggagttcaagaccagcctggccaacatagtgaaatcccatctctactaaaaatacaaaaattagccaggcctggtggcaggcgcctgtagtcccagctactcaggaggctgaggcaggagaatcgcttgaacccgggaggcggaggttgcagtgagccgagattgcaccactgcactccagcctgggtgacagagcgagactctgtctcaaaacaaacaaagaaataaaaagaaacaaaattttgagcaaccttagtaaagaaaggactgaatatttctactctataaaaatattacgaattgtcattatatcaaaagcaatcaaagcgtgtgggaggaaaatactggctgccctttttagtggagtggggttggcacagcagggcaggttctcagctggtccacaccatcaccatcgctgcacccgccggccgagtgcggaaggtcttctgcacgtccttcccttgtggtctcctttgcactcgccagcaccattcctaaatggtctttgcattttcctctttcatctgacacacagatgcctacatgtcacttttgttttctgaaattatacagaattatcctttgcatagactgtggtgttcgaagccccatctgatttctagttttgtgtgatgacatccaccaccatcatcatccttcatgcacctcatatcccaatgtctgcttggctcactatttccagaagctgtttctgctgcctgggatgtctttattgccatccatcccataggacttggctcacaacccagtccttctctataaagcttccatagacccaagcatcctcctcctcccaaccaaactagccacacgcctgctgaactctgctagtatatctgtggtagctcctgcccttatattcactcatgtgactgtctctctctaggtcatgagcttctgcagacaacaaactctttaccctgggcagctagcacaatggtttgtaattaaataatatttatcatttaacttgagagattagcaagagatatatatggttctgtgaataggacctccttgggtagaaagatcaagaagagccagagaaccagaactacgcagactttttcctggggaagctcaattatattctgagtttgctgagactttgcatctttgaaatttagaaaactagagcagtaagagcctctttcctctggtttcatcattaagagtgacgcagaactgcctccttcagaccatgacccgagtttcaggttaagtgaggaggctccggcaaagcgatctctccacattcctccaggagaggactgtgcagattgcaaaggaaggaggcatgcctggccatctgagagctgtgactacagctccctccagacgatttccagtggagcaggcctcataatgtggaggtcggcatacagtacagtctgtctcctcgaccccagctcccactcctgcagtcaaagagcctggacctgggctctgagccctgtacaaggatgagaagcagaggcagcacttcaggtttttgtccaggtttgatcatgaatgagtagaaggcccagtaactaccttccgcctaaaaaaaacattttattggctcctcaaaaagcaggaatacaggagcaactgactcttctctctctaccaacaccaccctttgactcccctcactttgtctcctttgctcctcacatgttgtggtgaagggaaatcctacggtcaaatagtttgcaggagagcagggccagtagacgcaaggctcagttaaagacttgaagacctggagagagaaaatcaggggcccaaatgggacctctgctgccaggactccaaactcctgttgtcaaaactgtaaaatattttcagaatctagttatcaattattttattttttctgtgataggagaaaatcatggaagtcaataaagtaagatttaaaataggcctcaaattatttttttacggatggtaaaaaaataatgcatgtagaaaaaaatacaacagagaaaacttggaaacatttttttaagttgaaataaaaggtcgaatcatccatcaggggcccatgttctattttttctttgcggctcaggcacagagcttcagcacacagcctccagggggctgtcctgagtctaaccacagtattcccggagaaaggaggcaagggctgggaaggagtgtgtcgctgctcttcagtgcccttctaggagctggtgtccacatgtcactcgtgtcccatcggagtgattcacacggccacacctcactgggaagtagagtctactctgggtggttgttcacccaactaaaaattccaaatgcattattgtagagagaagggagggcaggcatgggagagtgccagtagcctccagcacagggtcaaatcccaaggacaatctatgttaggccagcagcaaatgaggatgaagacgcaaatgggagagactaagaggaactgtgcagggaagtcaggggctgcagcagcccagccagagaggcccagacacagagattcttaggaggaaaacgaggcagctgactccaggagagaatccaggggaaaagatatatttggagggtttttttttttttttttttgagacggagtctcgctctgtcgcccaggctggagtgcagtggcgggatctcggctcactgcaagctccgcctcccgggttcacgccattctcctgcctcagcctcccaagtggctgggactacaggcgcccgccactacgcccggctaattttttgtattttttgtagagacggggtttcaccgttttagccgggatggtctcgatctcctgacctcgtgatccgcccacctcggcctcccaaagtgctgggattacaggcgtgagccaccgcgcccggcctggagggtttttaagtgaagttataccatagggtttgcagcataaaccctctacactgaacacctacaaaatccctgataaaggtctcgtggcttgttaacgtggtttggagtggacctgtttgggtaaagatttggggggacccatgtcagggtgggctgaatcattgtgcttaaaacacaccagagattgcatggtgtattgcagcgggtgattggtgattggtaggtgaaagaaagatgtgctcattcatccctgagtggagagatctctctgggctagccacaatgtatgaaaacagggcatgaagaatgtctccagcccacatggactgcattcttgctggttgggaatgtgtccccaagttctccaccttcctgtactagttaagaaggaagggccaggtgcagtggcttgtgcctgtaatcccagatatgcaggaggatggcctgaggccacgagttcgagaccagcctgggacacataatgagactccatctctaaaggtagtttgtgcctgtagttccagctactcaggaggctgaggtacacttggcaattgattaccattcaccttgacatcagtgaaagttttcctggagattggggtgtggttgtcttttgctttaccctactgtgcctttgcccatgtttgtctttccttgattccatggttttctgtggaaactgagggaagcatgagtttgtgccactgtctggtgtcacagaggcctgaggtctgaaaaggtactctcgacctgaggagttgtcgggtgatggggagagcattctaggcagaaacaacaatatgaaaaaatagagagttaggagcccaaagccacaaatcagaaatcaagagcaaagagagctggagaaggtagggtggagtaaaaacacgtctagaaagatctagggctcagtgggtcagcacatctcctctgaggcgtcagttccagtcagctgagaactgcagcctagtgggggcctcccgcacattggaaagagtacctggattagtcaatgaggtttgcctccaggggctggtcctctttaggaagaccagcagacgcaaggatacctcatcacaagcctaagttaagggcatagagggcctgggatgccactaagaagtccgaggtctgtctaaaggggctcatttcataactgaatgccaaatacattcagtgatctcagggtcccagggcctgctcttgactaaaaattaagctgaaacaccctctattaaaagctggccagaggagatggtgggttgaatgtggctcctgggccatgtttgcctctggaacaccagtgcagagcagcagggacaggaagagccccagggacttgcagactgggaggagaggcttccagctgcctctgaaagggagctttgctctttccaattttctgttctttctgtgaaaaagtttaagtccttctggagctgggctgatggcatgtgagtgttaccatgtgtcattctgtaagtgctctctgcaaattcctagagattctccctcatgccccaggggaaaagcaatttttattgtcccactgtgatccatgaatcttatccccagtgtctatgaatcctgactgttggacttcaaaccctctgggccctttctcaaagagctccacggaaagcaagctcctgatggctgccctgacacttcaggcttcctgaagtgtctactcaaaatagtccctaacctaagggcatgactttagtaatgtaagttttaagcttccgcatgtcaaattccccaatccacccaaaacaatttcctaagggctagcttcctgggacccccacattccccatttttctgcctaagcccacgtctggacatggcttggttcattgctcacaaacgctcctaccctctctccccaccaccccctcacttgggccatgcatctgtgtcatcttccagcagctcctggatctgacattcattggctgtttaggttactattccctccatgcccatgatgccactgtggtttgtgcttcttcatgtgaagttaaaggagaagatatctaagaacataaccttgagagcactagcaaccataggtggactgtgaggagaaagccaatgaaacatgttgaggagaaataggcagagaagcaagcaggcagctttgcaggagtcagaggagaggaacattgtgaggagtgcacgatctgggtcaaacaccagagggatggtgtggaagacaaggactgaaaaatgtctactggataattctaccaagcggggcagctgggcacaaccacagaggaactgacttaaggggaaattgtgcagccagtagtcaggtggaatccagatgtcagtgggacctagtggaaggggcttcaatttttgaatcgctcaaggttggccagaagctggctctgtaatcttggacaaataacaacttctctgagcctcagtttctcttctataaaatggacataaaacaccttccttgcagagtgtgatggttaatactgagtgtcaacttgattggattgaaggatacaaagtactgttcctgggtgtgtctgtgagggtattgccaaaggagattagcatttcatttcagtggactgggagaggcagacccaccctcaattgggtgggcatcatctaatcagctgccagtgcaggtaggataacagcaggcagacaaacgtggaaggacttgactggctgagtcttcccgcctccatctttcttccgagctggatgcttcctgccctcaaacactggactccaagttcttcagcttttggactcttgggcttacaccagtagtttgccaggtgctcccgggccttcagccacagactgaagactgcattgttggcttccctacttttgaggtttggggactcagactggcttccttgttccttagcttgcagacagcctattgtgggacttcaccttgtgatcgtgtgagtcaatattccttaataaacttcccttcatatataggtctatcctatcagtgctgtccctctagagaaccctgactaacatagaagagttgtgaaaatgaccgttggtctgccctcaccctttccctcttgtcctttaaccgcatgcgctcagtgttaccttccgtggcacctgctcaccgtcatcccgtggtgactcgtgtgggtaacttcatcagagaagaccctgcctgtcacctcaggtacagcccacgaagtaaggtggctgcaagcgcagatcctgcacctgcccaaggtgaaacaaatcagctcccggagcctgaggtgcaaagggcaggaagctccctgcgcacccctgcggccccagcgcggctctcccagtcccgctgcctcccactccgagcccctgccgtctgggacccgctccacctcccgctcccgggccctcggggcatcctgtctccattcgcagcccagtgccctccactcccacggcctcgggtacagcttccacagggaaatcacccacatctgtgtctctcgcctcgttcccagtcctgaggccgacgcatggccactgagcacacagatccagcacagcgtccctcgcctttcccgcgccccgggcagaggatgagcaccaggccagccctgcagctcacgccggcagccctgggctggctccgcacccgcgcctcgggcttccacggtggacccaggagacaccctctcgcccagcccagcttccctgcgggactgagagggagaagggaggagtcggggagcgaaggcggaggcagagctgggctgcgggaggaggcgcgacggcggcaccggcgggatggagcagcgggatcccgcggtgaccgggcggatggagtggccgagagcgccccctgccggccaagggtcccccctcacacactcccggtgtggccgggaaggcgggagccgggttccctgccgggaaggcgggagccgggttccctgccggtggagccggcggctcagccgggccccgcacgcaccggccccgcagggccaggtccccgcctccaggcccaccttcggcgctcgcaaacgtccgggtggctgcggcctggccaccatccaggcctcgcccaccggcagttgcccgggtccacacagggacaagctcggtctccgccgcgtcccgcctgagcctcgcccgcgcccaggggactccacgctgcacagggagagggccgctccgtgtgacaatgcaagaagggcgagctctcttttccacctgtctcatctcagtgtgaacggcgccctggaaaacagaactgttcagggacttctgaggagctcggccaacgctcttgcctccctacattttcccgaaatctgcctttcaaacaggcttcctcttgtcacagacgaacccatctccacgttagagtgcatcgtggcgtttcctattttcataaaagccagcgccctggaattgtcagtctgttcttacactgtgagtgtaacggccctctgttaaatctcagcaaaccctcgcgcgccagagaggccagccccagagcccgcgccctggaacgcggcggaccgcgggtgccctctgcgggtggcgcgtggcctgcgcagcgatcaggtcctcaagtcccgaagccccagtgccagcctccgaaaagctggcccggcaggaaggagcccagttcctgcccactgccttccgacgtcctgtaagtggaccccgcttcccgggcctcagtggtctggtctggaatgaagagtctgagccaggtggtcccaagcgctgccgggctcccacattttctgacaatgaggtaatcagtcacgtgcacttgccaaggtttgggcaccagactctttgacacctggtgtagactcagcaaaatcccatgagccactatgcccttcagatcaatggactatcacctacttcattcggacttttcgacctcaggtgagactggagagaaacctgggacagaggagacagctggctgagattcccgttcctgcgtctgaaggctggagggtatggagagtccctagacagtggcactcacgcctgctgcgccctgtgctgcaggttgtacgcgatataaaacatgacactgactgcccgtgaggatcttgacaagttgttttgaagatggcattttgctaagtccctgagggtcactggtcctcaaagcggcatggcggcatggcgtggctggttctgccacatgccagctgtgtgacctctgagactccacttcttcagtgctgaaaataaagaaggagttttactaaggaccaaacaagataatgaatgtgaaactgctccacgaaccccaaagaattatgcacatagatgcgatcattaagatgcgaagccatcgagttaccacctggcatgcttaaactgtaaagagtgggtcaaagtaaactgaattggaaaatccaaagttatgcagaaaaacaataaagaggtcttacgtagcaataccgaacttatgtcaggcactatttctcaaaacacaactccactgagatgctccaaggaaagaaaggattttgtgggcaaaagcttgatgcccctctagggcactcacaatgctcgtcagcacacagagctacaaatagttcagattttgccacccaatttgttgccaaaaacattcaatttccagatctgctttggatttcagaattgcagattcaaaacattgtaaaccctggattaaaacccattaaaagtttcctgtctgagttgctcctatgtctctcgtctcttcagaagaatttatctttttctttttgacaatcattctttcataagaattggtctttcaacctacttttagttcacctagttgttggaaatttagtagaaaaaataaccttgccttttagggttgatttaggttaaaatgtctaaggtatataaagtgcttatcatgtaacaaggcacacgagggtttattacgtgtgatacacctgtggtggaaggggtttcttgtggcctcaggtcatgcaggagggattccaccccacaactgctccaaaaaaagcacccatgccaccacctcacaccaatattctgaaccccacgatagtgacctaacaagtgtaaataatagtgaaaatcacaggacagactagttgaactcaggactgacctagaacatatgatatgccagatgacatgagagatgtagatagacgacatgagaaaatgagatcaattgtctaatagttgattgatccttcaatgccagatttttatctgccatataattcttactgattatataggctgaaaggcagaggagggatgatgattctatccaatgaatatggagaatggctccaaattttaactctctaaaacatcaccatgtgctgtgtcttttcctacaaatcaggatcttttttcaaccagtacatacctccttgacctgacaacacttaatataggcaaaaaaaaaaaaaaaaaaaactgttcccaagttgagtataatcatatctgtaattatatccataatcacaaggataaccactgttcccaaattaggtatagtcatgtaatagcaggcccagttctgggctttctatgccttttatctgtttgttgatccttatgcctgtgccacattgtcttgatcactgcagctttattggctttctataagttttttgtttgtttgtttttgagacagagtttcgctctgtcgcccaggctggagtgcagtggcgcgatctccactcactgcaagctctgcctcccgggttcacaccattctcctgcctcagcctcctgagtagctgggactacaggcgctcgccaccacgcctggctaattttttgtatttttagtagagacggggtttcaccacgttagccaggatggtctcgatctcctgacctcgtgatccaccctccttggcctcccaaagtgctgggattacaggtgtgagccaccgcgcccggccggctttctataagttttgaaagctggcaatgtaagcctgccaacttttttttcccctttttcaagatggctttgcagattctaggtgctttgcatttccatatagattttaaaaaatcattttgtcaattcccacaaaaagtcctgctgggctttcacggaatgtatacacctatttgggaagaactgctatcttaataatagtgactcttataagccataaacatggtatatatttccatttacttaagttttcttcaatattttcaccaccattgtgtagttttcagtatagaggtcttacacatttttgttgatttattgcaaaacattgcatgtttctgttcttacagtaaatataatttttaaaatttccttttctaattctgtactgttagcatactaaatttacatcgatttttgcataataaccatatagactgcaactttttattagctctagtggtcattttgtagattccttagaattttctttttaagttaatcatctttttattggggaaaaaaaactagcatttacaactcggaatggaagtaaactgtaatttgttgaacggtaatgttgatgactgtgctgaagcccacagccacagcttactctgctggctcaaagtcatggttcagaaggttttaaaagcagagtccaaagatgctcccttggtaaaggttttttgttaaaaatgtgtgtgaacagtgacagccgtttcactctagaacaatgcagacaacgctaaatcaacatacgtgggcatgccaccagggtatgtcatcgtcaccatgggtcacagcacacagaagtacaagatgaccatcccgctagtggggctacgtctcaacagtttatccttcaccccatttttctgcacatcatcctaagataaaccaattttaaatgttcgttttcagtaaaccagttatgacaatttatactaaacaaattgaaccagaatccatttgaataggttttggatttgttttctcctttttttttttttttttttaaatacaaatggctgactgctctcagtcgtcaggctgcatgcatgaaaaactggccggcccaaacagtgtattaatcatgactaaatggaactttgaggagtccttattattaaggtagtacatgtacttatattgtaaaactgatgtgtagcttggtctttaggggacaggaccaccaacaaatacatgcagattttgtgtgtttggatagaaggtacttttgacattcagttttgctatacagaaacagaatgaatctgttgggcatggtggctcacgcctgtaatcccagcattttaggaagctgaggtgggcatatcacttgactccaggagtttgagaccagcctcaccaacatagcaaaaccccgtctctactaaaatacacaaagattagctgaaagtagtggctcacgcctgtaatcccagctaattgggaggctgaggtatgagaattgcttgaactcaggaagcaaaggttgcagtaagccaagattacaccaatgcactccagcctgggtgacagagcaagattctgtctttaagaaaaaaaaagaaagaaagaaacagaaacaaaaaattagaaacttttttcttttttcttttttttttttttttgcaaaaggtaagtaaaagattccatttgattcttctagaacagggaaaaggggttggaagtaggtcttcattttgcagtcatcatctgtattaattcttcataatcaacttgtctgtctccatcaatatctgcttctgtcatcatttcatctacttcttcatctattagtttttctcctaagtttgtcatgacatgacgtagttctgctgcactgatgtaacctttgccactatcgtcaaagactggaatacctcacgatttcttcttcactatatgtgtctttcatttttctagccatcatggtcaaaaattcgaggaattaaatggtgtcattgccatcagaatccacttcattgatcatgtcctgcaattcagattctgctgggttctgacccagtgacctcatgatggttccaagttcctttgttgtgatagtgccattactatctttataggacagggagaaagcttcctcgaattcagcaatctgttctttggtcagctgatcagccatggtgccagtgaagggaggaagagcagaaggggcgagggggcagcatcggcactggggactgcggggagcctcctccgctgctactgctgctgagggcatgctgtgcactgtgcactgtgccaccacgtgtctccacctgctgtgagtaatggcacctcaaccatgacattcccagcaccactgcacaggactttttaatataagcaatagcaagtcacgactacagacgactaaaatccaggccgggctatacccacaaaattgtgtctctctgtggaatgtggaccctggaaaaatgaaagaggggaaaaactgaagatgtttcattaaggcactaaaactttatgtttacatggctaacagaaatgaatacaataacacaaagaaggtgaaccagattatcaaagtttttgcctcttgattgctatttcctttgatttgaggggagagggattgatagagaggactaatcccattccatctacatttggataaatcatctactccttaaatagcattactgtaagtaaaaatattcaaaaggtcagtcagtctcccaagcaagatggcggaataggattttccatagccgtgccttctcagaaacatccatttgaacaactattcatgcgtgaaaataccttcataagagcaaaggaatccaagggagacatttcagcacctgggtgcagcagagaaatagaaaagagggcaggaaggacagtttcagatgacacacatcactcctcccccaagcccaggcagtgcagcctggaaagagaccctccatgtggggaagggagagtgaagtgagcccccaattttgctgtggaccttagcagtaaaacctggtgcctagtcagaccccaaagtccaaggctccaggctaactctgcaaattcaggctccaggcccacctcagattctggactggccccagcaccagacctactcccatggtcccagacttcaggaatgccccagtgatcagctcctctagtgcaagaccccaagtcccccccaccatgaccctaggctccatgtcttctccaacaccaggtgagcccctcagtgggaaggaaacttcagatgtagccctcaggctacacactccagtggactcaagatccaggccctcccctataaaccctaacaccagaccagtcactgtagactcgggtttcaggaccacccccatggaactaggctccaggctggccccaatggacccaggctccaggaccatgcctaaggatgcagtctcctggcccatctccatggtttcccacaccagacctgcccccaggggccagatgccaggttcccccaagttcaccctagtgtgaggccagcccccacagattcaggaccaggttaatctccatggacacagacaccaggtctcccagcaccaagtcatccccttgcagactcatgcttaatttccactccagtaccagatcttctcctgtggacccagggttccagccaggccctgcagacatgggttccaagtctggtcctgaaaaccgagtcaaaaggcctactgtagtggaccctggcactaggcaagtcccctgtaaatccaagaaacaggctcacccacctgatgacccaaaaccaggccaaactgcctgaagactccagcaacaatcctatccacagatccccacaaggtggcccacccaaaatctctagatgtgctgactggtgaatggttttcactgtcaaagccaggatgtaaaaactagaagaagtacctacttcttcaaatgcacagacaccaatgcaaggcaaatatcacaagtaatcagggaaacatgacaccaccaaaggaaaaaaataaagtaactgactctaaagatatggagatatactaactgcctgacaaaaatctcaaaataatcatgttaaagaagctgagtgagctatggagaacacaaattaacaactaaaccaaatcaggaaaacagtacatggacataattataagttaaataaagagatagaaaccattttaaaaaactgaaattctagacctaaagaacacaaagactgaactaaaaacaagtaacaaaatgacaataataactccatacctaatcaataattattttaaaggtaaatgaattaaaatctctaattaaaagatgtggaataccgaatgagtaaaaaaaaaaaaaaaaaaaaacaagatctaacaatatactgcctataagagattttggtttagctttaaaaacacacagaggtgaaaagtaaaaaaatggaaaaagatattacatgcaaaaggtgaccaaaagagagtagagtggctatatttagacaaaatatactttaagttcaaaactgtcataagagacaaagaagtttctcatataatgataaagtcatcgatttattaagatactataacaattataaatctgcacccaacattggaccacctgagtatataaagcaaatattaatagaactgcaggaataaatacccagtaatacaataatagtaaaagacttcaacaactcactttcaacaatggacagaccattcagacagaaaatcaataaggaaacacttgacttgaacaacaccatggaccaaataaatctaaccaacatacacaagcattctatccaacaacagcaaaatatacatttttttcaggtgtacatgtaacattctccagtaaagattgtatgtcaggccacaaaacaagtcttaacaaatttaagaagacagaaatcatattaagtatcttttctgaccataatggtatgagagtaaaaatcaagaacaaatggaaaaccagaacattcattaatagatggaaattaaacacacccctgaacaatcaatgggtcaaatacaaaatttaaagggaaattaaaaatattttgagacaaaggaaaatgaaaacacaacataaccaaaatttatgggacgcagcaaaaaacagttctaagacagatgtttgtagcaatgaatgtctacatcagaaaagaaaaatctcaaataaacaacctaaggttgcatcccaagaaactaggaaaagaagaaaaaactaagtccaaacttggcagaaggaaaaaataacaaagatcagaacagaaattagtgaaataaagactagaacaacaatagaaaagatcaattaaaataagagttacttttttgaaaacataaaattgacaaacccttaggctaactaagaaaaaagagaaaagactcaaataaataaaattataaatgagaaaggagacattacaatgcataccacagaaataaaaaagattgtaagagactgctattaaaaactgtacttcaacaaattggataacttagaagaaatggacccactgctagaaatgtaacagcctaccaagactaaatcatgaagaaacagagaaatcttaacagactaatgataagtcagaaaattgaatcagtaatcaaaacccttccatcaaagaaaagccctaaaccagatggcttcatgggtgaattataccaaacagttaaagaaaaattaacaccaatccttctccaactattccaaaaaaaccgaagaagacagaatacatctaaactaattttacaagcccagcattaccccaataccaaggccacccaaggacactataagaaaagaaaattacaggccaatattcctgatgaacatagatgcaaaaaccctcaacaaaatgctagcaaacagaattttatagtacacacatgtaccatgatcaagtgagtttcaccccagggatgcaaagatggttcaacatacacagatcaataaatgtcacacaccacattaatagaataagggataaaaagtacatgattatctctatagatacagagaaaatatttgacaaaattcagtatgttttcttttttttttttttcttgaaatggagtcttgctctgttagccaggctagagtgcagtggcgcaatctcggttcactgcaacctccatctcccaggttgaagcgattctcttgcctcagcctccctagtagctgggattacaggaatgtgccaccacatttggctaatttttgtatttttagaatagacggggttttaccatgttggccaggctggtctcgaactcctgaactcaagtgatccatccaccttgggattacaggtgtgagccaccgtgcctggctcaatatcttttcatgataaaaaatgctcagcaaattagatatagaaggaacgcatctcaatataataaaaaccatatatgggaaacccacaactaacatcatactcaagggtgaaaagctgaaagctttttctcttagatcaggagcaaacaaggaaacccactctcaccacttctgttccatatagcactggatgtcctagccagaataattaggctaaataaatgaataaataaaaggcattcaaatcagaaatgaaggagtaaaattttctccatttgatgtcatgatcttatatacagaaaatcctaactactccaccaaaaaaaattgttagaactaataaacaagttcagtaaagttacaggatacaaaatcaacatacaaaatttagtaaggtttctaataccaatcacaaactgtctaaaaagaaagcaagaaaaaaaatcccatttacaatagctaccaaaaaataaaatacttaagaaaaatttcaccaaggaaggaggtgaaagagctgtacactaaagactataaaacactggtgagagaaatgaaagaaaacacaaatcagtggggaggtatttcatgttcatgaattgttagaattagcattgtcaaaatgtagtatccaaggtgatttacaatacaattcctatcaaaattcaaattgcatttttcaaagaaatagataatcctaaaatttgcatggagctaaataaaagataataaaagatgctaaatagccaaaataatcttgagcaaaaataacagagctagaaacatatacctgatttcaaaatatactacaaagctttggaaatcgaaacaacatgatggtcacttaaaaacagagatatagactaattggccaggcaaggtggcccacacctgtaatcccagcactttggaaggccgaggcgggtggatcgcttgaggtcaggagtttgagaccagcctggccaacatagcaaaaccccgcctttactaaaaatacaaaaattagccaggctgtggcaggcgcctgtaatcccagctacctgggaggctgaggcaggagaatcgcttgaacctgttgcagttcaacaggttgttgcagtgagcagagatgcactccagtgacgcactgcactccagcctgggcaacagagcaagactccgtctcaaaacaaaaggaaaaaaaagaaagaaatacagaccaatggaacagagcagagagtccagaagaaaatccatgcattcacagctgattgatcttcaacaaatgtgtccagaacacacaatgggaaaagaactgtctcttcaataaatgctgttgggaaaactggatgtccacatgcagaagaatgaaattagacccttatgtcacaccaaatacaaaaataaactcaaaatgaattaaagtcttaaatgcaatacttgaaactgtaaaagtcttagaagaaaacataggaaaaagcttcttgacatcagtctggacaatgacttttttgatatgatggcaaaagcacaagcaacaaaagcaaacatagacaaatgggattgcatccaactaaaaagcttccgcatagcaaaggaaacaaacaacagagcgaagagacaacctgtgaaatgggaggaaaatatttgcaaaccatacagctgataaggggttaacatccaaaatatacaaggaacacaaatcaatagcaagaaaacacgtaacctgatctaaaaacaagcaaaggatctgaacagacttttctcaaaagaagccattaggcgtgtttacccattggctcagaaatctgccttggactagaataaaagaactgcaggaaaataattgagaaaaatactgtttatctttacgtacagattttctccatgattttgtttttatgtaagcaagttgtataaccttgtgaaaattacttgacctctgttggcttttgtttctttatctgagaaagtaagaagctgaagaagatgattcagagtctgaaggctgctttccaatcccagtttcccatgggtcacaccagggtgtgtgcaaggccctttacctccctgaagggaccactgtcatcatagccatgcagatactgacaacctcgaatatttgaatcaaatgagatgaatgtaaacatcctttaaaaattgaaaggcagtccaggcacgggggctcatgcctgtaatcccagcactttgggaggctgaagcgggcagatcacttgaggtcaggagttcaagaccagcctggccaacgtggcgaaaccccgtctctattaaaaatataaaaaatagccaggcatgctggtgcacctgtagttacagctactcgggaggctgaggcatgagaatcacttgaacctgggaggcagaggttgcagtgagccaagattgcaccactgcactccagcctgggcagcagagtgaaactctgtcaaaaaaaaaaaaaaaaaattgaaaggcaatgtacaaatgatgtcagcttcacctgactctacaaagtcccttccaggcagaatttcttcattcattcaggaagtattttgagtgtctatggtgtgccatgaactatgctaggccatgttgctgtaatcatcagaacaaaaacaaccctgccctcgtagtgcttgtgcggcagtggaggagaaatacattaaataactgcacaattatttttgtgatcctctgacacagtcacttttcttcggtgttcttccttcctctaacaccatgtggccgccttcgcagcagttttggaggacggagagagagccctcacctccccacccaccccagtggaagagcttcctcctcagcagcgggcaggagtccttcagcactgacgttgtgtagaatttctagtccatggtgataataaaaagtgcgtgttgtgaaaggaaaatatcttgggcccccaaaatcactaagctaaatggaaaagtcaagccggaaattgctcagggccaaactgcctcccattctattcaaagtcacctttccactcactgagataaatgtgtatctgattgcctcctttggaaaggctgatcagaaactcaaaagaaggcaaccatttgtctcttatctacctatgacctgtaagccccctccccacttcaagttgtcccgcctttccagactgaatcaatgttcattttacatatgctgattgatgtctcatgtctccctaaaatctataaaaccaaactgtgctctgaccaccttgggcacatgtcgtcaggacctcctgaggctgtgtcacagatgtgtgtctgcaatcttggcaaaataaactttctaaattaactgagacctgtctcagattttggggatccacaatgtgctttagtcaattttattatcgtccgtaaactctcctgaatttactccaggatggatcacgtccacgtgcacacagacctcccgatcactctctccaggctgggtccacagtttctcatctccattaggacagtgtccctttgtgttggacaagctgccagtgcttgaaaagcctgactccactccagtcctaaccttctgatggaaaatgcctgttgcctcctggctgtctttgaaaggggccgtgtcaaatttagaagccaaagactttcaattattgagaggctcacaccctctcaccccatttaagtatttcggcagaggtaggcccctggcttcttatgcctgtcaagtaaaataagaagtattagtgcttctaaaactaactaaacttaggcaacatgtaggctataacctctgtggttgacagacaaataaccagccaaggatgtcgtagtagtttggtaaggccaccgtaacacagactgtaacacagaaaataccacagactgggcagcttaaacaacagaaattcttttttttcacaattctggaggctggaagttcgagtcaaggtgtgggcaggttggtttcctctgagacctgccaagatgcttgtcttctctgtgtcttcacagtctcttctctatacgtgtccttgttcaaattttctcttatatggatgctggtcaggttggattagggcccgctctactgacctcatagcttaattgcctagttaaaggccccatctcacagtaccatcacattctgaggttctgggggttaggactttaaacatgaaaagggggggtgggtcacagttcagcctattaccgttgttcatgtcctgatcccagaaccaatgaatttgtcaccttccatgacaaaaggactctgcagatgcaaggaagggtcttgagatgagcagattatcctgaattattcaggtagcacagtgtaatcacagagtccctccaggagtccctccaggagaggcaggagggccagagtcagagaaggaggggtgataacagagcaggggtcggagaggacaggagagagatgccaaccgacctggagatactacactgcttgctttcagagggaggaatgggccatgagccaagggatacatgtgacctccagaaagtggaaaaggcaaggaaatggatcctcctctggagcctccagaagaaaccagccctgctggcacctggattttagctccatgagacttctgacctccagaactctaaggtaataagtttgtgttgttttaagccttatagcagcaataggaaaaagtaatacaatctcccattctggaaatattttggaagctgtgaaaattagggaatagtcagaataatgagaaactaaagaaaagttggagatcaagggaacataccaaaggaaatgagggagagaaggacagaaagagaaatcaagaaatgcgaagggagggactgataagacattctgaaagtgccttattccctgtaaaggatgtatgctggcctggggaagactatgacgttagagaatttaaaatgcaaagcacatacaatatgacgacattggttgtggaccctgagcctctaggaaaggagtctagcaatccattcaacaaatatttccaccatgtcatctgaccgcacttatgtgccaaagccccctagctagagctgccatggaaagaccacatgaggccagagtcagccagatctggagatggcccagggcgtgtgtgccaagcagccactgacatgggcaggacttagttctaagacagtccaggtgaataatttggtcatcatcaggtgggagagacaacaatagctactttttagggagtgcttactatggccgagcacttcggagactgagtacacaaatggacaatggccagagcatctataagagtagaactcccacccaccccctgcagccaccagcccaggaggccaagccatcatctacaggaaccagcccagcaggccaagccaacatctacaggaaccaacctgacatctacaggaaccaacctgacatctacaggaaccaactcagcaagccaagccatcatctacaggaaccagcctgggaggccagcctgctccatgccaggctggtaagaattcagattgctatctctagaaataatatgggaaattaaacaatacattctctaacaatcagacccaaagggccaggacttgaataataactgacagttttcctactttttgtccctgcttccaatctaggactaaccagagaaagcccagtatgtcccctagccaatcccatgggatgcccacttctcaccagccgcctccggcttccccaggcccacagcctccaacaggcctctgaagcctccccttttccatgatgaagcttctccactcctcacctgcctgtgagtctgtcaggacacaagtgatggccgcggacccccttgctatagcagctctgaataaacagcctttgtccttgcttgggtggtcttcgtttatttccacccactaaggaaaccactaaggagacactcactcagagccgcccctgtggtggtaacttacatgttgggtgactggtggaagctagaggaccactctggctcctgagctctgctcttcatcatctgacacttggatcttggagaagtttggtgaaattgttcttccaaagcctaccaccaaccaagtttggaaaagactgagctagagtttagaaaacagagctataatctgggagccagaaaaatctattgttgaatgccagaactgaaggattaaactggggaaaaccacagactggtcccacagacccccacagggatattcctttccagcaatggatatgcttcaaaatgtgcccaggctctcctgagagttcctccggggtcttgtctcaggctgcccaacacactccacacctccatgccagcactagaccctcctggccctcaggacccccaagaccatagaccccccaggctgagcacacacaacaccaccagcctgtccttgggtctgacagactctggaccccacacctgaccacgaggccctgcctcagagttctgtgcagctacatgggggctgagaccctcgtccatcccccagggaccagtttcccaccttgggccttaactgcctccttgaggcacccccacaccctacaaaatatgacataggcctcccaaacttcagagcctggaacaaacaccccacccctgggagatgagggctttgtcctcactcctgtctcggggtcacttccctgagccctgtttcttgtcccggcattaatggcatcttgggatgatggccaatgggaactccctctcccaccaccatccccaaagaccaccaccccatagtctaacgtggtgacatctcccatggttctcttattgaacttggaacaaacagcttttaaatcaatttcacaactactcctcctacactacagcaccctccagtggaggagaaggccaccgggaggccctgggtttccatccaaagagcaaaaatatttaaagcctacaaacctcccctcaagctccacgaagccaaggacacaactttaaggaaactaagctgtagcagctgccatccccacctctcctggcctctccttgcaggcttgggtggagcctgaagggggtgaggacatgctggagaaaaagtcacatgggaaaaaaaaaaaaaaacacaggcaagacaaggacgacttgccagaaagtcaaaagcatgttgacagaaggccaccttggggtgggccaaagagccacacgattatggccaacaagcacctcacgcaaggagaggccgggcatgggacaccagctccccctgtgtagccccatgttcgtgaccatgctgatcagcctgcaaaggcagtgatggcgctgggaagagcatgctgcacgagaggaaggccacagctgaacagaggcagccagagcatgctgggacctggaaatgggaggcacatagtccagttctcctgacagcagaaggttcctgatgttctcttctaagtgtgggcactgcggccaagcctggacctcagatgcacgccgtggagaggctgaggagcaggcaaacttgcacttgtgtccacgtgcagcttcctcgtgcagaccccagcaccagacacagtgctgccaggctgacaacccagggccacagcctcctgcataaacaaaacaggccaatcagggtgccccatgcctccagaccccacagaataggatccaagcaaaagcaaccagaacgtccatgaataggggagaggacattcgaggacaaaattctccttccttacccaattgccaactgcaggaattgtgtgcacctggagtgctggagttcatcttttccacagcagggaaggtccagccagtgcagagcagagctgagagggcgggaggctgacttctggcaggcactgacagcctgaccccactgctgctgaagaaactcactaaactagttctgagagtcaggaaggacccttttcttcctgacctgattgtatttggacttctatcattagtcctagctagaacagagggaaatctgccaatcttacttctaaaattaggacatatattgagcacagccccccggctcccacacccttccccagagttcatgtgaaacaatgaacctgggggcagcagacagagcatcctcacgaggcctggcgctatgccagatgggctgggccactggggcagggagggggagctgccacctcacatgaggcacatcaggtgccttgggcagcctcagggtgccaagatagccagagaagcagaaactccagaaatgccgtttccctccagaaggactggagcctcagaatcaggaacatcagccctttatcccaagctcctcactccagacagcaggacatgcctgctttgaggtgccaccctcagaaatccagtcatccagaagtacaaccaaatattgctggacagagcctgtttgggactctataaggggtttcttgggccaagatggagctataggactgctatgggctgagctgtgtctcccaaaactccacctgctgaagccctaactcttcacgtgattgtattggagaccgggcctatcaccaggtgattaaggttaactgaggtcatgaaggtaagccatgacccaatagggctggtgtccttataaaaaaggaggagatgtcagagctctctctctccctctctaccatgtgagaacacagcaagaaggtgcagtctgtctgccaggaagaaagccctcaccagaaccaaaccctgctggaaccttgatcttggactactccagcctccaggactgtgagaaaataaatgtcagatgtttaagctgcccagtctatcaggttttgtcatggaagcctgaacagactgcagtgaggacggcaaggatctctgggtaaatatctcccagggtgattccctcctggtactcggattttctggacctgagagaacacatcagtagcctgaactctatatgctaaaagaagagggcctgctgtgcctgccgctgactgcctgtcagacaccccagcgtcagacaggatcggcatggaaggtcaggtccctgctatgtgacacctgcagacctgtaaggtggattttacggccaggagcccatcttccctcactgaagaagtcaggactgctggcaccaaccttgaagaaaatcaacaggcaaggtcctggttcaggacccactttgacaactgggccatggtttggggacatcaagtgggcagagtgaagagggccttccaattccaaatgcccagggatgtcagagactgggctgcagccaggaaccttccttggacagacagtcagcaggggagccgcccgggagaagttcacagaaagcagcctgaccccactcgagctccaggaaggtggggaccgtgtctggcttggttcactgttttcctcccgcacttgtgcaggaggctaccccggctgatggtgccttccctgagcaggggaaatgctgggcccttggacaggtcctggcagccttcccgccattgccatcactgcagttgggctccaggcaacagtgacagggatgctccatgtgttcacacacaaaggacatctgtcctggccacccagtgtgatttcccgtcctgtagctctcttctgggttcttaggatgaaggccaattctcacctcttctcggcaattccttctcgggaaagccatcctgtcagggagagagggactgaacacgaaacagaattcatcagaggctgctggtgctggcagcctcgctggctgtatagccataaatcccaaggcccaccaccctgcccagtgaccctccatatttctagaatccatttgctctcccttcccctgaagatttttttcacaaccgctcactgctcaaactccccacacccctcccttctcctcactctccaaccacggcatcacttcttactttgctgagtgtgcacatgcaatgatcttctagtgccaccacctctgcaggatgttctgcacctgggcccggtgaggccctgcccactttgtggctgctggcgaaagccctcgctccttcctcaagcagtccctcccactcgtgtcaactcaaggactgtgcacctataattatctcctctcccttgggcatcatcagttccccccatctgctgacaccaccccaattattaccataaacacacaacatgttctagtatctcccacctttctagaccatgcccccctgagctgctgcaccctccgtggcagctccctgcaggaccctttgccggccctcccctctctctcatccaccacccacccctgatgtgaataagagccaaatgttcagatcactaaatgtctattcccagccccaacatcttccctgaaatccaaactcaaatatcccaatgcctacttagatgtctagtaggtgtctcaaattcagaaaaatcaaaacaacctcttaccaaataccttaagcttgttccctcagccaaccccatttcagcagattacacctatattttccccattgtctcaaagcaaaacccgaggaatctttattaactgctgtctttcccatacatgctgaaattcttgctggaattcagcagcaagtcatgctcactcttccttcatgaattccagatccacaaccccttcccctagcctgcagccaaacaggccaggcgtgcagccgcctctctgagcccgtgaacaccacagttccctgagcagacagacgatgaaggataaacaggagcaagaaccagtcccacccagctgcctcgctcaggatgtagggccacagaaactgtaataacttgccctaaatcatgagagtaactagaagacacaggacttgaacctgggaagtctggctctcaaccactacactaaaatgcaggcaagggcaggacatggagagggttcagaacatagaggattccccagctcatctgcaaaacttttattctccagatggaaagagtcaggggtacccaaatccctttcccttcccactgcacagccccatgtcctggcagccacacacggttgctggccatacatggttgtgacaagaaaggaacacaggtgtggccagaaaaggaacaagggatgcaatggctgctcctgaaagaacaccaggcccctcttctggactgcagggttcccctaatgtgggccggcctatggcagaagaagccaaagaggaccccacctggccagacacagagtgccaaaactctacagttacagattcccatgtgatcaccgaaactgctttaagaaccttttaaaatacagatttctgggcctgatggaatcacagcatcacaagtagcatctgggaatctctgctcttagaagtttctcataggattctattggtgcagagagcagatctgagggaagtgactcgggcctggtgggagggccagcttccaggatgacccccagggattcccaccaacagttagccatgcccctgaggagctgcctccacagtgagtgcgcctggcctgtgtaccagttggatcttgaaaaaatgatcatgtgtgggttatgaggtcaggtcataaaaggacactgcagctttcccctctgtctctctggattgcaagctctgacacaccatgttgtggggaaactgagcaaccctgtgcagaagcccccatggtgaggcaccaaggctgcctgtcaacagcgagtatcaacgtgtcagacacatgcgtgccccaccagggaggtggctccctcagccccaggcaggccttcaggtgtctacactcttccctgacatctgaatggcaactccaagtcacagccacccagctacgccctcctgaattcctgacccacaaaatgggatgaaacaatacatgtttattgcagttttaaccttctgagttttgcagtaatttgtagtgcagcgaaagacaactgatacacctggaatgaccagaagacccttcccaaaggaaacgggtactgggtatgataaaaagagaggagggcattaggtaaaagaataagctggttcaggtatgacatacttcactgacgcgaaatagagaagagtaaatagatccctgtgcccaaatttctatttcccctgtgagagttccagtgcccctccagagagggggtgctggcatcactgcgcctggtggtgggggaggctgcccttctacagcagggtgggcctgagcctcacccactctctccgtcattctctagctgggctgcacattcagatccctggagagctttgaaaaatattgatttcagggccacactcacgaagattatgatttaactggtctgggttgtaacctaggcataagaattctgaaaatctccccgagtgattctaatacgcagctgcggctgagaaccatggctacagacaaagagcttcacaatctgactgtcgctgaggctaagtgtaagcctggtgaagggacacaaagttgcagccctttctttcaatgcaggcaggcatgcaggggtgcagggagcattcccactcaagtcaggatatggtagaaagggccttagctaaacaaacagccagtggcgattgctgctttaggtatctatgaccatgtggcataaaccataataatcatttgttatcattatgacccacatgcagctctggggcctggctagaccctgccatggggttcttacgtagactctgtaaaggtctttggtaattaggtttggatgaggtcataagggtgaggccatcatcatgggatcagtgcccttataaagagatgccacagagcttgctccctctctctctctctcagccatgtgagaaaaaagtgagaaaccactgtctgcaagccaggcagggcccacgccagaacctgaccatgctggtgtgactttcaccctccagaactttctgactttcaccctccaaaactgcgagaaatttctattgttgaagccactccatccttggtacttttttctggcagccccagctaaccaagtcacaggggaggagacatagacccccccaacacttgatagaaggagtgtcaaagaattctcagacatgtttaaaaaccacctgaactaaaaaggacatataaactccacctcttggatacagaaagactcatgccagtgagcctgaagctgtgaagttttccaggtatttaatagatggtcagtggtaaaattattttgtaatccattgagtttctaaaattatagctcctagaacttttcacacagaaaggagagatggaggtcaacttggcagtctcaccagcaaagcaacagagtagattctcacttatttttaaaatcccataacatagcactatgcctggcacatgggaggtgctgcgtaaacatgttataccctgactcactcagctcccaatgcctgtttccgtggcagcctcagaaacccacggagaagactctggactccaagacatctatcctatgtctggtattgctctgcctgcaggaaacagatgacactgtgtgggcaaggtgttcacctggtgacagagatgggagctgggggcagaggctgagactgtctggaagcaggtattggagttgacttccactctgaggggacagtgtgggtgtctgtgagggggttggctgtggctgagacactgggattcatttcagatgtggacgacagggctcagtgggaatggaacgcagcctaacctccagggctgctccagtccctctgtggccgggtcctggccacgtggtgggtgtcagctactcactgaaatactgatggggcactgctcccagggtcccctctagccagccagagtctataatgcaggtagaatgtccaccagcccttcaggagagatgggaaggcagcatttggaggagccccagggagggggtgccctgggacctcaggggtggttgaggagctgaaaggaggccacgttccccagggcagcagtgcactgaggaatggacgaaagggccatcaaggtgccccggtgccagagaggtgttggcctgagggatttgctaaccgggtgaggagtggaagggctacagggatgctacccaagatggaaggggaggaagtccccaggaccaggctgtctccatgcagaccctcaaaagcaaagaaccagcccaagtgatgactgctaacgtttgttaagtggttaccatgcacctggcagaaagtgagggccttccaccatctagccgttgtggcccagcgatgggaggtgacttcccagtcattcatgaaataatgcgtggcttcatcgccagcacctccgaggtggtgctatccccattctgcttctcaggaaactaggtgtatttgtttccaccgctgctctaacaaactaccataaacccatggcttaaaacagcagacatgtattctgtcagggttctggagaccaagagctccaaatcaaggcatcagcagggccatgccccctctcaaggttcccaggaagaatcctcccttgcctcttctgagattccggtggctcccagcaatccctcggctcctcggcttgtggacgcatcgctccagcccctcctgcacacgggcttcccctctgtgtgtctctgcgtctctttctgtcatcttataaatcacatttgaagacccacccaaatccaggatgaactcaactaattatatctgcaaagaccttatttccaaatacagaaatttgtcacattctgaggtcctgggtggagatggattttgagagtcactattcaccctattacactgagtctttgagaggtttaagaaattacctaagtttccacaacaaataaaaaggtggctgaaatggggtttgaatccccggagtaaagctgcccctgtagcccacagtggtgtcagcagcccgagggctgaacagctctaacctcttcccccgccgcccaagaaactgcactaccaccgccattttgagtcagagagacagaacccagtagagaacacagggcgggtctcagagaagaacactgcctgggatacagggcaggtctcagagcagggcccaggctggaacacagagcaggtctccaagaagaacccaggctggaatacagggcaggtctcagagcaggacccaggctggaacgcagggcaggtctcagagaagaacccaggctggatctcggatctgggcccaggctggaacacagggtgggtctcagagcagggcccaggctagaatacggggcagatcttggagcagggctcaggctggaacatggggcagatctcagagaagaacccaggctgcgtctcagagcagggcccaggctggaatgcagggcaggtctcagagcagagtcctggggacagcagcaccaatggctcttcccaagtggcctgagtgagctgggagggctcttttaactctgcaagcctcgggtccgtcttgaggctcatgggagattccgtacacctcctaggcatcccaagaagtgttttccccagatatttgtttcttccttaacgctagatttgctgccaccctctaattaatgggatctatctttcaagaaaatttctcttcagtcttctctctggactccccacttcctctctggcagtcccaagccattctaaattagattttcatattccttccccagatgtttaattctcctaatgagcattttctagctcaggcctgcactgctgtagcctgtagggtccctgaggggtgcccatggggaaggcggtgctcttcagggcttggagtgggttttaatatttaaatcttcacagcaatgccgacactagatggcagtggttcctaattattgggggttccaggcaggcttgccttcttcctgtgctgcccagggaggtcagacctccctgagatgggaagaagtgggtcattcccaccccaccaaccccctcctgcagacccagacccagaaagctcagcccgggtgaggaagaaaggaaagccccaagaggaaagatgtgaagcaatgaacttgacatggggctgttgatttcctctccaagtgcctcagacagatccacccctgagaggcccttacagaatgatcctctccaagtgcctcagacagatccacccctgagaggcccttacagaatgatcctctccaggggaggctcagaagctgtagccattgcctggcaagattttaggagcctcccctgcctcacccccaccccttatcccccacaggtaggaaagtccttgggaaaggcaactcagcagtgttcatcaaaagccctcaaaatgtcatatgatcactttatatgtaggaatttgttgtaagattagaagtgaataagtcaacaagaatatatgtttgggaggccaaggcaggcagattgtttgagctcaggagtttgagaccagcctggacaacatggcaaaacccagtctctacaaaaaatacaaaagttagccaggtatggtggtgcaagcctgtagtcctaaccacttgggggctgaggtgggaaaatcacttgagcccagaaagtcgaggctgcagtgagctgagatcacaccactgcactctagcctgggtgacagagtgagaacttgtctcaaaaaaaaaaaagggaacgagaaagagaaagaaaaaagaaaacagaatattcattgtacacttatttatagtagtgcgaatttggaaattgcgtaaattatacaactgttaaaagaaaaacttcagccaattaaaagagtttatttgagaaatgaaccattcacaaattgggcagtccccagaatcacagcaggctcagagagactccagggtttccttgtggtcagaaaaaaattatagtcaaaaaaagggaaatgacatacaaaaatcagcagtgaggtacagaacagctggattggttacaggttggtgtttgccttatttgaacaccgtttgaacactcagcagtgcatgaatggttgaagaatggctgctgggattggccaggtctcagctattgttacaggcgcatattcttatgttcggttctcaatcttgtctacctattaagttaggttacagttcatccacaaggactcaaatatagaagtacggagtccttctcaggccatatttaattaaccttaactattctccccttttagtcattttctcaattttcagagattgaccaaaattttagtcattgatgtcattatcaccaaggtaaatgtactattcagccttgaagcccactggggaacagtagaacagtgagttttgcgaaggtaggaacaaggactgagtagagggtagctccttatgctggaacatcctgtagagagagaaaaacaaaacctggtctgttctaggacctaagtgtttccttaaagacttagtttgattatgtcacatttagcataagcgactccatttttgtttggtttggtctgttggagcctagtgcataagctctaaaacaatggcttctcatgattttgtttaaaaattttacttaggttctcacttaggtgagagtgtgactaaaacttgggccttagtgccactctgttaccatcattttgggtttctcgcctcagcacgtcattcataggttatggtgtccccatggttgcagattcctttcagttcttgtcattccagttgaagacagaccatttgacattctagagatggctgcatgtaaacatttaaaacctttgagggaatgaagagcaccaggaagattactattatggctatctggaggataatactgagagtttggagtatgctccttacccagggtccccataaaccaaaccacctaaaattaaatagatcaaagaatgagctagataaagagtctactcgcttaactaagcagtcttttcattcaacccctacaactgaatctctgtaataccccatgttttctccataggccataagcgccagcagcttcacagatactgctatttagccagtaagtaatctagagcaattctattgtttagcataactttcataaaagaatttaaaatctgttgtgtaaccatagcctttacagtagaattttctatagagcttattatgagggatacatttctaatcattgcctcttttactctaaaccatgaaaaaggacataacaaatgatgcccttctagaagagtgaggcctcctagcaatgttctccttaactcattatatgggttaagaggagtcaatcaatgttttgtttctgattgattatgtggcaacatatgtaccattaaagtttctcacctacattgggccttcatcttttatctatcaaagtataaggttatccatgaataaggctggctgcaaaatccttcacaaataaaagtatattctgtaagtgcaaataacagacccccttttcacttctattgttcatagaggtataagcaaggaaaaaaaatatttgaagataagagtcttgatccgtgatcttgggaaaagctgttcacatcaaggatggcatcttcgtctggggagaaacttccctggttagctttaccttaagggttctaatgggtgtacagttccaacagtgtggagaaagccttctcagttgtgagattacgaacccaagtttcaaggacccaaagttttgttgcagtgtggatggcaagggcagtctttctctgatgttcccagaagatccaatcatcaggttctagactgtgaatgggttgcttgtcctcagtgaaccataaaaagctttctttaccttgtgaaaatacactgtgccataataagctactgttgtaacatcagccctcttgcatgggaacatatttataaaaccagaaaacatgcattgaaaatgacaagtgaatgaaatccctttataaatgtttaaatggcccatcaagtagtcaaatgtacctaaagttttgattgtcttcccaggaatatggtttttatatttgtcaaaataaacattttgacaatgtttagtgacaactaaacattggtcataaactattttagcaatttagaagtcatcacaccaatatatggttaatttggatcattctatcttttccataataagtcatggactacagaactttttttttttttttttttttttttttttttcttgagactgagtttcactcttgttgcccaggctggagtgcatggtacgatctcagctcactgtaacctctgcctcccgggttcaagtgattctcctgcctcagcctcccaagtagctaggattacgggtgcctgccaccacacccagctcattattgtacttttagtagagacagggtttcaccatgttggccaggctggtcttgaactactgacctcaggtgatccacccgccttggcctcccaaagtggtggcattacaggtgtgagtcaccgccccggccacttaaaaatttttaaaaaggcattgatagagggaagccttagctttccatacaatctgtctcttgtctttcctctttttttcctgtagtttatttaacaggcaaacaaaaatctgtcattatcctttaatattacatgaaaatctcattcaagagagaaagccaaattttacccttgcattagtttactattaatgtcaaccccaatttttaataaaaccttatagacaaatctatcaatcttaatcagtttgaccataaggtgagattctcatacaccttttataacccttaacaatttttgttaaagaatgagcagtgctgtaagaaaaacctgttgtgcttttattccaatgttcaacttacagaaaaccttaataattcccctggaactttagccaatgtccacacagaatttcttttcacaaaattaatttttcacaaaccgtccacaacttgttcaaatctttggctttatcttacataatttaaaacaatccttaaccctctaaactaagcaaaaatttacattcccatgccttcttaccgtcttttacttaaaacacattttacttttctaacacaccttgcatgtaaaactatttttgtagtagtctcaattacatgtgataatcgtaactcttggcaatttttaattttggtgaaaaacctagtaagttattttaattatgtacttaggtatggagtgtaggtatggttattttaattatgtacctaagtatggagcctagggtactacacagaagtgcagataagactctttccagcatagctagggatgtggctaactccacatgtccccaggccttacccagctgtaaagtaggcaagttgaacaatttttataacttaaagcaatttataaccttaaagcatttagtaaacataatatctgacctgcctaatttagatgaaatgtctttattttaccaataatctttaaagctgtttttatttcccaaagattactaaagttatatgaactaagagacattacagtttttattcttctttcaaaatatttaagtgcttatttttctttaaaccaattaattagagctcctttatataaacgtcacacacacaacacatatataactacacacagagaaagacagaagatccagtagttgtaagatttttcatttgccagtttttaagggttttttgtttgtttgtttgagacggagcctcactctgtcacccaggctggagtgcagtgacactatctcggctcactgcaacctctgccttctgggtttaagtgattcgcctgtctcagcctcctgagtagctgggactacaggcacatgccaccacattcagctaactttttatttttagtagaaacagggtttcaccatgttggccaggctggtctcaaactcctgacctcaggagatcctcccgcctcggcctcccaaagtgccaggattacaggtcccagattagaaatttgctcaaagaaactcagagagttcaaagcacaaatccatggagctccgaaatccaagagagaattactcacaattaccagccactccgagagatcagtggacacaagtgggactggcaggcaccttgcttgttcactcagcactcctggggtcatcaaagctctaccttaccccacttctgacaccatctgttaaaagaacttctgccacattaaatttaaaggagtttaattgagaaatgaatcatttgcgaattgggcagcccccaaaatcacagcagattcaagagactccagggatgcctggtggtcagaacaaatttatagacaaaaaaaagggaagtggtgtacagaaattggaggtgaggtacagaacagccagattggctacaggttggcatttgccttatttgaacacagtttgaacactcagcagcgtatgagtggttgaagtatggctgctgggattggccaagactcagcaattgttatagccgcatactcctaggttaggttttcaatcttgtctacctattaagttaggttatagtttgtcaacaaggacttaaatatagaagtatgaagtccttctcaggccatatttaattcactttaacacaataaaatactatacagacattaaaacttatctagaggaagaatatgtgtttacatggtaaggtatccaatgtatatatacggttaagtcaaaaaccagctccaaagagtgtgtatcatacaatcatactgtgcataatttaaaggaaacagaatgaggcagggaaggacagaaagaatcagatgaagggatgaaggaaggactgttaacagtgatttgttctagtttgtgggattatgagtaatctttgatttttatcatttatatatataataagattaagaagtcttatctttgttcataataacgaaaaagatcatctaaccaaattagtataaaataattttgtgcgttggatatatattaaaggaagtaagccaaaaatttagcttagaaatttaaatttcctataaagagaggaggtgtttcgaggaagtagagtttgcctttctgatatccacaaatctctgtgtttcttaatttgaaatcttaagttattagttctcttaaatgtaagagaacttacattttatctataacactgacctacaagttctaaatatccagtttaggaattcttctactttagatattcaatttaccaccttttaaaattgttagcaaaactactcacaaaaactcttgcacaggccaggagcagtggctcatgcctgtaaccccaatactttgggaggccaacaccatgggtgaatcatgaagtcaggagtttgagaccagcctggccaacatggtgaaaccctgtctctactaaagatacaaaattagccaggcatggaggcacattcctgtaatcctagctacttgggaggctgaggcaggagaattgcttgaacccaggaggcggaggttgcagtgagctatcacaccactgcactccagcctgggcaatacagcaagactccatctccaaaaaaaaaaaaaaaaaaaaaaacactagcacaaagattccacccacaacccccaggaagcaatagagaagctgggaaacaactggagatggctaaggagtgacagatctttcctaggagactagagagcaaacggttggctgagaggctctctggctttggtgtgcagctgctgccttggcagacacttgtttgaggtcttctctttcctcccacagttcctgcaaaccactccactccaccttaactctggaagagtggggcatcttctcaggtgatgccttgggcccccgaaaagttttctctagttcctcctagagatggcactcattaataagtccattgtgatttcagagtcctaatagattaaaaaaaaaaaaacaaccttcctgaatgttaactgttaagctagttcagttaagttagtgattgaaatttaaacacgctattgtatggcagaagtagcagcagcaaatcaagccttctcttcaggctgggtgtggtggctcaagcctgtaatcccagcactgtgggaagctgaggcaggcagatcacttgaggtcaggagttagagaccagcctggccaacacggcaccccgtctctactaaaaatacaaaaattagtcagggatggtggtgcatgcctgtaatcccagctactcaggaggctgaggcaggagaatcacttgaacccaggaggcagaggttgcagtgagccgagattgtgccactgcactccagcctggatgacaaagtgagactccgtctcaaaattaaaaaaaaaaaaaaaagtcatctcttgtgtcaatggggaacagaaaaattctgagcacctaagtggaggagggtgagcaggagaagaatataacagggcaggagaaagctgtagaaaagcagtgctgagaataccagaagcaaacttctatgtcagtcctgcctggaactccagccaacttccattgtgtgcagaggtattttttcaaggaaactaaaaacttgggacatcaattcactataccaaaagaaaacctgtcgaccctgctgtgtcaaactaaatgacaggttcttgtagtgtgtgacttatgacgctgtgtgcttgttatcttactgtagccaactttgtcatagaggagcattcaaacagctccttggttgcattatcattaaactaccaacaggcagaagactagtttccaacagaaggataaatttcattttatagctcggtaaaagcttttataaaaataatcattaagttattgtaacaagaaaatagtaaagatatcaagaaattttgttttctaatatcagttgtgccctgagtaaagtatttagggtttttaaatcaagtttagcctaaagctgcctccttacgtattttaagttcagcctaaaggtttttctgtacatcatgaactataacaagcggaggtgtcatgagacacctccttgtgccaatcacggagttttggccaatcaaatgtagccagctgttcaaaccatgttcaagtaaggcaaatgacaagctgtttatgtacctcacttccattttctgtacatcactttcctttttctgtcataaatcttcttccaccacatggctgtgccaaagtctgagcctattctggctcaggaggctgccccatttgtgaatcattcattgctcaattaaactcctttaaatttaatttggctgaagattttcttctatcagggtcttgatcgtgtgttttaatgtatatagacagaagttacagagaatacacagtgcatagaatttcagttgtaccttagaaactctgagtgtgaagtagttaaaatacaaaaccccaatctgctcacatatttactgagcagacactgacagacagtgccaccttctataattgtacaattacatgcagtaactaaccagaatgaaaatagagcttgggaaatggagcagatggccacatcatcgcttacaagatgcacttgaagtggagattatgatccagcatctcaccattttcaggggaagctatttgaatggcagatgcctcccagaggtcctgctatgtcctcccacctggggtgaagcatccctgtgaagtctaccacgctcccacagagctcatgccaccaccttcagcaggatgcactgaaaattgttttatagctgctaacttaaaacaactgaagacagatattgaggcttttctacagtttatatatttattttctcaagtccaaggaaagaattggttctgcatgaaccagaatacgttgaggattgtgaaaggaaactaaaaacttgggacctcaattcactataccaaaagaaaaaaaattcaactgaaagctgagtcttgcaagaagctgcctttcctcctgttcctagcagaaagctacagattaaaggttaaatatctccacgagtagctactgtatgttcacattatcttatgtaaagagctgatttactgagcataagaggaatacgtgattgactattccctacctgctcatttcctcttacaaatatgcattcaataatgtgaccatcccctctccctctcccctccagcccactttttctctgtaaatactgaagccctcagaatcatctttgaagaaaggcacagagcatagactgtttctgtgatttcatgtgtatttcttctgggcatgtccttaactttgtcaaaataaacttctaaattgattaagacctgtctcagatactttttggtttacagaatcagtatgaaacacagaagattaccagtaaacaacaccagacaagcaaaatctaccccaagactaaggcattgctaaaaactaccccaagagtaaggcattgctaaattgtaaagtaattctgcttgagtttaccaactccaaaaatcagggattggtgtaatcactcaagtttcatttgcatgaaacttgaatgaccagtgattatgaacttttttttatatgtttgttggccacataaatgtcttcttttgagaagtgtctgttcataccctccgcccactttttgatggggttgtttgtttttttcttgtaaatttgtttaagttcattgtagattctggatattagtcctttgtcatatggatggattgcaaaaattttctcccattctataggttacctgttcactctgatgatagtttcttttactgtgcagaagctttttagtttaattaagttccattcatcaatgttggcttttgttgccattgcttttgatgttttactcatgaaggctttgcccatgcgtatgtcctgaatgttattgcccaggctttcttctcaggtttttatgcttttagattttaatgtttaagtctttaatttatcttgagttaatttttctataaggtgtaaggaaggggcccagtttcagttttctgcatatggctagccagttttcccaacaccatttattaaatagggaatcctttccccattgcttatttttgtcaggtttgtcaaagatcagatggttgtatatgtgtggtgttatttctgaggcctcagttctgttccattggtctatatatctattttcgtaccagcaccatgctgttttggctactgtagacttgtagtatcatgtgaattcaggtagtgtgatgcctccagctttgttctttttgcttaggattctcttggctttacaggctcttttttggttccatacgaagtttaaagtagttttttctaattcggtgaagaaagtcagcagtagcttgatggggatagcattgaatctataaattactttggggattatggcaattttcacaatattgattcttcctatccataagcatggaatgtttttccatttgtttgtgtcctctcttacttccttgagcagtggtttgtaattctccttgaagaggtacttcacatcccttgtaagttttattcctaggtattttattccctttgtagcaattgtgaatgggagttgactcatgatttggctgtttgtctattattggtgtataggaatgcttgtgatttttgcacattgattttgtatcctgagactttgctaagttgcttatcagcttaaggagattttgggctgacacaatggggttttctaaatatataatcatgtcatctaccaacagagacaatttgacttcctctcttcctatttgaataccctttatttctttctcttatctgattgccctggccagaacttccaatactatgttgaataggagtggtgagagagggcatccttgtcttctgctggttttcaagggaacacttcccaactttgcccattcagtatgatattggctgtggatttgtcataaatagctcttgttattttgagatatgttcaatcgatacctagtttattgagagtttttagcatgaaggggtgttgaattttatcgaaggccttttctgcatctattgagacaatcatgtggtttttatcattggttctgtttatgtgatggattatgttgattaatttgtgaatgttgaaccagccttgcatcccagagatgaagccgacttgatcgtggtggacaggctttttgatgtgctgctggattcggtttgccattattttattgaggatttttgcatcaatgttcatcagggatattggcctgaaattttctttttttgttgtgtctctgccaggtttaggtataaggatgatgctggcctcataaaatgagttagggaggagtccctctttttctattgttcaaaataatttccgaaggaatggtaccagctcctctttgtgcctctggtagaattcggttgtggatccatctggtcctgggttttttttggctggtaggctattaattactgcctcaatttcagaacttgttattgatctattcagggattcgccttcttcctggtttagtcttggaagggtatatgtgtccaggaatttatccatttcttctagattgtctggtttatttgcatagaggtgtttatagtattctctggtggtagtttgtatttctgtgggatcagtggtgatatctcctttatcattttttattgtgtctatttgattcttctttcttttcttctttattagtctggctagaggtctattttgttaatcttttcaaaaaaccagctcctggattcactgatttttttgaagggttttttgtatctctatctctttcatttctactctgatcttagttatttcttgtcttctgctagcttttgaattctcttgcttctctagttcttttaattgtgatgttagggtgtcaattttagatctttcctgctttctcctgtgtgcatttagtgttacaaatttccctctaaacactgctgtagctgtgtcccagagattctggtaggttttatctttgttctcattggtttctcattatttatttctgccttaattttgttatttacccagtagttattcaggagcaggttgttcagtttccatgtagttatgtagttttgagtgagctgagtgagtttcttaatcctgagttctaatttgattgcactgtggtctgagagactgttcgttatgatttccattcttttgcatttgctgaggagtgttttacttccaattacatggtcaattttagagcaagtgcgatgtggtgctgagaagaaagtatatttttttgatttgggtggagagttctgtagatgtctattaggtctgcttggtccagagctgagttcaagtcctgaataccctcgataattttctgtcttgttgatctaatattgacagtggggtgttaacttctcccactgttattgtgtggtagtttaagtctcttcgtaggtctctaagaacttgctttatgaatctgggttctcctgtattgggtgcttatatatttaggatacttagctcttcttgttgcgttgatccatttaccattatgtaatgccctcccctctgtctttttttgtctttgttggcttaaagtctgttttatcagaaactaggattgcaacccctgcttctttttgctttccatttgcttggtaaatattcctccacccctttattttaagcctatgtgtgtctttgcaagtgagatgggtctcctgaatacagcacaccaatgggtcttgactctttatccaatttgccagtctgtatcttttaattggggcatttatcccatttacatttaaggttagtattgtttagtgtgaatttgatcctatcattatgttgctagctggttattttgcccattagttgatgcagtttcttcatagtgtcgatggtctttacaatttggtatgtttttgcagtggctggtaccggtttcacctttccatatttagtgcttccttcaggagctcttgtaaggcaagcctggtagtgacaaaatctctcagcatttgcttgtctataaaggattttatttctccttcacttatgaagcttagtttggctggatatgaaattctagtttgaaagttatttgctttaagaatgttgaatattggtccccactctgttctggcttatagcgtttctgcagagagatccactgttagtctgatcatctttcctttgtgggtaacctgacctttctctctggctgccttaacattttttccttcatttcaatcttggtgaatctgacgattatgtgtcttggggctgttcttctcaaggagtatctttgtggtgttctcttgtttcctgaatttgaatgttggactgtcttggtaaattggggaagttctcctggataatatcctgaagagtgttttccaaactggttccattctccctgtcactttcaggtacaccaatcaaacataagtttggtcttttcacatagtcccatatttcttgaaggctttgttcattccttttcattcttttttctctaatcttgtcttcacacttcatttcattaagttgatcttcaatctctgatgtccttttttccacctgattgatttggctattgatacttgcatatgtttaatgaagttctcgtgctgtgtttttcagctccatcatgtcatttatgttcttctctaaactggttattctagttagcaattcctctaaccatttttcaaggttcttagcttccttgcattgagttagaacatgctcctttagctcagaggagtttgttactacccaccttctgaagcctacttctgtcaattcgttaaactcattctccctccagttttgttcccctgctggtgaggagttgtgatcctttggaggagaagaggcatactggtttttggaattttcagcctttttgcgctgatttttcctcatctttgtggatttatctccctttggtttttgatgttggcgaccttcagatggggtttttgtgtggatgtcctttttgttgatgttgatgccattcctctctgttagttttccttctaacagtcaggtccctctgctgaaggtctgctggagtttgctggaggtcccctccagaccctgggtatcaccagcggaggctgcaaaactactaagattgccgcctgttccctcctctggaagctttgtcccagaggggcacccaccagatgccagccagagctctcctgtatgaggtgtctgtcaacacctgctgggaggtgtcccccagtcaggaggcatgggggtcagggacacacttgaggaggcagtctgtcccttagcagagcttgagcactgtgctgggagatccactgctctcttcagagccagcaggcaggaacatctaagtctgctgaagctgcacccacagccaccccttcccccaggtgctctgtcccagggagataggagttttatctataagcccctgactggggctgctgcctttctttcagagatgcccttcccagagaggaggaatctaaaaaggcagcctggctacagcagctttgccatgctgtggtgggctctgcccagttcaaacttcccggtggctttgtttacactatgaggggaaaactgcccactcaagcctcagtaatggcggacgccccttcccccaccaagctctagcatcccaggtcgacttcagactgctgtgctggcagtgagaatttcaatccagtggatcttagctttctgggctccatgggggtgggatccactgagctagaccacttggctccctgacttcagccccctttctaggggaataaacagttctgtcttgctgatgttccagataccactagggtatgaaaaaaattcctgcagctagcttggtggctgcccaaacagccgcccagttttgtgcttgaaactcagggtcctggttgtgtaggcacctgagggaatctcctggtctgtgggttgcagagactgtgggaaaagcatagtatctgggccagaatgcaccatccctcacggcatggtccctcacagctttcctttgctaaaggaaggagttccatgaccccttgcgcttcctgggtgaggcgatgccccaccctgcttcagttcaccctccatgggctgcacccactgtctaaccagtcaactaattagagcccttttatatatttttaatagtgaaacattgtgtatgcaacacataaatacatagacatattgagccaggagaatagggtaggagacagggaacgtaaggcccatttgtgctgacttcctaaaagaaaaaacacagccgggcacggtggctcatgcctgtaatcccagcactttgggaggccgaggtgggcggatcaggaggccaggagattgagaccatcctggctaacacagtgaaaccccgtctctacaaaaaaatacaaaaaattaggtgggcatggtggtgggtgcctgtagtcccagctactcgggaggctgaggcaggagaatcacttgaacccaggaggcggaggttgcggtgggatgagatcgtgccattgcactccagcctgggcaacaagagcgaaactccatttcaaaaaaaaaaaaagaaggccaggcgcggtggctcacgcctgtaatcccagcactttgggaggccgaggtgggcggatcacaaggtcaggagatcgagaccatcctggctaacatggtgaaaccccgtctctactaaaaatacaaaaaattagctgggcgtggtggtgggtgcctgtagtcctagctactcaggaggctgaggcaggagaatggcgtgaacccgggaggcagagcttgcagtgagccgagatcacgccactgcgctccagcctgggcagcagaggagactccgtctcaaaaaaaaaaaaaaaaaaaaggaaaaaggaaaaaaaagacaaaacaccaaggcctggggggcagggaatctaaggcccattcaagctgacttcccaaagctggataaaaggaaaacacctgggtctgtgggcaggtaacctaaggccaactaacacaaacttcctacagctaaatcaaaagagaaaaaccctgtctccccaccccaggtaacaaaggatcaaaggctactcttgctacagccctcccacttccgccacgtctcagggggaaaaggagagtgccttgggttggctatgggccaagcaggggaccttcccttcatctgcacagggcgccaattcacctcagccttaaattagccatagaccaaatccagataagcggtagccaataagaacctcaaatgggccgggtggctcatgcctgtaatccagcactttgggatgctgaggcaggcagatcacgagatcaagagtttgagaccaacctggccaatatggtgaaacccagtctctactaaaagtacaaaaattagccgggtgtggtggcaggtgcctgtaatcccagctactcgggaggctgaggcaggagaatcacttgaacccggaaggcagaggctgcagttagctgagatcattccactgcactccagcctgggcaaaagagcaaaactccggaaaaaaaaaaaaaaaaaaaaaaaaaacctcaaatggggtacttaaagcccaaaacaatttgtaactgggtccttgagcttgttgctggggcccactctcaccctgtggagtgctttctcgctttaataaattcctgctttcactgctgtgttcctgcatttcattcctctgctactttatttgtgagttttgttcaattctttgttcaaaatgccaagaacctggacaacttgtagtcaagaccctccaccggtaacagtattaggcataacagtagaagtacatcttatcgattcataagaccttctcttttttttttttttcctatcttagacttgcaaactcttgataacctgtttcattactctggcagttgtcagttaaatagccctaagtctgcatattgaaggaaataattcttaggtgaaaaatcagcaaaatttacatctcaaggtacagagagaaaaagtctggtggtgctagagggagattaaagatgtatgccaaatcaaacataaaattatagaaatctatcataggattgtctaaggagaccaatttatttagatagagactacctatattttaactggatctctgagctctgggcagagccatcactggaatcctgggtctccaaaaagggagaattattatgaggctagaccacacgatgcttttacagtgcacttaaaaaaaaattttttttttttgagacaaaaatttttttttttttgagacggagtctcgctctgtcgcccaggctggagtgtagtggcaggatctcggctcactgcaagctctgcgtcctgggttcatgccattttcctgcctcagcctccagagtagctgggactacaggcgcccgccaccaaacccggctaatttttttgtatttttagtagagacagggtttcaccgtgttagccaggatggtctcgatctcctgacctcatgatccgcccgccttggcctcccaaagtgctgggattgcaggcgtgagccaccgtgcccagctacagtgcacttaaaaatgtttttaaacaaaaacatttataagtgtctaaactacactcttccttaaaaacacacaagagtagtctctgttccaatagctattttagtaaaaaaatcaggtaacacaatacaaaagcaagcagtttaagagctgagatgaacttgtctgtttacactcttggggttccataaggaaaaacagaggtttctccccaaaagggagtctggcaccttttctgttttctttaaggaatcccaatctaatctactaaaactattttaggtctctcatgcagcagagggtgcaagagaaaggggagacagcagaagtaaatgaagaaaacagaattcattcaactagaagaaaaaacttttgctgaaaaaaaacaaggtcctaggagaaaaaaaacaaaaacaaaaacatgaaggccttttaagtacaaacacacacacacacacacacacacacacacacacacacacacagaggaatcttggatgttagcttttaattaagctgacctttagtccagttgagctcctttaaaaaaatcttttaaaatctcattaccatatttccgctaggacaaattcctgctatttcagaagtaccaagtatcaaatgagaaagggcttgatttgggaaccaaatccaggctcttgtggtgaaaagagaaggcagaactttagctatggaactgcagcacggggcgacagccattgctctttccgtttggcctggctagcaaaaaggtggcctcgttatgttaataaagacccttaagtactcaaaataaaaaatctttcctttttgtttcccttttgctggccatttttctccccccacctcaccacctttttgtgtgtgtgtatgggaatttagccacttgggagtcctcgttcccataatttggaacttcccttcagatttgatcaagtcaaatagagttggtcaaacccaatggaagaaagactgaaacaacaagaacaacagaaacaatcaaccaaccaaaaaaaaaaaaaaaaccagttaagcaaaacaaatgatcccacaacttatactattactgagcactgtaacactaaggagaaattaaattttagccaagacaaaccccaattcagttacttacctagggatgggtctcaggccgaagactgctctctactatcctagatgcaggagaaaacttaaacttgtcttccctgttggaagagagctcaaactccataaaggagtccagaaggagctttccttcaacatcaaagcaggaaaacttgccttccttgtgttagaagcaagtaaaactcagagaagaggaagttgtacagcaaaataaactttagatcttgaccaaattttgggagatcaggaattctctggagggggtacttccaggcctcagcaaattgtcctactcattcgaaccataaagataactcaaattggtaccaagaaccgatgggagatttgtcaaaggtcaggggcacctccactcagaatccctcagtggttaccaaaatgtgaaccccaaatatctgagacagatctcagttaatttagagagtttattttgccaaggttgaggatgcgcacctgtgacacagcctcaggaggtcttgacaacatgtgtccaaggtggttggggtacagcttggttttatacattttagggagacatgagacatcaatcaatatatgtaagaagttgattgcttccatctggaaaggaaggacaactggaagcatggaagaggcttccaggttacacgtaggtgagagacaaagggtagcattcttttgagtttctgattagcctctcaaaaggaagcaatcaaatatgcatttactcaatgagcagagggttgactttgaatagaatgagaggcaggtttgccctaagaagttcccagcttgacttttccctttagcttagtgatttttggagtcccaagacttattttcctttcacactgtaaatgagccaaatgtacaattaaaaggcaaaggttttcagattggatgtttaaaaaggcagacacaacttgtgtgcggcctataaaaaacctatgctaaatataaagacacagagaaaaaggacggaaatagatacagtaacagtaatcaaatgaaagctgtagaggctctgtcattttaaaaatattatctgagaactttcaggggaaatataatgtgaagaacaaagagagtgacttcataatgacaaaagtgtgaattcaacaagaggagggccgggcgtcgtggctcacgcctgtaatcccagcactttgggaggctaatgcaggtggatcacttgaggccaggagttcaagaccagcctggccaacatggcaaaacaccgtctctactaaaaatacaaaatttaggcaggtgttgtggtgcatgcctgtaatctcagctactcaggtggctgaggcacaataatcacttgatctgggaggcagaggttgcagtgagctgaaatcatgccactgcactccagcctgggcgacagagcaagactctgtctcaaaaaacataacaaaaacaaaaacaaaaacctaacaaggggacataacaatcttaatgtttatgttcctaattacagagtttcaaattacatgaagcaaaaactgataacacagaaagaataggcaaatcagtaattatagtcagagatgtcaacaccattctctcagtaatcaaaaggacaaatagatagtaatcaataggaatgcaaaaaacttgaacagcatttttatccaatctgacctaattgacatttatagacctctccatgcaacaacagcaaaatatacactcttttgaagtatacccagaataaatcatattctgggtcgtaaagcaagtactggtaaatttttataaacccaaattctaccaaatatgtcattcaactacaatggaattaaactagaaatcaacaatataataaagattaaaacatacatacaaagaaacaaaagaagatttttgaaggtgatgaatatgtttggtaccttgagcatggtgatggtattatgggtttgaacacatatgttcaaactcatcaaaatgtttacattaaatacgtgcaattctttatatatctaaacatactcaataaagcttaaaaataataaaatctcaaataatgaaagttatctggataatctccaaatctccaaagtgctgggaagtgaaatagcacatttctttctttctttctttctttcttttttttttttttaatttgagacagagtcttgctctgtcgcccagcctggattgcagtggcatgatcttggctcactgcaacctccacctcccaggttcaagcagttctcctgcctcagcctccctagtagctgggattacaggcatgcgccaccatgcatggctaatttttgtatttgttagtagagacagggtttcaccatgttggccaggctggtcttgaattcctgacctcaggtgatccacctgccttgttctcccaaagggctgggattacaggcctgagccactgtgcatggctaaatagcctatgtctaaataacacatacgattaaagaagaaatcaaaagagaaattagaaatcattctaaactaaatgaaaatttaaagaaaacacacaaaaattgtgggatgctgttaaagtagcattgccctctagggcaaattcataacattaaacacctatgttagaggaaatcatgggtccaactcgctttaagatcctagggaaaaaagagcaaattaaacccaaactaagcagaataaagaaaataataaaaattagagtggaaatcaatggaatagaaaaaaatatagttgatgagatcaaaaacattttttaaagaacatgaataaaatcaataaacctctaaccagactgatcaggagaaagtagagaagacataagttaccaatattaggaataagcgatgtatcatcattacaaattcagagattaaaagaaagtatcatgagtgttaatggaaaagccaaactctgtaaaatattttaaagagggaattctcagccaacacaagtgaccacaacccagggaaacacaatcgcaaagagtcctgaaaaagtgtgtccacggtaattggattacagtttggttttatacatttcaaggaagcaggagttataggcaaagatacacatcaactcatggaagatacacgttggttcagccaaagagccaggattcagagattccttagtttgcaatttattaaaaaagtaaggttctgactaaaacttggagtcagcagaaagcaatgttttacattaagataaggatgccatgtagcaagactgacagcctgcaggtgacttaaccctggcgccacatggccttaggtcttatttttaatttggtgtcttattgccacaaagagtgtgttctgtcagtgttaagatctctactttaacactaatgctgctcaggtgttgtgcctaaactccaaaagggacggcaggtaacaaggtgtgttcgacttcccttcccatcaaggctgagaactcagttttccaaggtttatgtggagtctcctttggccaacaggggggtccatgcagtcagtgggggacttaggattttatttttagtgtacgtgagcaatagtataacaatcaatttgacaatttatataaagtggacacagtacttgagagacacaaactaccaaagctcattcagtccagaaatggatagcctgaaagcccttccaggagagaattctccaggggtgtcttgcgtttctgtatgtcttgcaagcagagctttgttctggatggtcttcttgtgacctacaaaagggtcgggctgctagctgcttgtagaaagaagttaaaataataatgagggccaggcgcggcggctcacgcctgtaatcccagcatttggggaggccaaggcgggtggatcaactgaggttgggagttcgcgaccagcctgaccaacatggagaaaccctgtctctactaaaaatacaaaattagctaggtgtggtggtgcatgcctgtaatcccagctactcgggaggctgaggcaggagaattgcttgaactcaggaggtggaggttgtggtgagctgagatcgtgctgttgcactccagcctgggcaacaagagcaaaactctgcctcagaaaataaaaataaaataacaacaataataataataatgagttgtggagggaatgcaagggtttttaaagaaagggtttggaatgcagaagaggtgaggggtaggggtgagagttggtgattaggaggtgccaggcagcaagacccactccgatcactcatcttgaattattattcaatttggtgaaggggctggcatcatcatggatcctaccaggttataaattaatcacagttaatcttgtatcactcttcagctgggagtgggttccagccttgaagtaatcttttgttggagagagaattctggaggtgtctagtccctatgaggatcccactcctgaagcctctaaggaaatagatggccagataggtgagcatggtgtgtgcttaacaaacatctgggtaaataagtgtgcataaggcatgggggcatagaatggaaaaggatgggaagtggaggttacagcactttctgaggctgtagtacaagatgaacatatacatagcttgtctcaaagtcatatcttgagacaagggagtgggcgaagagaaaaggggaaagaagaaagttttaaagtgtggtttaaggctcagctgctaagctgcccagttacattctcaaagatgtttgtatatgaacagctgtggaagacagtgatggtgtctcactctggagcacagaatagtttgattacctgtccagaatgataatgtttcctttaaggcaaaggtcagataggtttgctagcagcctgtataataaatcaaaagaaacaaggagagagtgagagagagaaaaaaaaagaaaaagaagaagaaagaagaaggaggaggaggaggagcaggggaggggaaggaagaggagggaggggaaggaggaggaaagaaagaaagaaggaaaggaaaagaagagattaataaataaaagattttagtttgctgaagtaggggttccacggctgtgatgcaaatctggatgccctcaacatgagggttctgacacctcctgtgattttcagcttggtctttctcactgcagggccttcttaagggcatctgaagggaggtttaccgaggctttgtaaagacaagggagacactctttcttctcccttcccttttctcctcttttttcttttgtcattctctttcctcctccttgtctgactgtcctgtcttagttcttttagcagccttattgaaatatttccataccacaaaattcctccatctaaagggttttacattttaagtctagtagtttttagtatattcacagagttgtccaaccatcaccacaatctaactttagaacatttttattacctccaaagggaacactatatgcagtagtagtcagtcctcattcccaccccacaaacccttcccggacagccactacttcactctctgtctctacagacttgcctattcggaagattttgtgtaactggaattatataaaaggtagtcttttgcatctgtcttctgcaacttagcatagtattgtcaatgtttatgttgtagaatgcatcagtcttcattattttttattgacaagtaataccatactgtatggatattaaacatattattcatctattcagcagttcctggacattttccttgtttatactattttggtattatgagtaatggtgctgtgaatatttgcatacgagcctttgtgtgtgcacatgcttttcatttcccttgggtacacacctacgagtagaattgctgggtcatatccacaggaactgccagactgttgtccaaagtggctgccctattttatcagcagttcaggaaggttccaattattccatattctcaccaacatttgttatctatcttttttgattacagtcctagagggtgtgaaatggtatctctttgtggttttgatttgcatttccctaattgactaatgatattaagcatcttttcacgtgcttattggccatttatatatatcctttgaaaaatatctattcaaatccttgtccatttttagttgagttacttgtctttttattactgagttgtaaaaattctttatgttgtctggataaaagtacctaaccatatgtataatttgcaaatatttcctcccttcccaaatgggagaaaatgcaacaaaaacaaaaatagacaaatgtgacataattaaactaaaaatctacacagcaaaataaataatcaacaaagtaaacagataacctatggaatgggagaaaatatttgcaaattacacctctaacaaaggactatctccagaatctacaaggaactaaaacaactcaacaagaaaacaagtaaacaaccccattaaaaactgggcaaaggatgtaaatgcgcatttctcaaaaggggacatacatgtggccaaaaatcatgaaaaaattctccacatcactaaccatcagagaaatgcaaattaaaaccacaatgagatatcatctcacaccagtcagagtggctaccattaaaaagtcaaaaaataacagttgttggcatggatgcaaaggaaagggaatgcttatacactgttggtgggaatgcaaatatacactgttggtgggaatgcaactatagcctctatgaaaaacagtatgaagatttctcaaatagctaaaaatagaactactgtttgacccaggaatctcacaactgggtatctaccaaaggaaaagaaatcattacacaaaaaagatacctgcacttctctgtttatcacagtaccattcacaatagcaaagtcatggaatcaacctaagtatccatcaattgtggactggataaagaaaatgtggtacatatataccatagaatactatgtagccatgagaaagaataaagtcatgtcctttgcagcaacatggatgcagttgtaggccatcatcctaagtgaaataactccaaaacagaaaatcaaatgccacatgttctcacttataagtgggaggtaaacaataagtacacatggacataaagatggaaataatagacactgggggaaaataataggcaaaaagtggggaaggtagagagatgagggttgaaaaattatctattgggtataatgttcaccactggggtgatgggtacactggaagctcaaagtcccagcattacaaaatatacccatgtaacaaacctgcacatgtacaaatcttgaatctaaaataaaaatgtttttaaatgtctgagtgagaaaggattataaaggtcccataaccccagattcccctgatccctgacctgcatttaccacatcccaaccaagtggtcatctggccagtgctagaatgtctgcaatgacagagatactctccacctgccaaaacagacaatttcattttggggtcagtttgattttggggcaggtcttccttgaagctcttgacaaatcatttcagtgtcaacctcttaggatcatacaaaaaagtcttccacatgatagctagccctctataaacttgatgacatattttttatccctcaaacctttcctcctgaaggtgaaatgttccctagtccctcagtaaattctcactttggcgtgtttttagtttcatcacctgactcatacttttgtgttccagattatttttagctttctaaacatgtggctcccaaaaatgaatgcactattccaggtgtggctagccagcacaaagtaaagtggagctatcgctctctgcctgctgacttctattcttggattaatgcagtctgagctcatttttttttggcaggtacctcacaaaccaatgactcacattgagacaactttttaataaatgcactaaaaatctgtacgtttatttaggaaaagatgccacaaagtgacatattcctcattctgcatttgagcaagtgggtctatggatcaagatcaggactttttctgctaactcctacctgttactatcttcacgaaccctggttttgtcccatagctcaatataatctacaagtgtaacaaccatgtagattctgtcagtcatatctcagaattagggcatgaggtgtgatgcttcattagagcaccctggagcaggcagggtcaaagacgaagccaggacctgaaatgacttttaccaagaggggaggtgaggcccagaggacgcagagccaggaggagcaagtgagatgcataacccaaagagcacaaccaatttatccatggatttggccacagatggccctggtatttctcaaggaagacggtggaatcctgttctagggggctgtgagggaaggaactgagaatctggtggacaagaagccacagctcaggagagctctcttaggggttacagttgtttgaaatgtggaaagaaagggcttagtctctggaagaggagctagcgagaacaagatgggaggcacagtggaaaccagtcctagcaaactggaaccagggagagctccctctgggcaaggccttgggattacaggctcagcactttctgattggagtccaggagcaagcagttgctgatgagcttgcctggaggggattggtccagaggctgggaggacagggcagcgtggaattcagcaggaggtagctgcaaggagtggagaaggcagaagctgggaaatgagactgggcctgagatatactatcgttgaagtctccagtgaaagtgtggaagaggccttcacacacactattgaaaggccaccacacacccatcctcttctgtttgaatttcccttctatgtacttttcttcattttttctttaaactcttattttcttgagagcaatttccctgtactgttttccctgatgttccctgggccttagactaccttttgagaaagacatgcacttagactttattgctcaacactcatgcccattgcatcattgtctaacctgcatttccctctcatccaaaggggcaatgtggacaaaacgaagtaaaaagatcaaatgccttgcagaatttcagtgtcagtgttgctcattctaccaatcttttgatcttaaaactgggttcaaaaggaaataagctactttggagccaggtacagtggctcactcctgtaattccagcactgtggaagattgaggcaggcagagacttgagcccaggagttcgagaccagtgtgggcaacatggcaaaaccccgtctctataaaaaatacaaaaattagctgactgtggaggtgcatacaggcagtcccaggtagttgggaggctgaggcaggagaatcacttgagcatgggagactgaggcttcagtgattcatgattgcaccactgcactccagcctgggtgacagagcaagaccctgtgtccgaaaacaaaaaaacaaagaaagaaacaaaaagctggtttgcatagtttttcatcaaatccaatgccaaattctagccacttcttgcttttctaagcacagacaggcaattcattgctaaactattttacaaatctcccaactatattatataaaatctatctcctctcttatcaagggaaacacttgctcatctttgagcaactcacatactccaaatacctctggtgttgaaagccgtctggtcattagtatgttcagctgctcagtgtctgaaattcctttgggtcagacctctagagcaaccagataatctctcagtggcggtcacaggctagcaagccttggccgtatccagaccatgcctatcatggtctggcaaccctgccaaagtaacaaagcaacttttacttttatatctttccaaagtaacaagacaactttgaatttattgccaacattgaacattgaggacctcatataaaatcaggattcccagctgctcttgaaaatttggaagttgtgaccctgctgggcccacattccctagagtgttgggtctcctgggctcagcagctgctgcccctgagggaggcatgcatctctcctgtgtaagtttccacctggctctctggcttggtcatattggcttcctggcctctttttgcatgtagtttgtgatccctgattgtaggtttcatcatttatcctgggctgtttcctcctgggagttataaccttcctaatctgaagctgaaactcccccaaatgcaagctaaacgtgagttgacagtaatggctaatgcctaaatagcacctactgtgtaccaggcctgaaacactaactcatttcatcttcacaacaagcctatgctgtgggtgctggttactgcaacaggcctgaaccaccagctcatttcctcctcacaagcccatgcggtgggcactcgttaccacactaggcctcaacaaccagctcatttcgttaccacaccaggcctgagccaccagctcatttcctcctcacaagcccatgcggtgggcgctcgttaccacactaggcctcaataaccagctcatttcattactacactaggcctcaaccaccagctcatttcattaccacaccaggcctgagccgccagctcatttcatcctcacaagcacatgcagtgggcgctcattagccccgttttacaggtgaggacacatgctcagagactttagcccacttgtctggagctgactgcctccacaccttctgtgtgattcacactgacacaactggacatttcctaccacgaacatgatattcactctggttttctgccttgacctctacatttttggcccctgcacatttgggcctcaaccttccagacacggttcctccagctcggttagagtcccgtgctcctcctcccatgcctttggtgcccacactaagtcggggctcagaagtcactccatctgtgacttggctgctctgctttgtgagctcaagaaaccaggaagcctgttaaacacgccatcaggaatgctgaagaattaagattgtccaataaaagtcagtgtcaaaggaatggaaaatgaagtgtggatgggaaccgttatttctcaggagtcagggagtatctaaatttgctgtctgaagtcagagccatagaaaatccccagctgcactctggtagtagtggttttagcacctttacttgtcattacaaataaatttgaaactgaaggaaagtgaagaaacacctctcagaagagcatgatgccttcgacctggtttgctaggacaggaactggacacagattctgaaaatctcattcattcaagctgaataaaatgtagacgcaaggacatttacatagtcagccattcctcaaggatttactgagtgcctactgtgtaccagaagtggtattcgttaggtaccacatgtttcattcatttgctcatagtcctttgaggcccttctaggtggaagccccacaataggctctggggatacagcccctgccactgcagagctgatgttttcacataagattcagacttccaacaaccaattacactactggttaatcacaattatagtgctgcaactaggcgttcccagtcagtctgggaaatgcagaaaggcctccctggtgagaaggtctctgcactaaaatctgcaggagctgcaggagcagagtgaagggaggtaagggaaagtgagagcctgccaggcaaaaggaagaggaagcgccaaggacctatggagggtgggagccagggaaccgaaggaggcagttaccagcactcctgaagcacaggcagctagagaagagagccacaggctggacagtgaccttggcaggggacacaccatgcaaggctagtgagccacgttcagaattttgagatttatcttgaaagccctgggaaatcattagcattttaagcagaatggtaatatggtcaaattagcatttataaaggccctgtgaaggaaggtcagaggtgcagcaagaatggacgcagtgagttggttactgggtgaattcgccaggcaggcaagaaggggtgttgcagagccaggtttctccacagccacatcagtgacatttggcatctcattgatctttgctgtgagggctgtattgtgcacggcagcatgctttgcatccctggctctgcctgctggatgccaatagctccctccccgagtcatgacacacaaaaatatgtccactggacattgccaaatgtccctcgttgggggaaatcacctatagttgagaagcaccaatttaaagtggggacaagggatgtgaagagatatggacagattcacaatgtgtcttggagctggaatcaaaagatattagtgacatatttgaaaagggatggagggcatgaggtcagggctgactgtagcttgaggtgctgggtggataacacggcgaccattgctagaaaatacgaaggaaggcaggatttgaaggaaaagataatgaggtccatcctaagtatttcattggaaagttgacctctccctctccctctccccacggtctccctctccctctctttgcacagtctctctctgatgccgagccgaagctggactgtactgctgccatctcggctcactgcaatctccctgcctgattctcctgcctcagcctgccgagtgcctgcaattgcaggcgcgcgccgccacgcctgactggttttcgtatttttttggtggggttttgctgtgttggccaggctggtctccagctcctaaccgcgagtgatccgccagcctcggcctcccgaggtgccgggattgcagacggagtctggttcactcagtgctcaatggtgcccaggctggagtgcggtggcgtgatctcggctcgctacaacctccacctcccagccgcctgccttggcctcccaaagtgccgggagtgcagcctctgcccggccgccaccccgtctgggaagtgaggagcgtctctgcctggccacccgtcgtctgggacgtgaggagcccctctgcctggctgcccagtctggaaagtgaggagcgtctctgcccggccgccatcccatctaggaagtgaggagcgcgtcttcccggccgccatcccatctaggaagtgaggagcgtctctgcccggccgcccatcgtctgagatgtggggagcacctctgccccgccgccccgtctgggaggtgaggagcgtctctgcccggccgccccgtctgagaagtgaggagaccctctgcccggcaactgccccgtctgagaagtgaggagcccctccacccggcagccgccccgtctgagaagtgaggagcccctccaccggcagccaccccgtctgggaagtgaggagcgtctccgcccagcagccaccccgtccgggagagaggtgggggtcagccccggccaggccagccgccccgtccaggagggaggtggggggggtcagccccccgcccggccagccgccccgtcggggagggaggtgggggggtcagccccccgcccggccagccgccccgtccgggagggaggtgggggggtccaaggtaaggaaggccctagagtctaggaagagactggccagtgcattaaccattgtagtgtaatggatttgatgttactttatgctcacaagttggacacacacacagggacccagatcaaattggaggggaaggtcaaagtcagcttcccaaaggaactgaagcttagactgatttttaaaggctgagttaaaataaactgggtaaaaataaagaaggaaagagaaaagcaaatgtaaaatatctgtgcagcatgaagtagcaaaatatattcagagaatgtaagaagctgaaatgagggcctcaactaagcgtgggaatgcagatggtgacatagcaatgctgaggtaggctccccaggaccgaggccggcttgttgcggggagaggggaggggcactctaggatgatctctggcgtaagcagcaggtaacgcggtgccaggacatggctgagttttacataaacatttgttcaagcaaatatgggatcattcactgaaacggagaattcaaagtgaggtctagatttggtggcaagatacaactgattcgaggttaggaaaggagagttggaggaacaggaggaagcggcctctcatctgcaaaccctgagttcctggaacacttgtttgttagggagggaagtgtggcccagccacaatcctttgaacatcttcctcttccatcctctgggttctgcatttcgtgctgatctttaatacatttcagattttccagatacgtccacacctcaccctggtacactactgactggaatgtcacttccttcaggcaggggcttgacatctccttgtgaaactagctagccaagttccagaaatgggatggagggtctggcccacccctttgtagcacagtcctggagatgacagcagccttcctgggtgcggggcaagcaatctcatctgcctgtctgcagtggagcagtttgagcagctccccagcctggtgccacacaacagcatcatgcccacgaggtcttattccaggtgagcctcacataccatgttgtcaaaggtgcctgctgggccttccaggggtgctgcaatttctctctgtgcccatttagtgcaggtgtcagagcatctgcagctggatctaggtgccagtgctattctgaggctcccgggaacctcttaatgttgtagacactgctcactgtgtttccagggaccaaataaattggtaaaatggcacaagctggccatgtgtgaaatggagagggaacgggtcaattggaaaacttacaaaacttctaagaaggccaggcacggtggctcatgcctgtaatcccagcactatgggaggccgaggcaggcagatcacaaagtcatgagttcaagactagcttgaccaacatggtgaaaccccatctcttccaaaaatacaaaaattagccgggtatggtggtgcgctcctgtaatcccagctattcaggaggctaaggcaggagaagtgcttgaacccaggaggcagaggttgctgtgagccaagatcgcgccattgcactccagcctagatgacagagcatgataccatctcaaaaaaaaaaaaaaaacttctaagaagaggcccagcatggtggctcatgcctgtaatcccagcactttgggagaccaaggagtgcagatcatttgaggtcaggagttcaagaccagcatggccaacatggtgaaaccccgtttctactgaaaacacaaaaattagcccgtcatggtggtgcacacttgtaatcccagctactggggaggctgaagcaggagaatcacttgagcagggaggcagagattgcagtgagcagagatgcactgcactccagcctgggccatggagtaagactctgtctcaattaaaaaaaaataattaataaaaaaatataaaaacttctaagaagaggctgagggtggtggctcacgcctgtaatcccagcactttgggaggccaaggcaggcagatcacgcagtcaggagatcaagaccatcctggctaacacggtgaaaccccatctctactaaaaatacaaaaaaattagccgggcgtggtggtgggcacctgtagtcccagctactcgggaggctgaggcagaagaacggcgtgaacccggaaggcggagcttgcagtgagccgagatcccgccactgcactccagcctggggtcagagcaagactccatctaaaagaaaaaaaaatttctaagaagaaaatgcaacttcctctctgccattacttagcaaaagtgtatcccattcctttcatcagcctgaaagaccgcacagctcacaggctgcctgtcttgtctcttggtcacaatttaattggaaagttgaaaaagctgaaaaattacataagaagtagggtgtcagataaaatacagtccatccagttatgtttaaataccagataagcagcaaataagtttttaatataaatatgttccaaatattgcatgaaacctacttacacaaaaaacttacccattgtttatcagaaattcaactgggtgtccagtatttttatttactaaatcttgtatagaacaaccctcgtatagaacagcctgaaggttgaccttcagcttcctaaaagggatattttaaatgtgtttattcatgtatttaacaggtccttccttgttccatgaggcatttgaagtagttgaataaagttgcgctcaattttggctcatgtattgactcagttgccagtttgggctcatttattctgtatcactgaaggtggtcctcagacagtgatgaagggccctcctcagccagaagcagagccctggcaggaaagcgcaagacagctcctattgtcaggccctgggcaccacgccacctcctcctgagcgtcctcccccggctcaccccacagggtgtcctcagggcatcacctttcctatcacagctggaggggaatttacagcaaacaggatgagggcagggaggtttgtctcaccttgtagcttacccgcttgccccgttcttgaatcctaaggaaaaagccaaaccccttacttatacacacgcctccagctcattcggatccctgatggctgtccagctgctcacaaagagctgtcctttgggagccctgctgtcctgccacatgcatcaaatatagtgtggagactatgtcctgagccaatgccagttcaacctgaagtggcccctgggaccaaataaaaaaggcatcctttttatttattttattttatttattttgagatgtagtctcactctgttgccaggttggagtgcagtgacgcaatctcagcacatggcaatctccgactcctggattcaagcaattctcctaccccagcctcctgagtagctgggattacaggtgcccgccaccacacccagctaatttttgtatttttagtagagatggagtttcaccatgttgtccaggatggtctcgatctcctgacctcgtgatccgcccacctcagcctcccaaagtgctgggattacaggcatgagccactgcgcccagtgagggcatcttttttaaagtgacatcatcacaacagtagggtcagcgatcacaaaggcgctggagaaaccagaaagcagttgagggagcgcggtgctttttgaaatgtgctcaggtgctgagctgagccaaccaccagatgacccttgcctcagcctttcaggcctcagaaactggctggaccccaggtaagaagtgccactgcaactaaaagggaattttttaatatgttttttatatatatgtatattatatatatacttgtgcacattagttttttatattgccacatttgttttctttttctcctgaatagagatatataacagatatcaagatattcctaaataatacagcataaacctcctaagaacaaaaatattcttctacataaccacagtaaaattatcataccaaagaagtttaatatgattatctaattaagtccatattcacattaccctgttgtccaagtaatgtccttcatagcttttttgttgctgtttatccaaaaatctaatcaattgcacttagtttttaatgttcttttagtctcctttaatccagaacagttctacagctttgtgtttgtgttctatgacatcgacatttttcaaaaattgaggccgatttttttgttgaatgtcccccaagttaaattggattgttttctcatgattagatttaggtgcaatatttttgacaatcatactaagtagatgatgctgtgttttcagtgcatcatatcaggaggctcttgatttcaatcagtcccactatatatatatactttaagttctagggtacatgtgcacaacgtgcaggtttgctacacaggtatacatgtgccgtgttggtttgctgcacctatcaactcatcatttatattagatatttctcctaatgctatccctcccccagcccctgacccctcctctgacaggccccggtgtgtgatgttccctgccctgtgcccaagtgatctcattgttcaattcctacctatgagtgagaacatgcggtgtttggtttctgtccttgtgatagttttctgagaatgatggtttccagcttcatccatgtccctgcaaaggacatgaactcatccttttttatggctgcatagtattccatggtgtacatgtgccacattttcttaatccagtctatcattgatggacatttgggttggtgccaagtctttgctattgtgaatagtgcctcaataaacatacgtgtgcatgtgtctttatagtagcatgatttataatcctttgggtatatacccagtaatgggatggctgggtcaatggtaattctagttctagatccttgaggaatcgccacattgtcttccacaatggttgaactagtttacagtcccaccaacagtgtaaaatcattcctatttctccacatcctctccagcacctgttgtttcctgactttttaatgatcgccattctaactggtgtgagatggtatctcattgtggttctgatttgcatttctctgatgaccagtgatgatgagcattttttcatgtgtctgttggctgtatagatcttcttttgagaagtgtttgttcatatcctttgcccactttttgatgggtttttcttgtaaatttgtttgagttctttatagattctggatattagccctttgtcagatgggtagattgtaaaaattttctcccattctgtaggttgcctgttcactctgctggtggcttcttttgctgtgcagaagctctttagtttaattagatcccatttgtctattgtggcttttgttgccattgctttggtgttttagtcatgaagtccttgcccatgcctatgccctgaatggtattgcctaggttttcttctagggtttttatggttttaggtctaacatttaagtctttaatccatcttgaattaatttttgtacaaggtgtaaggaagggatccagtttcagctttctacgtatggccagccagttttcccagcaccatttattaaatagggaatcctttccccatttcttgtttttgtcaggtttgtcaaagatcagacggttgtagatgtgtggtgttatttctgaggcctctgttctgttccattgatctatatctctgttttggtacaagtaccatgctgttttggttactgtagccttgtagtacagtttgaagtcaggtagcatgatgcctccacctttgttctttttgcttaggatggacttggcaatgcaggctcttttttggttccatatgaacttataaagtagttttttccaattctgtgaagaaagtcattggtagcttgatggggatggcactgaatctataaattactttggggagtatggcaattttcacaatattgattcttcctatccatgagcatggaatattcttccatttgtttgtgtcctcttttatttcgttgagcagtggtttgtagttctccttgaagaggtccttcacatcccttgtaagttgtattcctaggtattttattctctttgtagcaattgtgaataggagttcactcatgatttggctctctgtttgtctgtattggtgtataggaatgcttgtgatttttgcacattgattttgtatcctgagactttgctaaagtcgcttatcaccttaaggagattttgggctgagtcaatggggttttctaaatatacaatcatgtcatctgcaaacagggacaatttgacttcctcatttcctatttgaataccctttatttctttctcttgcctgattgccctggccagaacttccaacactatgttgaataggagtggtaagagagggcatccttgtcttgtgctggtttttaaagggaatgcttccagtttttgcccattccgtatgatattggctgtgggtttgtcataaatagctcttattattttgagatatgttccatcaatacctagtttattgagagtttttagcatgaagcactgttgaattttatcgaaggccttttctgcatctattgagataatcatgtggtttttgtcattggttctgtttatgtgatggattacgtttattgatttgcatatgttgaaccagccttgcatcccagggatgaagctgacacttgattatggtggataaactttttgatgtgctgctggattcagtttgctagtattttgttgaggatttttgcatcaatgttcatcagggatattggtctaaaattctctttttttattctgtctctgccaggctttggtatcaggatgatgttggcctcataaaatgagttagggaggattccctctttttttattgattggaatagtttcagaaggaatggtactagctcctctttgtacctctggtagaattcggctgtgaatctgtctggtcttggactttttttggttggtaggctattaattattgcctcaattttagagcctgttattagtctattcagaggttcaacttcttcctggtttagtcttgggaaggtatatgtgtccaggaatttatccatttcttctagatttttagtttatttgtatagaggtgtttatagtattctctgatggtagttcgtatttctgtgggattggtggtgatatcccctaaaagggaagcttttctcaactacatttggtcttgctgggaggagagagaggcagggatgtgaaaagcagacatgggcaggatcatcagagctgcccctgaagagtccgtcccaaaagctggcatccagaccctagccaggcaccctccataggacgtcctcttcagtcactccctagaaaagtctgaataggggccgagcgtggtggctcatgcctgtaatcccagcactttggaaggccgaggcaggcggatcacctgaagtcgggagatcgagactagcctgacaaacatggagaaaccccgtctctactaaaattacaaaattagccaggcatggtggcacatgcctgtaatcccagctacttgggaagctgaggcaggagaatcacttgaacccgggaggcagaggttgcaatgagccaagagtgcaccattgcactccagcctaggcaacaagagtgaaactctgtctcaaaaaaaaaaaaaaaagagagaaagaaagaaagaaaagtctgaataggcatggaaattacctgctgccctgctgcagatggctcagggctcttacaggccattatcacataaataaagcacatgactcgaagcagcaatgcatgataagtgggttaactattatccctctttttataatatagaaacagaggtaccaaggatactgaagatcaagccaaagaatagtagtaagatccctaacagtggccaggcgtggtggctcatgcctgtaataccagcattttgggaggccaaggcaggcagatcacttgatgtcaggagtttgagaccagcctggctaacatggtgaaaccccatctctactaaaaatacaaaaactagctaggggtggtggcccacacctgtagtcccagctactcaggaggctgaggcaggagaatcatgtgaactttggaggtggagattgcagcgagccacaattccgccactgcactccagcctgggtgacacacagcaaggctccgtctcaaaaaaaagatccctatcaaatgctttccatttcccatttcaaataaggattattaaaaagcttaaacatgctgggtgcagtggctcacacctgtaatcccagcactttgggaggccaagacgggtggatcacctgaggtgaggagtttgggactagcctggccaacatggtgaaacgtcatctctactaaaaatacaaaaattacctgggtttggtggtgggcacctgtaatcccagctactcgcgaggctgaggcaggaggcagaggttgcagtgagttgagatcatgccactgcactccagcctgggtgacagagtgagactccatctcaaaaaaaaaaaaaaaaaaagcttaaacacaaatagagaaaagagtatagtgagccctcacgcacccatcactgaactacaattagcaacccatagccaagcttatttcatcactcattctaccctcttccatactgtcttaaagcaaatcccaaccattatgtcacttcatccagaaacggtttagtatgaactctgaaagattaagggcacttttgacaaaaaaaataaaatacctaggaatacagctaacaagggaagtgaaggatctcttcaaggagaactacaaaccactgctcaaagaaatcagagaggacacaaacaaatggaaaaacattccatgttcatggataggaagaatcaatatggtgaaaatggccatactgcccaaagcaatttatagattcaatgctatccccattaaactaccattgacattcttcacagaattagaagaaaactattttaaaatccatatggacctaaaaaaaaagagcctgaatagtgaagacaatcctaagcaaaaagaacaaagctggaggcatcacactacctgacttcaaactacactacaagtctccagtaaccaaaacagcatggtactggtacaagaacagacacatagaccaatggaacagaatagagaacccagaaataagaccacatacctacaaccagctgatcttcaacaaacctgacaaaaacaagcaatggggaaaggattccctattcagtaagtggtgctggcagaattggctagccatatgcagaaaattgaaactggatcccttccttacactatatacaaaaattaactcaagatggattaaagacttacgtgcaaaacccaagactataaaaatcctagaagaaaatctaggcaataccatttgggacataggcacaggcaaagatttcatgacaaaaatgccaaatgcaattaaatgaaagcaaaaattgacaaatgggatctaattaaactaaagagcttctgcacagcaaaagaaactatcatcagagtgaacagacaacctacagagtgggagaaaatttttgcaatctatccatctgacaaaggtctaatattcagagtctacaaggaacttaaacaaacgtataagaaaaaaacaaacagctccattacaaagtgggcaaaggacatgaacagacacttcttaaaagaagatattcatgcggccaacaaacataaaaaaaagctcaacatcactgataattcaagaaatgaaaatcaaaaccacaacgagataccatctcacaccagccaaaatggctattattaaaaagccaaaaaaaaaaaaaaaaacacagatactgacaaggttgtagagaaaaagggatgcttttacactcttggtggcatgtaaattatttcaacctatgtggaagacagtgtggtgattcctcaaagacctagagacagaaataccatttgacccaataatcccattactgggtatatacccaaagaaatataaatcattttactataaagacatatgtatgtttattgcagcactattcacaatagcaaagacatggaatcaacccaaatacccatcaatgatagactggattaaaaaaaatgtggtacatatataccatggaatactatgcagccattaaaaggaatgagatcatgtcctttgcagggatatgactggagctggaggccattatcctcagccaactaatgcaggaacagaaaatcaaataccccatgttcttacttataagtgggagctgaatgatgagaacacatggatacatggaggggaaaaacacacactgaagcctgttggagagtggggggtgggaggagggagagcatcaggaagaatagctaatggatgccaggcttaatacctaggcgatgggatgatctgtgcagcaaaccaccatggcacatgtttacctatgtatgaacttgcacatcctacacatgtacctctgaacttacaataaataagtaaataaatttttaaagcattaaaaaataaaataaaataaaaagataagggcacttttttacaatgtagtcatgttaccaatatcacaccttagaaagaattaatttcctcagtagcatcaaatatccaatcagtatttaggtgaccaattatctataaatgtcataaatatttttaaatttgtttgaattagggtccaaataaggttcacatgttcagattggttaatatgtctattaaatctataaggttccccttcatattgtttttctttgacatttacttattgaagaaaccaagtctttcatggtgtcatgttcaccttagtatggatttatctgattgaatcactgaggtgtcatttaacatatttctctgtcttctgttattttctgcaaattggtaattgaagacttgatccacctttttgcaaacttcttcataggtgttgctgtgtacttccaggaggaacatataatgtaggactctctctttctctttctctctctctctctctctctctctctatatatatatatatatatgaagttatctaccattaatatccaaagcctagctatcttaattcattactggcattactggtcatgaaaaggtaacattctaatccagtctttcctttttctttctctgtcgcccaggctggcgtgcagtggcatgatctcagttcactacaaactccgcttcccaggttcaggcgattctcccacctcagcctcccaagtagctgggattacaggtacatgtgccaccacacccagctaatttttgtatttttagtagggacagggttttaccatgttgtccaggctggtctcgaactcctgacctcaggtgacccacctacctcagcctcccaaagtgttgggatcataggagtgagccaccgtgcctggcctcatttttcatctattagctgacatacatccacaaaaagaaaatgttctcttttgctgtctgggttgcccattgctgtagtacacagaacgaagttaagttaaaggtttgattctttcatttatgtaccactttttaacgtgccacttttcaaaaaaacgagttgattcactagcattctccaatagtaattaagttttttgtttgtttgtttttgttttttgagacagcatcttgcgatctcggctcactgcaacctctgcctcctgggttcaagcaattctcctgcctcagcctcccgagtagctgggattacaggcatccgccacgatgctcagcattttttttctttttttttttttgtatttttagtagagatggggtttcaccatgttggccagcctgctatccaacttctgacctcaggtgatccgcctgcctcggcctcccaaagtgctgggattacaggggtgagccaccgcacccagccagtttctttttcaatgttgtcaagaccatcaatttaaacatatttaatagatgaaggagacataaaattagaaagatatagaatacttaaaacttaattaacattttctcctgtttcttgggacagaggaaaaaaacataattaacaagcttgcatcaataattgaagaaaatacatttttaattgaaaaataattcacataccataaaattcatgcttttaaaaatgttttttatgtattcagaaagttgtgctatccaattccagaacattttgcaactcccaaaagaaacccatacccattagcagtcattctctgttcccttctcaccccacccgcaccctgcccctggcaatcaccgatctattaatactttctgtttctatggatttgcctaaaaaatacattctttttaagtacatttgtaacatctgagaaaatgtaaactaagtctgtttctttaaatgtaaaggaaataaaagccagaaagcaaattccaacaacattcaaaggattgatattatatcattcacattatttgacaaaaatacaaataaatctaaaacaaataacaaataaaattatgccacaaaataataaaataataccacattggaagatgaacaatacatttatttgactcacggattagagaccatggatcataatgccgatatctatactatgtaagatattccctcctttgtagtacctatttaaacctaaattttaaaatattaaatggcaacctgaaggtattcaagagcattttaaaatcctgttgtggagtgtgaaaggaagagaggaagaaaggaagcagggccactggtctaaagagtccttgagaaggctgctggggctggccatgctcaaggagatggtgctcacctgcggccaggtgggcagcagggagaggtgacacgtggcagagctggagtttcagaacaatggccatgctgtgagtcctggcactgtccattagggcgaaaagcttttctgctgggagtgagaggcctcatgactcggtgctaggagccccctcggtcatgagaacacgggtgcatccccaaaacctcctttgcatcagatccctgcagcagtgaagcacattcccactgctccttccatttacgtccaccaattgatggtcactccgccagctgaatgatggataagaatccctctcaaatgttaaaggacttctagtcatccaaatttctgatttcacataaacttgttaagatcacacaaaacctgcatttcaagtcgccccagcattttcaccctgtagtacctttggcaacatcactgcaatgctttctgtcagccaatgtggatcaaaactgccagcagaacatactattttctgccatgattggcagaaagcaggagcacagttatggagtaaacagattggccggcacttggcaagctgaggaaaccacacgtacttggccctctctggcccctgggacacatccaactctgctatattagtgactgtgatactgtactctccagaattccaaagtatgagctatttctgagggaaacgggtcaagctgactcagcctgtgtacagttgctgaacagagctccagtcaagtgatgctgcagggaaatgcagcaggagcatcctggcctggtgttttgctaaggccggtggtcttgccagagtaggaggtacatacagggcactactggggggcagtggcaggaattcagcacccacagcaggatgcagactctggctccccacagtattggcagcaaattccagagacccatgatcagtaggcatctaaggacgctaaggcactctttgagcaataagaatagtttgtgggtcctatacccacaaacccagatccctctcctctcactttaccaggaaacaaagtgaaaggagggtggcctgggcttccaatattgattggttttgttgctaagaaaagcaattcattcctctttccgttattgtcttttcttagactggtggccaagaaacaatagtcacgtatgaaactccaagttgtttgaaaatttaatgtgaaacagtagttagtgagttttccttcatgccaaactgtcctgctaaaacaaacgtcaggtggctgtcacctcagccaagatgtaaggactcacagacggccagccatgaagccattggccaagggcccacaggacatctgttctgggtctgccaccgagtgtgagccaagaaagtcagatctgagaataaaatatttccaaatattattttcctctggacctgatttacaaagcataacacaagctggggaagagggagtttttccagataaacaacctggcatagggggaggtcatgttattttaaacatggagctcatacaggagagtttctggtccccaagatcagggagcattcgctgtgatggtaattttcattattttatgctaactctgaaatacgtagcattccaacatcagtctaaaaaaaggcgctcactagaggaaagtgagccagcaagcacctgtcctccacgaacagaggcccttgacatttggctccgccacagttagagggaaggactcctccaagaagtcagctcctgctgttgccttctcttccatttctactctcccacgatttctccccaggagaacatacacacaggcattgacaagcagagctattatgtgacattgtatgcagacctcatggtaaaattattggcacagcttgtataaattacagatgcacattttcttaatcaacccaggctctatacattaattgcatagatcttccaattcaggctcacctacttttttcttgaataaggtagcagttgttttttaaaatataataataatacatgctgactatcaaaagcttaagaaataaaaaattcaaattgacaacaatccttccactagtgaaacctactgtattataacactgagtataatacatatgtacataaatatacacacgcacacatgcacactgaaatcttggcattcatggggtaaacatttgcaatttcagctcttcctcggtaactccagtttgcacccctgcaaggcacaaatctcaatctggtgtgtgggagaatattgctaagctaatgagcaatcctgcagaagttcctaccatgatgcctagatctctggatgtcatagataatgcacaagcggatttgaatccaatccatgtcaatagatttatttgaaaatcctaccgatagtgacagagacctgttcatgctcagcatgtagaggaagtgggtggagttaataaacaggctatccatagatgtgagtggaaacaaagggaaatacatatggaacacacaacgagtagaaaggaaaaccagggaggcagaccagggcaatgctctctcccctgcctgagggatttcctcgcctctacttgctgctttctgtgccttccaccacagttatctctgcttcttccacttccgaatgcctaaaaatggccatttcagcacccaagaataaatgaatcttagtccaatttccccaagaaactgagtttctgtctgaatttcaacatcactgggatataatcagattggcatgcctcatcgttgattgccaggccaaggactgctagccaggctttggaaggatggtcctggaggccaatatataccctgacctcatcagctggtcctgtggctctcgaagaatagccttcctcagacaggacacggactggttggtatacagagcctcagactgctcaaatctggcactttgtctttaatgtgacagggcaaccttctttctttgccactataaaacagatgcaactttatttctagtattttctacccaagttttccacttagtgttaacactcttaacacattttgtaaaaatttaaatacattttaacacattttcttaacacatacttaaccaacctccttgctacactctttgcccacgttagagttcaattcagtacaacatagctcatcttttcctccatactctgtacctatttgtgtactaatggtggcccattctaaaatctttaccactgggtgatacagtttggatagttgtcccttccaaatctcatattgaaatatgatccccaatgttggaggtggggcctggtgggaggtgtttgggccatgagggcagatctctcatgaatggcttagtatcctccctccctatgatagcaagtgagtttgggctctgttagttcacatgagagctgttgtttaaaggatcctgtcacctcttcctctctctcttgctccctcctcaccatgtgacatacttactccccatttgccttctcccatgactggaagctacctgaggcctcaccagaagcagatgctggtgccatgcttcttctttctttgttgttgctgtttttgtttttgtgtttgtttttgatacagagtctcactctgtcacctaggctagggtgcagtagcctgatctcagctcactgcaacctctccctgccaggtttaagtaattctcatgtctcagcctcccaagtagctggaatcacaggcacacactaccatgcccagctatttttgtattttttgcagagactgggtttcacctacgttgaccaggcaggtctgaaactctttacctcaagtaatccacctgcctcggcctcccaaagtgctgagactacaggcatgagccactgtgcctggccttccatgcttcttgtacaacctgcagaaccatgagccaaataaacatggcttataaattagccagcctcaggtgttcctttatggcaacacaaaatgggctaatacaccgggtgagcccagtatctctgtatgcgctgctcttggctttattcacatttctaatggtagaaacggtaggatggcacggagttcagaaaagtaaggttttatgttaacctctgtatagatacagcacattttgataccactattttccagcctgatggatttttgactctgtgattatgaacacaaacatcttattgaaaattatataactattgataaattttacttcagaaaacatttaccaaagcaaaatccattgatctattttcattgataatttatgtaacacataaagtgtttccatctctttgttttcatttttatttcatggaaaatattttatttggaatggattattgtgaatagtacatttgtttttcttctgtacatcatattgaatctgcttcagtgcctcatgcagccaaaatggaagtaccaattgagggctgtatgagtcagggtcctgagaggacacacattgcccactcagccgagatattttcctttttagcttaagagattgctgttttggcttttattatatattattcaaaaaacaaactaaagttacacatcattacttgaattttagtagtttctgacctttgacacttaaaagtggttgtcttagttcatttgggtggctataacagaacacacagactgggtaatctataataaacaggtatgtatttggtttacagttctggaggtcgggaagtccaagagcatgctgctggcatttgtcaaaggccttcctgctgtgtcatcccgtggtggaaggcagaagggccagagagggtgatggcaagctcaattcacatccatcacaagcccactctggcaacagtgaatccactccctcaataataacattaatcctttcatgaaggcaggtccctcatggcctaatcacctctaaatggtcccacctctcaatactgttttatggaattgtgtccaacacttgaattttgggggacacattcaaactatagcgatcatgaaaaatcttttttattatctcaaatgtcaccaaaatctctaggcttttcctttatagtcaataaaagtgtaattaaatacatgaaaaaatctccagttttgttatttcaaactccatttaaatttgactgttggctcaaaattcagtgagctacccttttatcaaatcactgtccttagagaatccatggttaaattaatacatccagtatttgttgtcattgatagtaatggtaaaattttgtttgtgggaattttggctaaattaagattcctacataaagaggcattcagaggtccaaacatcattccactgcaattaagctagtttctcattccttcctttcctgaaataacattttttttcctagagaagcagttaataaaatttcttttcaatatgcttcatagaaatcagaatgttttccaataaaaacagcttctcgctgtttttcactctggtcatcttagctctgcatagatacattgagtttattttaggtgtctaaatgaatgtgctgcatgctgtagagaaggaataaatgccctatttttgaagacataatttccatttttgcttagttgagaggcagcattgctgcatggagaagctccattgcttctctataagaaagaaagattgcttgcttggtaccaatttctaaagagaaagcacaaaggatcattggtttagagcaagtcctgtgatatgacagctcccacagtttcccagaatatcctttagttttaaagcaggcaaaggcaggtagacaacagccaagcatacaaagaacaatcatgctttgaagattttttccttaatggccgagtttctttctagcatagaagtggtgccatcaatgcaagctgatccacttgtgagtgatgtgatcatgccctttagaagtctcttcagatggaaccaagtgctttcactcggggtttacgccagtgattcagtcatgtgggatttttgaagacacttttaaatgaagggaatgattgattacacagactgggcagagttaagggacacagagggtatactgaggtaccgtgggaagctttatcctcccaggcaatggtgttaccagagcctgggtgaaagctagagttctagaagaatctacgcatagagggtgcattccctgccagaaccatgccaaagcagggagaaagaaagaaaaatacatacccaacttccctcccctcccactctctgaccccctatcagtcagtgcttccccttgaccaaccctttgggaaatccaagggcatgagagcaggagggcaatgtccgcaggaggcggcatcccaaagcacagagcagaaaaacagagggtggagagtggactgagaggttgggtggggaagaacagagtatcaccagcacaggtagcatcccctctactcagatagcacagatgacccagatcattccagaagagtccattggtttacagtctgctcctgtcactctggctctgagaaggtgggcgtttcctctgctttctcccgtgctatggagtttttgctcaggtggggcaccttgacaactctcccacatccattctccccacgcgcaccctgtgaatgctcccctctgagctcctgcccactgttcagggaaagaaaaggcttggaagactggccctgctatttaagggtctacaaataaaataaaactaatccttccagttagttgggggataaacttttttaaaacctgatcatgaaaaagtttatttcccacctgctgttgtttgaatgtatcccccaaaaatttctgttttgaaacttaattgccattgtaacacgattaagaggtaaggcctttaagagatgactaggccatgaaatctccactctcatgaatggactaatgctgttatcacaggagtgggctcctgacaaaaggataagtttggcccccgttttctctctctctcacagtgggatgcccttataccatggcatgactcttgccagatgctggtgccattctcttggacttctcagcctccagaaacgagagccaaatacactcctgttctttataaattatgtagtttgtagtattctcttacatcaacagaaaactgaagacacattttaaaagaaactgagtctttgtggaaaactctagaaattcagagttcaccttttgttgccaatttctacaaagtcaagacttacagaaaaatcacaattcttccttcagttctggaaaatctctttttttttcttcccccctccctcagtttcagaaaatctctaacaaaaattttttatgtgcaattttaatatttgccagtatctggtgttgattttttctgctggtgacatttgtaatttggatttaagactaatacttcatatttatttatttattcaataatctatgagaaattgttcatggttttgcccaagaattccagaactgcaatattactaattattcgtctatttttttgctagtttaattcttacatattcttctcttctaaaagaacatattataacatatggcaacgttctaattatctatccaaaaagcccaaggaggcacaatgcttactttttgcttttgcttcaccaagtcttttgttccttcatcaaatgtttagcttttaccattgttgtgcagctattatctgcttttataaaaatgaatatagatgtatatcctgacttttatttgtaaacatgtcatcgtaagcattttcccaagctgggctgtagtctgccgaaatgtgactttagtcattgtgtcatattccttctaatgcaaacacttcataagaatttcccaatttttgggccaggcacagtggctcatgcctgtaatcccaatactttgggaggccaaggtgggcagatcacctgaagtcaggagttcaagaccggcctagccaacatggtgaaaccccatctctactaaaaatacaaaaatgagctgggtgtggtggtggacgcctgtaatcccagcaacttgggaggctgaggcaggagaatcgcttgaacctgagaggcagaggttgcagtgagccaagatggcaccattgcactccagcctgggcaacaaaagtgaaactcagtctcaaaaaaaaaaagtaattcccaatttttggactctaagttatatttatttttcatgttactactaaaacttggaaaacatttgtaactctttgcgtgtctaatttttcctctacaagtcttcctataagtacaatcagtagatcaaataacatgaaattttaaaggctcttgagccgggcatggtggcttacatctgtaatcccagcactttgcggggctgaggcaggcggatcacctgaggtcaggagtcggagatcagcctgcccagcatggcgaaactccgtctctgctaaaaatacaaaaaattagctgggcgtggtggcaggcgcctgtaatcccagctactcaggaggctgagacaggagaatcgcttgatctgggaggcggaggttgcagtgagcagagattgcagtgagtcgagattgcaccagtgcactccagcctgggcaaaaagagtgaaactctgtctcaaaaaaaaggttcttgaatcgtttttacagaagattttcctcaagatataattacgcttctgctcaaacacagaaataaagggagaaaaaatacccaaagttctactataagatttgtagcttgaaaaatgtttaggccgggcgcggtggctcaaacctgtaatcccagcactttgggagactgaggcaggcggatcacaaggtcaggagatcgacaccatcctggctaacacggtgaaaccccatctctactaaaaatacaaaaaattagccaggcgtggtggtgggcgcctgtagtcccaggtactcgggaggctgaggcaggagaatggcatgaacccgggaggcggagcttgccgtgagccgagatggagccactgcactccagcctggacgacaaagcgagactctgcctcaaaaaaaaaaaaaaggaaaagaaaaatgtttaaagctgatgtacaaaactgtcacttaaaccattaaaaaatttgtgtaaacatcacattgaacaacacaattttttttttttactttttagattgacactttgaactgcatgtatttcttgtgtacaacatgatgttttgaagtatatatacattgtggaataactaaatctagctaattgacatataaaaaaataagggaatcctgtcatccaagacaacatagatgaacatggaggacattatattaagtgaaataagcctggcacagaaagacaaacactgcatggtctcattcatacgtagaatctaaaaagttgaactcacagaagtgaaaaatagaatgatggataccaggggttgagttgttgagggggatgggcggttgagggagatggtctggaaagatgtcagtccaaggatgtaaggcttcagttagacaggaggaaaaatttcaagagatttacagtcattcattaaaccagtttcaatgtatgaacatgattagatccaggatttttttttaaaaaaaagctttaaatgatatatttgagacaattggggaacttgaatacggtgttgttatacagaacataattcttaagacaagcatgtgaagtaacatgacttacacattgttagcagtttttaacatataatatagacacatatatgcatataaacaaacacactttgaaataaaaataaatcttgggacccccaaatcactaagctaaagggaaaagtcaaaatgggaactggttagggcaaatctgcctcttattctattcaaagtcacccctcagcatactgagataaatgcatatctgcttcctttggaaaggctattcagaaactcgaaagaatgcaaccattagtctcttatctacttatgttctggaagccccaacccagcttcaagttgtccgacctttccagaccgaaccaatatcttacatatattgactgaagtctcatgtcaccttgaaacatgtaaaaccaagctatggcctgaccaccttcggcatatgctgtcagacctcctgaggctgtgtcacaggcatgtccttaaccttggcaaaataaactttataaattaactgagacctatctcagatattttgggttaacaatacatacaaatatacatactttctgctagtgaaaaggtggcaaaatattaacagcaggtgaaattaggtaacttatttagatgtccgatgctagttagagaacatttatgttttgagcactactgggaaatataactagtcctacagcagcgggggcagaatgttcagtcagcagtgtctcacataaacatgaagacttgatgtcctcaacttcaatcacagcctgtcacacagcaggctcgtgtccatgcgactagcttcctatgaggactctggactgcaggattcaagtgggtgtgcctggtggacacaggtgtctgtggtttgcctctggagagcaagcagcagagggaggatttagaagcctgtgccggccttccctagccttcctgcactggaagctgtgctgcaacccattttaaccaacaatataactttctcttgggtcagattcatctgaccttcagcaaggcatccagctagggatgggaccccaaaacaaaagggcctatgggagccttctcgggttctggtgtaacggcaaagacaaatgtaaaaaaaggaaacttgaattttctccagtacaagaagcaaaagagactccccatttctttctttagaggatttacttaattttttaatttttttacttcaatagcttttggggtataagtggtttttggttatgtgaacccagaaaatctgagacaagtctcagttaatttagaaagtttattttgccaaggttgaggacacgcatgtgacacagcctcaggaagacctgatgacatgtgcccaagctggttggggcacagcttagttttgtacattttagggagatatgagacatcaatcagtacatgtaagaagtacactggttcggtctagaaaggcgggacatcttgaagcaaaggcaggaagactggaagcagggagggagcttccaggtcacagataggtgatgcacaaacattcttttgagtttctgattagcctttccaaagggggaaatcagatatgcatctgtctcagtgagcagaggggtgactttgagtagaacgggaggcaggtttgccctaagtcgttttcagcttgagttttccttagtgattttgggggaccaagatattttcctttcagttacataaatgaattctatagtggtgaaatctgagattttagtgtaaagggcaaccaagttgtattcactgtacccaatatgtagtgtttgatgcctcatcccccaccttcctcattgagtctccaaagtccattatatcactgtattcctttgtgtcctcatagcttagcttccacttggaagtgggaacatatggtatttggttttccattcctgagttacttctctcagaataatggcctccagcttagaggatttattttagaaaatgcctcatcataagttctttctctctccttttcagatagatttatgcaaatctttctaaaagctaaataagcttcttgccagtttcacaatccagggatgcttttctcaagtacctgggagctatctctttgcaatgtaaacatcaaggaagagaactccctatccccagattccaggggagggtaagagtccaacttctgcaggcacctggctcgacattttattttcttttggataaaggcaattagcaagcacaagtgaccactccaattaccaggtgaatatgaaacaggagagtttcctgacccccctcgcaagacctgcagcaggggtgtggctcatctgttaggctaccacaccctcaaatcccttttaggagggggagcccacagacaggcaggtgcaagagccagggagagtgcttttgggctccagccccacggtagtgtctaggggtgggtgcctgcaactcccgaagttccaatgggcatgtgacagtgctactttagctctgccattcacagatggcttacatgttaaccagctcagtgccctcatggtacccaggtccttgtccggcatccaggaagagtcaggtcacatggacaaattgaaggatgctaaatgaggaggattttgttgccagatggaggtgtctctcagtaggatgaatggggaactggaaaggggatgaggtgggaagctgatcttcccctggagttcatccatcctgcaactgatctctccaaccgtcaccagctgaactcctctcaactttcagacgccccttctctgcaactctaccactcttctgttcccctgctcttctgcttatggagcctggtgttttgggtttatatggatacaggataggagggtgtggtaggccaaaaggcaatatttgggcatgaaaacaggaatgcctgttcccatttagggctttgagtttccaggtttgaggatggggcccttgctggggaacctccctcttctacccagcatttccctgcctcctgtccatatcaaatgtagtatgaactatatgtgacaaacggtgctgccaagttctcttacttaaggactagttatttttcttgagaacaagtatgcaatgagttgtatctgccaggttatatacgtggctttttttttctatctttgcaatctctttcatggattgcctgtgatatgtgtcacatgagcttagtgtgtattcagtgataaaactgttttctttctcttctaaacttgtggagaggctttctgggttagcaggagaatttgttttcaattccatttcctcagtactggaaatgtctgtatcttaagctaggcggtggttacgagtatgaacgtatgtaaaacttctttaacctttgtgtatatcactctagataaattctatgtcaatgtaaaaagaaagaaagaaaaaagacaagaaaatgccaattcagccactgccttttgccttcccacagctgaagaagggacacagggtgtgctgctcagaagtctctcatttccaactctgaccaccagcacctgaaaacatggtggcctccacctcactgtctccacccagagcgtgtgccactgtaccgcttcctacacagcaaggggtctgaagggatgtaatctgagcttggcaactatatccaatataaagaggatgcaatgaaggttgagagaacaaatccagctatcttctgtgataattgtgcatgcctcgggccaagtcacgttgttaggcagattgctgagttgggtgagtacttgcagcaaaatatcaaactagcgggtggtgataggatatcacccactcattagagagaaggaactgccttggcatgaagaaaaaattacaaatgatcaaaaaataagagaaaaaaagtttcaccttttcagggtaagaatatggataaagacaggtagaatgggtatttattgtcttcaattacaagcaaactaccagggatcaaggaaatataaagatagtttcttcctccacttacaaaactatcagtggggcccaaccagacaaaactatacaaactggccgggcgcggtgactcacacctgtaatcttagcactttgggaggccaaggcgggtggatcatcttaagtcatgagttcgagaccagcctggctaatgaggcaaaaccccgtctctactaaaaatacaaaaattagctgggcgtggtggtgcgcgcctgtagtcccagctactcaggaggctgaggcaggagaatcacttgaacccaggaggtggaggttgcagtgagcctagatcgcaccactgcactccagcctgggcaaaagagagagactccgactcaaaaaaaaaaaaaaaaaaaaagtatacaagcttagaaaatacagttagagccaacctgccaggcatccttgcatacttcagaccagggatgcttgtctgcatgctttgtttgggtccatctctagagtattcttctgtctgcagagattggtgtaggcaccttgggatgacaaatcattgagcggggcttttccatgtgtcccagagttagtgacaaagtccaaagccgtggacggaaagacactcagtacccccactacaattagagaaagatagcagccccaaagccttggattgaagaaagaggctcaaccacacccctccacctgcatcaccagaaggagtagaatgaggaagggtgggggtggggggtcactgagttatcctgtggttttgcccagtttggtagtaagagacttctcttttctccttctatgaaaaagaaagaggtgcttctctcacccactaactcaaagccaagagaggagagggcagctagaggaatcatttatggagactgtaggtgcctggaagaaggactggcctctctctacctggatgatcctttctgcaagcgggaagttcactagaggaacccaggccagcatgatgagaagggcccgctgtggggtgtgcccaagagcaggagggatttgcttcttcatctgtcccaggtcttggaagctctgagggcataagccaccgcagtgtgaagagcagatgctggaggaaggcacagggccagacagggcaagccccacactgaagagatgttgtagatgtggattgctgtgtgcctaaagggagacacagcagcccctttctgaggggattctctgtgataaagggtaggtcagggggaagctgaacactgtccctcccaccaaaacacatacgccatctacatatacacagcataacagagaagccaccaaccagcaccaaactgaaacaatccaagcaagagtaggcccagaaggggagggcagagggtaataaaggaacagatggtagccctgttcctactacagcgattgcatcaaatatgactgcagcagatttccttcaggcttttctttttaaataaatttttgttgaagggaaacacatacagaaagtgcataaatggtaagatcacagtccaacgaaccatcacaaagtgagcacagccctgcacataaatgactgaatgttaccaaagccccagacacccctcatgcccctcccagtcactgctcctctctagaaggtgaccactatcctgacttctaataacaaagatgagtttggactacttcgaaccttgcatgactggaatcatatggtaggttctcttttgactctcccttctttcattcaatgtgactgttttcagattcatctgtgctgtgtgtagagtacttcatttatttttagttgttttttatttttattttttaattttaattttttttttttttgagatggagtctcgctctgtcacccaggctgcagtgcagtggtacgatctcagatcactgcaacctctgcctcccgggttcaagcgattctcctgcctcagcctcccaagtagctgggactacaggcgtgcaccaccacacctggctaattttttgtatttttagtagagatggggtttcaccatgttagccaggatggtctcaatctcctgacctgctgatccacccacctctgcctcccgaagggctggggatacagccgtgagccaccatgcctggcctatttattatttacacaccattgcatggtgtatgctttctattatctgctataacatattactacaaccttagctgcttaaaacaatggagatttattttctcacagttctggaggccagaaatgcttagtcagtatcactgggccctaaccagggtcccagcagggccacagttgtccagaggctttaagagagagtcctcacctccaggagcttctgggagctgccagcagcccttgtcttgtggccactcaacctctgcttccttggccacattgccacctcctcttctgtattaaatctccttccggctccctcttataaggacacgtgattgcatttagggcattcagggcccctctggtcgtctccttctctcaggatctttggctcaatcgcagctgtaaagaccctatgactgagatttagagtgaaagtttaacaggccaaagaaaaaaagctctccctgctgcagagagagaggtcctggagaaatgtgttgccacttccatggtgaaatgcagattttatagatgagcttgagaaggcgtgtttaatttacatagggcatgaaagattggttgaaccaggtgtgccatttgcatagtccgtgaagaagttggctgccccaccccaatattttattatgcacataggttttttaacatggctggtgccatgttgcctggtttttgttttgtttttttgagacacagtttcgctcttgttgcccacgatgaagtgcaatggcacgatctaggctcatcgcaacctccgcctcccgggttcaagcaattctcctgcctcagcctcctgagtagctgggattacaggcaagtgccaccacgcccggctaattttgtatttttagtagagacgggctttctccatgttggtcaggctggtcttaaactcccaacctcaggtgatccacctgcctcgacctcccaaagtgctgggattacaggcatgagccacggcgcctggccgttgcctagtttttgtggtaacaaacaaaaaaaaggcggggggggggggaatggagcctccatgttgaacacacccagcccccaagtctattggcaagctgctagcctttatccatgcaagctttctgcttccctatcttagtgtgcccaaaatagggaaaggaatatgctcattaaggtccactgtttttactgggactcattgtatttatgtggagtttggtgattattcaggaagctccccctctgttgtcgaagtgcttatttatgttttatagcccaatcttccagactgctctttgttagaaaaaaagtaatttctttaaactgtgtgtggttaaaaagaaagtaatttctttttttttttttttttttttttttttgagacggagtctggctctgtcgcccaggctggagtgcagtggcgcaatcttggctcactgcaagctccgcctcccgggttcacgccattctcctgcctcagcctcccgagtaactgggactacaggcgcccgccaccacgccccgctaagttttttttaattttagtagagacggggtttcatcgtgttagccaggatggtcttgatctcctcacctcgtgatccgcccgcctcggcatcccaaagtgctgggattacaggcgtgagccactgcgcccagccaaagaaagtaatttctgagctgctttttgttaaaaggaaagtttttgccggggactcttgcaccctatcaacctaaataatttctatcttctgtataggagtccaggggtcagggcagaggcgcaggtggtgcgacgccacggagttggtccccatggccgtgagccagccccagcggcacagccgccctgtccccagcggcatctaggtgatggccaactccaggccgctctccagctgcttggcctggcacctcagctctgccagctcccggaagcaacaggccaccaagcggccccgggctcccgtggcagtgagccctctactctgctctcaaaaactgatgccgccaaggagcccgccatggccagccctgctcaaagccagggccagccccgggagccaagccgccaggcagccttcctccagggagggtctggaggctgagggggggcggcctgcgggtgaccaaggagatagccatgcagcgccacgtgggggacctccggctgctggggagtccccggccacacccagttccccaggcctggcctggcaggatggtagctgcctctaagaggggaaacccgagtaagaaaagcgggaccccagccgcaaagatggtgcccaggaggaggacaagaccaaggacaagggctgagggcagcccggggagatgcccggtgtggacaagaagggcctgcaggccagcagcccctgccgcaaggcagagcgggggaagcgaccagtaagaagccattttcggccaccgaagtccatttgctgccccaaccctcccagacaggaagcacacgaaggcccctgcagggaagctggtggagtggaaggcctgctcgctagacccctcccaggacgccccaagctgaagaagcgggtcttgagccaccctgatctcttcggagaccagagtgaggacgaggccccggaatctgtggcgccgaggatgtgggcccctgccctcccagcctcagctgggacttagactcggtctccagcctgggcttcggggaggctcagaaatcgcccaagcggctcaaggactccccgccccactccccggcccatcctactcctcctccttctcctccagcgcgggcaggatgtggactactcagccctagaaaaagaggtggacttcactccgaccccctggaggcgtgcctgtggatcttcgacgagtccactagcgtcaacacggaggacaaaggtcgactggccttcagccccccaaggaagagaccttcgggtctgaccactctgttcagaagaggatgatatctttccaagcaaggccaggaggcggagccctagaggaggagtcccgcggtgccccgcccaccggcgcaggagttagttggctacctgccggcccagcacgcgcagaggaagtaggtgagctggctgcaggccgcccccaggctagcggagagccgtcctcgctccaagaggatcgcccacgtccccaaacccgcttggctgcagcccctacagaaaaccctcgtggccagctgcagccagacccccagtgaggccccaagcccctcagccagctgcttgagacccgcaggtggtgagggatggcgtccaagaccaccaccatcatcacccgtaagcgactcgcccacagtccatccttacagagtgtaaagagacccattatcccctaagagtttaggggcagtcaccaccgtcatccgccaacgccatctcaacctgttcatccagaagtgttccgttctgcgccaccaggaggctatggagaaggcgctgaaagaggaaacgatgacctgagaccggcaaccccggagaaaacctctacctgaactgccacgaacaccctcccagagctcagccgcctgggaatccccgaggccacaggatgtgtcccgggaggaggagttggtgggcaggctggccgccgggaccagcttctcgtgcagctactggagcagcccccggtgaggaacctgaaccaggccgccctgtgcagccccttgaggagctcctgctaacccaggcccagctcaagaacggctccccgtcccacacccaccgctccgtcttcttcacggccaaggagaagaagcccaaggactcctcctgcaggacctgctgtcccgcggcaccgagtcccacgtgtcctcgtcgagctctatgtccgcaacgaggagttgctgccactgggggcggctgggagacccggggttgcgcggcgccatcaggtcgctgagctcacctgccggcggaaggagcgcctggagggcttcgtgaggacgtttgagaaagctctgggggacgcctccccactgggacccatgccctggactgttgggcgccctgcaccacgcacggcctggagctggcccggtaacgcggccacaggaacgtggtgcgcgacgccttcgtcaagaccgacggctttcttgccgacattagcgtcagctgcaggcagtcctgctgaacgtgttccgcttggcaccaacaccatcgtcacccgcaccgcctggagagcggcctgtgacctcttagggtatccacagcacggaggtggacgagtccgcgctctccccagcgcctgggcctcccctataagtgctctctgcggagcctcacggccgaccacgtgggacatctcacccagagacgcatgtacagcacagctcccgcgggggcgcggcgcctgcgtgcatccggctatctggaaggtccgagaagaccaagcgctggcgcccgcccgcctctcctgccgccctaggcctcttccaaaacagcgccatacatctccacgaggccaggcagctcagagcagcgggatgagcggacgccgagaacgcgacgcccagcagacccgcccagcccagcccgcgccccgccctggcctctggcgcgcgtccccgccccgctctctgcagcccccagtcccgcagccctgggccgtctccgcccctcagccccacggcccgagccgccaagagaccctcgcacccgcccgcggctccaaccaggccctcatttccgctccgggctgcggcaggcgcctctgcttctcacacggggcgccgggtgggctggtctcaagtttgagacaggctttttaaattctatattgttatttgtattatttttaatgtaaacctgatgaattgcacagtaccttccccactgagaagagcaggggcccggcgctggcttccctcctggggcatagggaccggacagacccgaacaggagccggggccacggccacacgcggcctagcgtaggttggacacgcctcccgggctctcggagctggcctgcttggtgggagccggcttctgcaacctacctaccgccccctgcgctggactccgttacctctgagaaccaaagaagcccctcgccagcccccagggcccactggcctccaaatgcagtcttcctgcaggagcacgctcctcgtctgtggggttctctgtaccccttccccctcacccccagcatggacagaataaatggtagtataaataaatgctggttaaaaaaaagaaaccacaaaataaaaattataccagtttacactgctactccatattcttgccaacacttagtattgaaattcttttgaactttacctttctgatggatttgcagtggaatctcactgtataattttgatttgcatttatctgagaatttatgatgtcgaacaattttcatatggctgtttagccacttcagcatcctttttggtgaagaatcacttcaggactgttccccattttttccactgtgttgtttttttctctttaataggagctgtatacattctagataaaagccttggtcagtataaggtgctgccaatatctcctcccagcctatggctcacctttacactcagaagtggtgtcttttttagtccataaacaaattgtatttttattcgccagcaacaaacaattacaaacagcctcaaaaattcagatggctgtgagtaaatctaatgcaagatatgcaaaaccactacacagaaagccacaaagcaatattgaaacaaaacttaaaagtcctaaataaacatgtaattggaagacttagtattataagaatgtcagttttcccagaaatgatctatagagtcaaaacaatcccaatcagaatccaagaagggttttttgtttccccattttttttggaaactgacaagtggatttggacaggtatgtggaattgcaaatgacctagtatagccaagacaatcttgaaggagaagaaccaaattgtgggaattttccatccaacttcaagactcagtttaaaagtacaacaattgaaacagtattggggtgagtatagacaaatggaccaaaggaaacaatacagaacagaaacaagactcccctgggcacacgtacttgacttatgacaaagctggcagtgcagaatgatgagtaaaggcaataatgctgggccagttgaatagtcaactggagaaaatgaaaagtttcccctcttcatgctgtgcacataaataattcctggtgggttatagatgtaaatgtgaaaggtaaaataataaagcttccagatgatagcatatgaaaatatttttatggctttgagataggcaacaattcctcattattaaatagcactaaccataatgggactacattaagatttggattgctttttgggaggccaacgcgggcggatcacctgaggtcaggagttcgagaccagccttgccaatatgtcgaaacctcgactctactaaaaatacaaaaaattagccgaacatggtggtgggtgcctgtaatcccagctactcatgaggctgaggcaggagaatcacttgaaccggggaggtggaggttgcagtgagccaagatggcgtcattgcactccagcctaagcaacaagaacgaaactctgcctcaaaaaaaaaaaaaagatttggattgctttaatgtctgaaggtggttaaaaaaaaagttacgggaaataggttgcatgataatatactaataatatcactaactataatttattgagcatttgtgatatactgagcaccctactgagtttcaaatgtcttatctcatttagccattactaatattattattttacagatgaggaagctgaggtacagactgttgaagtaacttgcctaaagttattcacactgctagtaagtgacagagctgctctgcagaccaggcagtctgactccagagccaacactcttaatgactccacctgacccccattggaggcactggattttatataatgagggcatttaacttatagactgataccaaacctgaagagggcatgtaggatggctttttgaaaacataccaggagcccctggtatgtttctcagtgctacatatcacaagatgcaaaagataacaagaagtagttatggctgaagttcctaaggataaatatctcaggaatcaagacaaagtcaaacgagtaggctcaatcttcatatcttttaattatgttcccagagcttgtccaaaggtgtaggttgttatggtgatgggaaaaggttttgcaaacttaacttatgggagtatttttttcagatttaaataatgccttgtcatgatgtacaaccttagctagccttgctcctctgtgctgcccacttcagttatacgagaaggtattatgttggtgttagctggtaaaatgtctgaagaatctgtgaacccaaaaaagccatgggtacccccttggtggtggtaacaataaatgttatttatttatttttttgagacggagtctcactttgtcgtccaggctggagtgcagtggtgcaatctcggctcactgcaacctccacttcccaggttcaagctattctgcctcagcctcccaagtagctgggattacaggtgcccgccaccatgcccagctaatttttgtatttttagtagagacagggtttcgccatgttggccaggctggtctcgaactcctgaccacaggtgatctgcccgcttcagctttccaaagtattgggattacaggtgtgagccaccgcacccggccacaataaattttacattagtgagatccatggtggccaacctatcatttttcttttgcatgttaccttattaatctgatcggttgtttcaagctatttcactatctttgattttgttacccaggaggagggaaaatccacagttgacaggacccaatatggatgaagccaatgtcagttaaacctcagttcttcctaaaaactcattctggatatgtaacatttactaaaataataataaaagtccataaagagaaactttttgcccaagcagatagaatgtctgtgatattcatattgccagggaaatgacacaactctagaagaaattatcatcatatgactcaccactacctttgccagttcttttgctgacagatggagagataaaagatctaaaactgtgtctatgagggattagcgttctaaaattgtggtcgctcataagaatgcaatattaacactcattcgaaaagacagcagcacatcgagggtttttcttatgggaccccagctggccccacccagaagacagagctcagtgactccaggactccatgggagttacttccctcccttcattttttccttcccttcttttcaggccttcttttctttgtctcctttcccctcattccttcctcccttctctcttttatttctatttctctttctgttttgttttctttctttctatttctttccttccaacagatgggattttatttttatttttatagacttatgtataaaatttcagtcaaaatattatcctagaaaggagtataaataatttttttgtctcattatatctaacgggttttcaagcaaactaagaatctctaaaatatccaggtcagcaaagaaactgtaactatgtaatttattgtgaagatgccttctcttctaacacaagctctacccagcaggagggttttcctaaatttaaatcagcagtaaagcatgttctcctcttcgctaggcaagtttttgcaaacaccctgttgccaagctgccatctctgagcagggagacttacacaatatctgccaattgactgcagcaagtactgagagcagtggaggaagaaggggccagtatgatcggacaagggaaagggatcaaagggacaaaagcactgagcactaagctctgattttttgtcttgcccaaattcctacctaaggggtctagggagtcatgccttgcaaaccataaattctcatcagatgggttttattggaccctatatattgtgacttacttttcaatctgactctggcataacattatgagacaaggaaaaaaatatttaaccacagaaatatatttccttgccataccttaaaattgccttgcaaaatgtcttgtgggaagaatccacattctatacaaaatccccttccccctttgtttttcttccttcctttccagatccgggagataatcaactaagagccaggcacccttttaagttctataaaaaacaatttacaaaccgctctctctaaagttggctacctaagagctttctctgcacgataaaacttggtctccacaaacctttatctttaacctgaacattcctttctatctatcccatgtcttcagacaacttcaaccaattgtcaaccagaaaatgtttaaatttacctatagcctggaagccctcgcttttgtcccacctttctaaaccaaaccaatgtattccttaaatgtatttgattgatgtctcacgccttcctaaaatacataaaaccaatctgtaccccagccaccttgggcacatgttctcaggacctcctgagggctgtgtcatgggccatggtcactcatacttgtctcagaataaatctcttaaaatattttgcagagtttgactcttttcatcaacagcacctaggcacaaagcagaaatgaatagaaaaagaaatgcgtgtaatccacgcttccctcagcaacagcagctttagatagactatttgtctgtgacaaataattagggcatgactaataatttccgtattaacaagaaattatttagttctgcgtcttcaactcacattttcactggaatcctacaagtatcagaggtgtttgaaccacagcgactccatcttgaacagggctgggtaaaataaggctgagacctactgggctgcattcccaggaatttaggcattccaagtcacaggattaaacaggagatcgccacaagatacgggtcacaaagaccttgcttataaaacaggttgtggtaaagaagccggccaaaacccaccaaaaccaagagtgacttctggtcgttcctcactgctcattacatgctaattataatgtattagcatgctacaagacactgtcttcagtgccatgaaagtttacagatgccaaggcaacatctggaagtccccctatatggtctgaaaaggtgaagagtcctcagttccaggagtttcccacccctttcccggaaaactcatgaataatccacccctcgtttagcatataatcaagaaataaccataaaaatggctagtcaggccaggcgcagtgggtcacacctgtaatcccagcatcttgggaatctgaggcaggcagatcacctgaggccaggagtttgagaccaccctggccaacatggtaaaactctttctttactaaaaatacaaaatcaaccagctgggcatggtggcacatccctgtagacccaactactcaggtggttgaggcaggagaatcacttgaacccaggaggcggcagttgcagtgagctgagatcgcgccactgcactccatcctgagtgacagagtgagactgtggatcaaaaaaaaaaaaaagggccaatcaaaagccctcagggctgctctgcctatgaagtagccattattttattcttttactttcttaataagcttgctttcccattactctatagactcgcctggaattctttcttgcagagatccaagaaccctctcttggggtctggattgggacatttttctggtcacacaagcacttcatgtcctccttttcccttgtagggtcccaggggctgctagccatggcctagcacagtgcagcacagggagcaccacacacatcctcagctgtgctcccagggatgcctcctgcacagtccagtgtgaacagctgcccagagccaagaagggcagtgttgctccacacgggcagttggcagccacgtggtagctattgagatcttcttgtttttcattatttactaaaacaaacaaacacttatatgtctaataatagataaaataaattctcgtagatcatacaatggcatatgaagccaataaaattatgttacagaagagtatttaatgacagaaaaacattcatgatttattgctagataacatgataaaatttgaacataataggtaaaaagacaaaaatgtgtagtataaaataaaatttcaggaccctctaaatttattttgccaaggaaggaagttaagctctggagacagtagcatgtttgcaatttcgcttcttagattatagcttaaccctcttcctcattgctcttttcctgtaaatgcctaggagagaccagagaccagatattcccccttccaatcactgatctttgttatagattaactgtctttattgtccagttcctaacccagaccaatggcacccaagaccccatgacagttacatcttcagggtggaatgttaaatatacctttccctgaaagaaacgtaccatctggactaatcatatcattgtattttaactatacattaagtcttccatagaaagacactgaaattctgttaaagcgcccta

SEQ ID NO: 23 - DNA, 163049 bp, Artificial Sequence
  Synthetic BAC sequence
gaattcaagcccatcttactctgatctaaggggcaaagacaccccatctgagttattcaagtagagcccagaatggatcactggcaccatctcccccagttgttgacagttgagcaaggagccgggcgttctcccctcccctcctcctgctgtgctctgtcttggccgccttccttatggataggccatatgggccgttttggagcctgtgtttgctttggcttggtggttcgcagcttacttcctgttaacattcctccacctctcaccccacattatgggtctctctctcagagccacctgctctttctgttctctgtgcccataacctcagctctctgatttctccattcattgcttggctcttaactgggactcaaatctcacttctgtttaagtattttccatgccagcttcttgtttggaccagatagtgtttcaccatgatgggcctttattaggagacaaaggggtgatcggggtggtaccggaaaaggcaagttcatgtatccaaatgactgtcaagtgagaccagaaaaagcccttcttcccatgagtttttgtccaaaaagcatcagacctagtatagaggcgattatggccaaaaaggcgagcgctgagtttgaggccaaaaaaaacagcctaggagtggagggaggcacaaaactggcacacgtgcctgtagattctctcacatttaccctcctgggtctccttaacccaggcccttggcctagtaagagtgccaggccaggccacagtccaaggccaacatgtgtacgaaactaccacaccccgcatgtggcatgacttgttctggctactcacaaacgactcgatgttcatctcctctagtggagttcagataaggcctttcagcttggctgtctccatctggttcttcccattgagcccaggtccagtggctccacagagaaacaccttaacctgcctcaagaacctcttcccttgacttcaactcaggtggatgtcccagccaagaatgctttggcaggatgaaaccgtgctgtgaagagcgtgttcagggtgtgggtttaagtctcacttcaaccaggtcttagctgtgtgaccttgagcaagtcccttcacatcattctacctgtttcctcttttgtgagatggagctaattatgcaaagaggtgtgagaattcaaaaagatcacccacgaataataaggtgggacaattccctgaaaagcacaccaggcctactgagacaggaaataggcttggtgttgtgtatggagaggtagaccttctttgccatttaggggatgagatccatagcacagtaggaagtatggtgggtagctgagtctggaaaacaactgtgtgtgtgaatgcagaggactgcatataaagtgccagagctgtgcctggcacttgttgtttgccagccaagggtccctgagttgagaacacacacaccaaggacagtggagaagagcagatgccatccttacatgtgcagtgtttttggccttgctcccattctgaaagtgcctgtctgaagggatctggctcctggaatgggcaggggtttttgtcatctgtttcgctgggaggaagtccacagtcagggattttgtagaatcttaatggtgaccgccaggcagtggcaactatagccaaaaacaatgaggctccttggtacactaaggaaggcttcgggtttaatgccttagggcaatactcatctggaccgactttttagactgaagaagccttcctggggtcttggggtttttacatagacataacaggggtgccaaggcatttagtgtacacatttgaaagattgtgactgcatttttatcccaagcttatgaagcagctacatttgtgaagtggttagcaggctgcctggcatattttaagggtttcataaatgatgctcattattattaagcacgcgtgtcacagcagccagagcactgagcagcgctccttggcagctgcagctccccaaggggagggcggtgccttacaagttgggagaagacagtggaatcattaagcagctgacacatacccagtcactccaaggaatctcccatccctgttcagaagtctgacccaatttgctcagcttttctcctgagactctcttgttccagccacaaatctgagctgggagcacccttcctcttagccacctgtgactgggaggcagcgggggtggcccagagctcaccctagttgggagacttgagcagtagctcctctcctccagcattccctggtgggggtgtggaaggctgtgagtaagggaagagagagggtgtggggcacctcacatggtcagggagggctcccctcccttggaactcacagcagccaggtcatgggctcactggggttgtttatcatcctcagtcttggggagaacaggctcacatgacagcgctttgcaaatcggtaagtttttttccaaacatacaaaaacctaggcctggggtttaggacttctagaacttcagagcacacggtcctgtgtcatgactctcaaacggggacacacatcacttaagtcaagtggaggtggagctgtcacgttagtcactgcagtttgcaaggcttgggtgccagattcttgtcagatacctctctgtatccctatggaaaccagaagaatggagagtgacttgtgatgggctgtcccaggcattgagtctcacagaatcagagagctgggagcacagggggtatgggagtgggaacagaggagggagatggggggcaggcagatgtgggaggtcacccaggacagctttcaggcagagcagtatcatctgccttttacagatgtggcaactgaggcaaaaaaagactcactggcttcccagacccaccacgacccactgcctcttcctgctgccgcgccagatatcctccttttttcatgaaagcaactgagttcatggtgttcctgtgaacttagcaattgtagaatgtggttttgcctggtggctggaaaagatcaggaacctatataagaagtaaacccttttcaacttgtacaagtccagaaggataaagggaggtacaatctaatgtggcaggaagaggcgttgggcccatggtgggtcagggcgagtgatttctgtgggggtccagaaaggttcctggcaagaataaggaaaccaagcgaggttccccagctgcagaggctaatgtgctctccacctcagcctgtcctatgcaccaccagctcatactcccttcaccttctttttttgtttgtttttatttaaaaaaaaaacaactgttggtgggactgtaaactagttcaaccattgtggaagtcagtgtggcgattcctcagggatctagaactagaaataccatttgacccagccatctcattactgggcatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaccaaacactgcatattctcactcataggtgggaattgaacaatgagaacacatggacacaggaaggggaacatcacactctggggactgttgtggggtggggggaggggggagggatagctttaggagatatacctaatgctaaatgatgagttaatgggtgcagcacaccagcatggcacatgtatacatatgtaactaacctgcacattgtgcacatgtaccctaaaacttaaagtataataaaataaaataaaacaaagtttttaaacatgctctttaacttttagttttccttgatcactataactccatctcctcagtgttcatttttaggggactaggtaaaggtggaaaaactaagaccaggagagaagtgactttccccaggccactgggcagtagagcaggggcaggccctcttaactcatgcattgcttccttccactttctgagccaccacattgtgagatgccgccctgtgtggactcgcacaggatttcattctttccacaaaggattgagacagacacagcccctgcactcatgcctgaatgtgcaatgggataggtgggcattggccaagtgactgtaaatgagcaatgcaaaagagagttcagagactttctgaattgttccaccaccccagtctctgggcttcccagacatatcctgtgcactcctgctggattactcctccgaatgttcccaaagctgcccgctgtattccaaattactctagacaggcattctggcccctctacgaccacacctcctaacctacttcctttacacacggtgcctgccagctggcctgtggcccactgcactgcccttactcgggatatcctctctctgaaaaagcccagcctggctgtctgatctccaagaagctttccccaacacctctgatggcaaggatctttcagcacctccattacataccccccatactaaattttaggaattcgttttgtggaaaatacatgtaatgcgattcaagaaatttacaactcccttcaggtaatgaaaagcccaatagtagacaaaatgaaactggaagaccttgaactagccatctctcagcacattttttctttttttttttttttttttgagacagggtcttcctccatccccccggctggagtgtagtgctgtgatcatagttcactgcaggctcaaactcatgggctcaagcaatcctcctacctcacccatccaaataagtgggactacaggcctgcaccacaacatttagctattttttaatttttttgtagagatggggggtctcactatgtcgcccaggctggtctcaagctcctggcttcaagtgatcctcctgcctcagcctcccaaagtgctaggattccaggcatgagccacttgcgcctggccactctcagcacatttttctaaagcccactcttacccatagaccactcacaacacatcttttctgagcaactgtcaagttctgggtattgaataacagaatacaacatacaaaacagggtccccagcctccgtgatcttacattttgagaaatccctggaaaggctgcagtctacatcagctgaaaagcatttactaagctccattttttttttttttagagtgctgccctcccctaggagctcaaccggtgatatatatcattgcatgtgatacgtctcataatatatctcacagcaccactgtgagacatccttaccttcccaattctgcatgtttactctggttcttctcagccagaaatgtcttcttcatatccacttttcagcaccctaatcgggtttccttctttgtgctccaaccttatgatctctgaatcctttgatcttctttccggacttgtaatttggcaccatacagtttagctgttcctcctacatgattcagaagcagtgaggtttggtggccttggagtctgtggcagagaaagctaggatatttgctctccttccattaggttaggttgtttctgggaaacagctatctggccacttcatttctcaacccctctgtatcttattggggccatgtaactaattatggaccatgaaataaaagtgatttatctcattttggggtaagagttgttgcagtatctaatgtgccatcatcattcagtcttcctcttctttgatgacctgaatgccacctgttggaaatagcagagcttcaagatggaaaggactggattcctgagtcaccacttggagaatcacctcccagaagagcccagccagccaggaacacctgcagaggatattgggcaacaaatacacttgtatcaggtcaagccactggaggttttcttgaccaaaacaaagttagataagtttaggattgagtcccatctctgccacttgacagccctgtcatgttgggaagattactcacccttcctgagcctcatattctccttcaataagaagagctcagtgatacccaaccttgcaggatggtcgtgaggagtaaataagatatttctgaactacttgaaacattgtagaaacccaataatttgtatatctttatgtgtttgtgagggtgtatgtgcatccacatagtgagtggcttcatatgtggtactcttgctgctgaattgtaaataagtggtttaatgttgtaaacctgtattctttctaaagcctagcacagtgcaaagcaaatggaagatctcagttaatatttactaagaagcaaaaaaaattggcttaaaatataaggaaaactaatttgctgtgctacctccttataatatccccctgtgcaatgggaggagtttacagccctctcccgctggggcagtgcttcccttggcttcccactgatcctgtcttctaaagtggatttctgtgtatacttgctgctcagtatgtgagtaaatgggtgtatttatttggataaaagtgcttttgtggtttgtgacaaaggagtagaagccagacagggaagggagggggcagattattgaattctttggaaatagatggtgaggaaaccatgctagaagggaccttgttttatatttttgcaagcgagctgtagacacgagctgtgtgatgaaatctctgagttgaaagatatcattaagcattcctgcccagtataaaatatcaaattgatgatgatcaaccatctcatcagattggtatgttgagattttggtaatcatgtcaatgtgtttttaaaaagaggacacatatttgaagaataagagcaatgaaggaataatggattatctgaggtcatcttaagccagcacagtttagtttatcttttaaaaacaaatcagacttgtcctccactattgaagaagcagttgaagctccttttacgcctgttcattttgatatgccctttgcatgttaatcccctgacaaaagctctctaaaaaagcaaagtaacaccaataagtattctgattatgctagatagagaataaatgcccaaccaagggaaagcaaaatgtttttgcttcaaggaccattcaaaaagttttttttaaggtggctcaggcttgtaatcccagcactttgggaggccaaggcgggcgggtctctaggtcagaagatcgagaccatcctggctaacatggtgaaaccccgtctctactaaaaaaatacaaaaaattagccgggcgtggtggtgggcacctgtagtcccagctactcaggaggctgaggcaggagaatggcgtgaactgggaggcggagcttgcggtgagccgagatcttgccgctgcactccagcctgggcaacagagccagactcagtctcaaaaaaaaaaaaagtataaacttcattttaaaagagtatagactgggcatggtggctcacacctatgatcccaacactttgggaggccgatgtgggaggccaggagttcaagaccagcctggccaacacagtgagacttcatctctacaaaaaaataaaaaaaattagccaggcgtaatgttgcacacctgtagtcatagctactcaggaggctgaggcaggaggattgattgagaccagaagttcaaggctgtggtgagctatgatcacaccactgtactccagcgtgggtgacacagcaagaccttgtctcaaaaataaaaaaaaaagaggatgtacggtatacacacatacatgcatgcacacatacaccatcaagaaatgcagcatccataattgcagtgaagcatgctaaatattatttctctttcatagaaagagtttcattcaggaggagctgaaatttcagaaacaacatatgcacaattagcacacatggcagtgtcttcttaaaattcggggtctttgaacacattttatgtataataagaaccagtggtatggagaggaggcaggctggggggattgaaattggattgaatgcaaagagaagtgcaaatcaatcacagagcaaggacaacagccaagagccattccactagcatctcactcctggaagtgtggtccacaggccacacccaggacctgggctaaggcaaggtaagtggggcactcttccagaacaacctcagcacctataataaataatattttatgcaatattttaaaaattcaaactgcaaactgtaactgtggtctggtggcctgtttttgtaaacagagttctattggagcagtatgagcatcccatgggtgtttgttagaaatgcagaatcttgggccctataccagcccttcagactcaaaatttgcattttaataacattcgcaactggtgtgtgtgcacattaaagtctgggaaacactgctccagcagactttaaggcaggctagactgacgtatggttgctctaggcaggacagtaatttgttgcccttcaaggtggatactctttaaacattgattacttagcatttatttaataaggacaggaataaattaaaatagatttctttcttcacatttaacacagagaatttattgcatgcattggaagaaacgtaatatttaaacttacttggaatgactttttaatttcacatctttctactgtgtataattgcacagcgttagtccctcacacatgaagtacacaaaaatataattgaactttcttattcaaaatatattttaaagttcctttttctgactctcatattggcaacaacatcctacttttctgtagctgatttgtcttcaatttttcttttgtggttttctgaatcagaaaacttctagggaggcatatgaaaggtttaaatttgaggtaacagaatgcatcgcccctgccatgctttaactttagcatttcaagatcagttcacttgagcctggaggttggtgagcatgctggttggcagctcagcctgtatcccatcactgcacacttttagcagaaactgatagcttcttgaaaagaaaaagcttctattttcactccagaggactatttttttcaaaagaattaatttctattttccagttttgtaaaaagtgatatgagacagcttcagttaactgggccctgtttctgatttgtatattttagggagtttttcagtattttgctgtggacagatttcacattggacacgctgactccctgggaactacccagtgtggaggcaagaattataatcttgccccaaggctagcgtgagaggagtcaggtagctggttaatgcaggaaaccacctggcagcatccacgcctcactgctgcttaattcttgtctactgatgacatgccgcaaaactccagtaaaaacacagctcacagagtcaggaaatggcatggttaatattgttaggtgataacacaatgtcctgcagactgcggtaacaatagtggaagggcacataccagaattaaatggtggatttccccaagaaaacaccctcatctgtgttatctaaagatttagaaaagtgtttcttaaccatggctgcaaattgcagtcaactggagagcttttaaaactgataatggctgaacctcaaatccagattctgaattaattggtctggggtgcagtcaggacactgggattctttttaaaagcatcctaagcagttctaacatgcaaccaagtttgagaaccgttgctgtggattccttatagtgaaaaagtggagaatatttatttatttattatttatttgtatgagggtaattaatatagctggtacaacaaggagtccccagatatcaatggtttactacgagaaagtttatttcttgtgagtgtggatgattgcataagtgttttctcagctagacctgaaaatggtatacatcacacctcctgacatcccgctggttagaatcacatcacccagctccaacctaactgcagaagaagttaggatatgccatctttctgcggcccaggagaaaaaatacagggttggtgagcttgtagtccattcctgccacatataaatatcataaaaatgcttataacttcctaatttaagaaccaaaggcttagagtttaagtaccaatatttaaaaataactttatatggcctggcacagtggctcaagcctgtaatcacagcactatgggaggccaagatgggtggatcacctgaggtcgggagttcgagaccagcctgaccaacatgaaaaaaccccgtctctactaaaagtacaaaattagctgggcgtggtggcgggcacctgtaatcccagctacttgggaggctgaggcaggagaatcgcttgaaacccagaggcagaggtggcagtgagctgagattgtgccatttcaatccagcctgggcaacaagagtgaaattccatctcaaaaaatgaaaaaagttaactttatatattatttttctcttctattcgtagaatcaatcatacatatacattttatatgtatattgtttttacatatatatgtatatatatacatacacacacacttatattcgaaataaaagggtcctttatggccgggcacggtggctcacacctgtaatcccagcactttgggaagccaagtctggcggatcacgaggtcaggagatcaagactatcctggctaacacggtgaaaccccgtctctaccaaaaatacaaaaaattagccgggcgcagtggtgggcacctgtagtcccagctactcgggaggctgaggcaagagaatggcgtgaacccgggaggcggagcttgcagtgagccgagatggtgccactgcactccggcctgggcgaaagagcgagactccatctcaaaaaaaaaaaaaaaaaaaaaaaaaagggtcctttacagtatgaaatatgtctgcccaggccggagtgcagtggtgtgatcatgactcactgcagccttggccttccaggctcaagtaatcctcctgccttggcctccccaacagctgggactacaggcatgtgccaccatacctggctaatttgggtattttttgtagagacagggtctccctatgttgcccagactgggctcaagcaatctacctgcctcagcctcccaaagtgctgaaatcacaggcatgagcccacacactctgttataatttttaataagaattgtcttggaggcagtgagtgtctccaggttgcctagcttggctttaacccacgaagccctgcttatattttatgtattggatttcagagtaagtttcatttaaatatagaaatttaactttaaaaatgaactcaccactgaaaatcaccattttatgtgaaaactaccacagcattacatgggggagataggttagaagggtgttttaatttcagtgattcataaggatctagacacggggctttacagatgtcagaaggaacatagtacagaagcatagcttgcctcctggcttctaggaccaaggcactgaagatcatacaccctgctacttccttcaagagcctcaaaggctcacatcccctctgactatagctgggagagaactgctctgctaccccttatttgaaagtacctctgcgttaggaacttggcttcattcatctttgtctctactgcttcatgcagatggctcaaggcaagtgctcagaaaatatttttttcagaaaaacgaagggagggagatgaagaggaagagatagaagaaataggttgctcttctgcagagatttttcctattttccttctcctaatctcagtcattgatcctttcaacacatattaagtgcctgctatgtgccaggcactgagctgggtgataaagctacgaggacaaagcaggcctagtccttgtcatcagaggcctcgtatggcagcagcgggttacaggggccatgaagagatttactgaggggcgagggaggggagcaagcagagaagcaagaggactgacaacggtatggcccactctctccttggccttctcttggtttctagaagagcagagagaagcctagatcttgaatcacaatataatttgtagcttacagattcctattttactttcttgtgttacattttattcattcttctggcaagcacagtgaactgggtatgcactgtgttgtcagaagatctggagtttttattctcagttccaactctttagggtgagagacctttggcaagagaccccaacttgtgcatgattaggatgataaaaatctaggattgaggtgaggattgaggatcagaggtcacagttcacaagtgcttgttaaaactgtgaagttctacagaagtattagacttttatatatagtgggtaataatggtccagcaaggacatagggaaggtgttactattatccacaataataaggctcagagacatcaaggagttgccctgggtggaataactagaaagggatggaactaagatttgagcacagctttctgaccccagatgtcctgcagtatcaggactctcaggcaggcactcctcaggagcaaaatgagctctcagtgaactttctttgcagctcacggaaaggtcaaagctctgtaaatgaagaatcactgacgctaggaaaaaaaaaaatcaaggctgaaagcatcagcctttaaggatggtgcacctggcttccgtgtcctctcctggtaggggtgaggcctgtgggggtgaacatgtgggcatgagatcgggagccattttctcctggggagctggttaaacagcacactgactccccagctggaggcaccacacctcctgtgaatgacccaccagagagcccacggaagccaagccacaaaggcgcaggaagcagcaggcctcagggaggagcttgccaccccgcctgatcatgggactgcccaaagagggataatctccatacagctgaagacagaaaggctaaacagcacatcgtgctgatttcatgtagttacaaaaatacacagacacaaacccaatctagtctgttgagccttggaaattctgatatattcaggtctcattaatcttttctgacaggtctggcctccatagcagagctggtggggccacgcagagcagagttcaccacgtagacacaactacaaaggcctgtgacctctgtcactgtctagtaggactgatgggatgtgtgattatcatcaggatgttttcaaatgtctccatttccaggagaagaaaaaggttgatcatgtaggtttgatttaattctccccaagagagtatttcagggtaaaaaggaaacagatctcttcttatttctgcaactcccagcacagctgcaaagaatacatcaggtgggatatgaaagttaggaaatgctcaatggagcagctgctttttgcttaaaatctccacctctgtgttgcttagatttgaacccaagctatggattccagaagtacttggaaggcttgatgccttctagctgacaccataaccaacccacagggggcacaggggagcacagagaggataattttgccttcatttatgaaatggggatggtcacaaagatcaaaaatcacaatgaagagatagcagagggtggagctagccagaaatcgcatccacttacctgctataacttggttcagtccttctaccatccaacagtaaaaaatgaaactgacatccatttgtagaagttataattcagattttttttttctttttcttttgagatggagtcttactcttccatgcaggctggagtgcagtggtgtaatctcagctcactgcaatctccgcctcctgggttcaagtaattctcctgcctcagcccctcgagtagctgggactacaggtgcgcaccatcatgcctgattacgttttgtgttttcagtagagatggggtttcaccatgttggctaggctggtctcaaactcctgacatcaagtgatctgcccaccttggcctcccaaagtgctgggattacaggcatcagccacagtgcccagccataattcaggtttgaatcaaggattcaaagcaacctatgtcctaaaacaaggtttatgactttgtttgaaaaaaagaaaccattttagatttattagcagttagttgaaacaacagattttgtgatttttgtcaggtcttgccaaatgcatgtcaaatgtacaagaccctcatgtttatgcagatatttgtgagaatgtctttaactgagatccaatcctgtgaataaaaccagtcatgaatatacatggaaatttgcaaagtcaagtgtacagcccttttctatctctccaaccctaacactcagaataatatagatcatcctttcctaactcatacgtaatgtcaggctcatactgggtttcaaaaaaagcataatgaagtaaattgttttttttttcttctctcttttttacaaagtgttattttaaattggcaaggggtaaatatctgtcttcagctataaatgtgaaactaatatttctgccagtaatgatcttctaactttaaaaacaatgtccttaaatcatttaataattacattcctaataattacatttctaatacagttctctaagaactacagttaaaaccagaataaaatatattctgtggaccaagttgatggtaattttaaaatccctaacatttatgggtatataacttttaaggatactaatgcagcatcaacccaattgtcctttattttggctcatctaatttacagacatgatttctgaagtttaacagtatttgtaatggcaatatccaaagtgattttggctgagtaaactgctatttgttgaacaaaaatgtagttgtttgtgcaagtttaaacatttcacaaggccagctgagttcatttcaaccctacttacaaaataattattggcaaatgaaatgggctgagggggtagagacaagatattttcaagcttctgagagatttacaaagccaagttcttcaactattgaaagtgaaattgaaaggtcacagacaattgaaaggtacaggtttaaatctcaggattaaaaagagttccaacaagaggaatatttacaatggaacaatgaggaaaatgttttgttacagtcagaaacatggaaaatatgctgttcaaaattgttggctcaggaataaataaaatccagacttggactattaaaaatatcaaagtgatccactgtgtgccaactccattttcccctgttgtttgttataaagaaaatccgttattgaatataatgcagttctggttaaattatcaaagacattttccatatgcaaactgttgtttaccatatgctatatattcttcgataacaattttaatacacctctatcacatggttccataggtgcagcgttagaaggaaattttgagttatattttaatctcttacccaaggtacaaaccccctttgtaacagccattcagctcattctgttgagcacctattataaacaaaattagagatacaaaaatacctttaagatgttaatggcctgttaggtggaagaaagcatctttgtccaatggttgccattaagcctagactgaaactcttctatcttgtgacagggagctcaccacaatgcaaggaaacccattctttcagtgagtagctctataattgggaccgtgtgtattaaactggggctgacatcagctgaccctggttttgccttccggaatagtatgagccaaatctactccatttttttcagctgagctcttcaaagatttttgagagcactttcctgtgtcctacctagtttctccgcccaccaccttcatgccatcttatttcctcttattttcactaccacgaaatgctttcctgcccttagggatttaaaaaattatttcatatcgacggattgagcctaacagctaaatactcaatattgcacttaaaataaaacagactttaaaaattatgacattaagaaaccaaaagttacagcaattggatacagtctgggattatccctttgtaattagatgagcattgactaacgaaagatgtttaggggaaaaaaaaatggaacagaacacctaaggcttgccaaaactgtgtatatttgagaggggggcatgataaatctattataatgaaattcatgtgctctaagacaatgactgaacttggtatttaagactatttaaaagtcacaagatgaattaggtcatgtttcagaaatgactctacaatctaaatttctcacaagcaagtcaggttaatgacaccagactctgctactttcaatggataaaacaagggatcgactcatatgttaaattttcttctagtggttatacatttggtactttcataagccataagtaagagacccaggataatttaaatccaggagactttatttagcctccggaatggcccctccaaccccaaatccatgcaagaacacaaagccaaggggtaaactaaaaaaaagaagagattgttttattgtgacatttatgacattgaccccttgttgacaggaatgaccgagggtaatcttggcatattgcacatgctgtgatgaaggatgcactggtgatcctctggccactgaggctgtttcctggtcctcccagacctctatgcacgtgtgggccagtcaccgaaatttcattaccacttggtgtatacatttaacaagtctttggtcttaataagcaccattacaaaccctcacattaagggcattattattctagtttataaatgtttcaatgataaaaaatagcacgattacagtatacacacacttaatttacatgtaatgtattatactcataactgagataagctactgaactaactttggttgattgaaattaatgaagtattggaactgaatacttgtaatttggtttctaagttgtgtacatattacagtgcatttataaatctagtttgaaaatttactagcaccaaataggtaccataaatggacaacctagtacttgtatttggagaagcaaagtttacaaatttgcaaaaaatagagtagtccatcaattgaaagcacattcccgtacgtttgctggaaggatggcatgtcagcataaatggccaacccccaatggaaatacacgtcccagttttcaagaatcaacacatatgacaaggtagcttagctacacacatgagaagcctgagaaagtggttgttttgaactagggtagtcacctgtaccttgctttggtaatacaaagaatagtgcttatttatacaaatttacttggtgaaagattgtacctatgatatgatgattctgattgggggaaaatatagttctacctatctatatttgtttttcttttaattatttggtctctggatggtgaattaatgaagcaaaacctggattttcatcttcagattatcacccagttcaccactgaggtagtctttgtcatatttgtcttctagttggttaagttctttctttttataaagtggagtactactgatttgtaatgaataggttccagccactggcttcttctttgtgaagtggaggtagctgatcccttccttttggttgattttaaagaagccatcttcatttccagattcgatcaagtatctgttgtgattcgtcagagttgtaagagctggaaggagttctaggattcgaaccttgttactgacgtgggaaatattgaaagcaaagatggctgtcttctcaacatcccaacttgcaagactcacattggcttctgtctcagactgatcctggaaagacacatggcaatatgttaaatacaatgtacatatgccacttagctctcatattaaagaaaaaatgactcaaatttcacactaatacaattttctgccttatgctgcatacacaatattgaaagcattttgtttagaccacaagtgtattaaattggcacatatttgtaatatttgaaaatattaactgatgtcaggaagaaaggcaggttgaaatcatttgtatctggaggtctcaaaatgtagtccctgaacaagctgcatcagcatcacctgggaatctgttagaaatgcaaattctcggcatcaccccagaactactgaatcagaaaccctgggatgtctcccaacaatcaattttaacaagacctagtaggtgattcagatgcatgctaaagtttgagaaccactgttttaatagattatgttctttccaaagacttatctcatttcttaaatgacagcagatgggttgcagcaccaatacgaagaaccagactatttcaatttgattcattgacgtaaaaccatcttctcctaaggacacacctatgagcctacttcctgactgtgatgatctgctaatattcaatgcttttcacctggcttcttacttgcctctctgggaccacatgtgctggattctatgggcccagagccagaggtctgggtgaatatctgtgcacttctgagttgactgaaaggctgcagcagccgtaggcaaaggaaaccaggctgcttcagctccacgttatttttgtctacaatccaagttccctcacactccacatggctcttttcagtagaggagcctctagctttcagaacttggcattcctatgtagggagcactatgtcacttcgctattctgcccacttgctgtcctggatctcagaccttatcctttcagcagactttgggtgggtatttgacttttttttggcgagacagaggaaatgagcaagtatgtgaaaaccttcaaatggccactcccgaaaagcagcaagaaactccagaaagccccacagcctcttgtaaaatacagcctagagctcagggaatgtctggagtttctccctggggagctttttcacactttggagcatccttggaggaaaccacaggaatctggaagggctttccaccacaggagacatcaggagaaactaacttctgacccacctcgatattggaggcatcagtttcgtttgtgcttctccgtttcctgccccgtttggggtagccattgatcttacactcgtaacaagcctctggggagagtgaattgtcatccatttcaccactgacaggtggctctgggtttcctcggcccatgcccattccagaaacacagtgcctgcagcagaaggggagcatagatgtttttcattagaatgggaagacaaggtaggtggtacaagagttctggtgaagcctgttccttgcagttgtgagatacagcccttgcttgtccactggaggatcagctagttctgagaactacattgaggtcctctgtttggcctctaattcccagttccctgaatgtattgatttccttctactgcctatcaagaccctgtcttggatatttatttatctcttcattcccaaacctaacatggaaagcattttgcagtacttatactggggaggagacacagagtggaaacaagagaatagtagatgagggaggccatgtaacttgggaggctaaataaaaatggcttctttttatgaaacaggctccatgggagtgagcaaggtgtgagacatcactgttgagtttcttgcattctcccacttccatcattacttttcctcactcaagctttggagcaattgctcctattccttgacgtttcacttttgcttatgctactgaggataagaagaaagctccggttgataatgaaggttaatttaataataaactatgaagatatgccgtatataaaatgcatgtatcagagtttgcccaactgtgggaaactgtttcaagtcattcaaaaccactagggccactggctccgactcatgtgaagatggataaacaaacccatgcccaagagagaactcgttcagctgtttttctttgcctttcagttatcaaagccaagttacggagggaggctcgaatgtttcacaagtaccttgttttgttattctgcttactatttcagaggccacttggaatgtgtatttatcaagctcctctttccaaatgtgttgaaacatttgaatggtccttaaaagaatctttatttgggggcagagtccattctagtgattcggagaggccaaaactgttttaaatgggtagatttctaacaatgggtcataatatagaccaaaaattatttatctgtttttctgtaatagctgatctgctctttagaactaattttcctatatacccttaggattcaaaatatgttgccaatgaacagaatatctgttgtatttcaaagcagtttataggttcctactgtttcccccaatcttgccagagtccaatacatttcctttcctctttatcttgcaacatgaaatatgtagaaacaatacaatggatgaagtgataaatgctcatcctgtgggtgtgtgcgcatgcgtatacattcacacaatgattaaattattaggaggtaaactgcaaatttgcaggctttggttcctttctcagaactcctttccagtattttcatatcccgggagcaccacttataagaagtgtgactacaaaatcccactggccaaaagccagtttagagtgtcacaatttttgctgggaagaaatggttctggcattaaactataaagaatgagtctactgagagccagacacaaacatctgggaatttgtgtctgattgctggcattctgtgtgcttcccacgaaacattcttctacctacccagatccaaaatgaatcacttgatgtttgtatgtcaagaaatcaaagactgctacattaataatttggtataagtgtggatgtgtgtgggggtgtgtgtgtacacgcatgtggaggagtacataatgtatatatatatttaatgtctatgtgttcctaattaaaaagttaaaatgtgcacttcctctcaggatagctaaaactaggtggacacccgagtccagattaattcagcaggaaaaaagatccaaactttgaaaacttaacactaaacttttaaatcactgggtaaaataaaaataggccttcccggccgggtacagtggctctcgcctgtaatctcagcactttgggaggtcaagacgggcagatcacgaggtccggagatcgagaccatcctggctaacacggtgaaaccccgtttctattaaaaatacaaaaaattagccgggcgtggtggcgggcacctgtagtcccagctactccagaggctgaggcaggagaatcgcgtgaacccgggaggcagagcttgcagtgagctgagattgcaccactgcactccagcctgggcgacagagcaagactccgtctaaaaaaaaaaaaaaaaggccttccctgccccaactctcacacagacacacctataatttggtgaagtgttttttttgtttttctttttttaaccaggaaaatacagtaagtgtttcaatgcacctttggtaaaatttaatgtaaattcaagtctgaaatgtaaaatataatttaaaaccctaaataattttcaacccaaagggatgtctttgacttattctaacaggagctagatacaaaggcattttaagtccagatagaatcctccctgccccaggagaagagtggatcagtcgtgtgcagggtgagcccagttctgtcatgggttggcagagaggtgtatttacagagagatgaatcacttcccaacaagatgtgaagatcaagagaataagatagagaagtcatatagcgagatatttacaatgtagtttcattactttgtttgacgtttccagaaatccagatgcttccttccaaataaaataacctaaaacttttgccaagctaactggaattaattttaggattacaaaaagcatggttctcctctgctaggacaggtaattttgagttcagtatacttaattatattacgaatgaaagaatctccaaccatgaccaggaagagcactgcttacccttggcctatgcggaagtaaccaggtggacagccacacaggtaaccgccctcggtattggaacagccatagctgcagggggcctgcgcagagccacattcattgatgtcttggcatcctccactgaactgttcatactggaagccggcgggacacatgcacttgtagctccccagggtgttgtgacaggaggctcctccgcagatgtgagcgctgaggcattcgttttcatctgcaggcaaaataagaagcggcatgtgtggcagcagccagagatttctattgaggacattggatctggccacttgctgccggccagctggccctcagctaggctctcaggaaggtaagacaggcagaggtggctgggtggggagagcaacagcagagaaagatgcgggcatggatgtggcttcttgctatgttgtgagtaaacatggaagatgaaacatggaagatgaagtcaaatgcaccaggcagagggcattagaggatggcattctgaggaccagcagactccagttctcatcagaagtcaacactggtatcttctgctccatgtaaacatccggtcatgaaccaacatggggctggtccgtagctaagatttagggttcaaggggggaggaaaggaatcttgcagttctctgcgtacttgcttcacaagtgcccagcgaggagacaaatctctcaaaagcagagaccaaccattttcccgcaggctgctttccctgtcagcctatttcaggatatgctgatctggcaaaggctgatatcctgccccaagtgtctgccccacgtgtctgccccacttggacttccttttcaaaattctgcaaaagcccccaggtacctgttctgggagatgaataatgccttctggtatgtctgctcccatcaccgaatcggccccctccttattcaaaccagcctcctgcccagagtgtctgagccctgtctaaaactaagtgtggctggaagagatttggtgcagacttcacaagcagtaattggggaaaacccacaagtgagacagaagctgcagggctggctacccacagggacctgccaagtctgatgctaagaagcaggaaaaagaaatcttactttaaaaaaatcagctagaagggggaaaaccatgagtttctcattatttctgatttataatttttggaagtctctaatatatttttgtagatctgcctttgcagggcaggttggaaagttgctggtaagacatttcttaactgccatagtccattttcaggcatacgttcatttgaatgtagatagattggccttctcttcacttagcgaataaccacttcctatggaagagaggaaggggaagggaatgaatgtttattagatacctattttatgatagataggatacaggtattgaccatttccttagctttcctaacaatcctgagaaagaggtattatattctctgttttacagctgaagaaagtgaggctcagaaagctcttccaagatctcacagccagcagcagcagggcagaaattcacagccaggtctgttggactgcaaaggccatccatgcgctttcctttataccacagtgcctctcaagagacgctccacatttaagctggtgcttcctttctcctgtaattagtttaccttctttgctaaggcacattcatttataaagaaaaataatgtttctcaacaaatctattttttctttttttttaaattagaaaacaggtggataaaagtggtggggaaggatgctcacttgtatatacttagtatatattcacatttcctacctgcctgcctgcctgccttccctccttccatgtctccttccctcctaccttctttccttctctccttccctttcttccttccttccttcccccctcccctcccctccctcctttccttccttccttccttcctttccttccttccttccttctctcctcccctccttccttctctctttccctccttcccttcagctacaggtctttgatcttaactgcctgtctgaaaatcttttgtatccaaagaccttcaagtcttcacccaaggtcacttaggctccagggctcttaaaatataaataataattttatctttctcattcttccctttctctttctgtgctcaacacgttatctgtgttctttctccttattttaaattgaggacgaagtgtgcaatagagagcaacagaaaccactggcaccaagctccatgtcaaacaaagaatgaagaacgaagcatatttacttcattggagagaacacccctgggctgatgtcttcttgctcctccacgtccatcctccatcctctccacttgctcttggccccaggtggctgatctatggagcatgagcaagctctgctcccctgtccctcacttttggttggcctcagccatctgcttcttgctgggaccctgactaataaaacctgcaaggcgtgggtatatgagggggaagacttgtcattctatagcttagatttattctgtgttttttcctccaaagagcagaagtaggaccaatggtgagaaattagagggaggagaaatgattttttttatagcaaaaaaagacatttctaagtattaaaagctgtctatacatagattgggctatcttgggagaaagtgggcacccttcaaggtggtatttaagccaaactgggataagcaaggaagttagagaaggatttatatattaggaaagagagaaggctagatctctaaggttctttttaactttgagcatctatctgtgttactacaactatcaagagttctccccctctcctttcacattcttttaaattttattttacattttctcccttccctgagaatttaataaagtttaaattaaacttgcttatctaggttggagaggtaggatggagtagagcacagattaaaataagaaattggcaaatattcagtgtttacagtttgaaaacagcatgtttgtgcactcgccctttttatcaatatacaaacaccacgatttggttaacatgttttgcacttttcctgacctttttcatcctctgcactctggagcaaatgactccacaaggaatttttttacactccaaaatatttgttttattcttccagttggtacttagattggtgagggttttgtttgttttataaaaagagacaattcgaattttaccaaaatagcattaaagtctgaaaactactccttaaaagtggattgaaacccaccactctgtcctctaaaatcaaaggtttcagcatccagcttgcactgttcatgttagctgtggccttaagggagtaccgataggaaacttcacaaatgcaggatgggctttcttttactcattttctctaggggaaaatgggtcaactctatctatctgcaagctgaattttttgaaatttacttctagaaagcaatgaaattagtggccctcttaccccaaagagtgaacttccagccacctgggagtgaggatccagggagggctggtctaagagatctgctctgtttcttgtggttctggggaagctattttagcccacggcaatgctcattctagataactctaattctcaagattgatgagagcaatttggcatttggagacattaagaaccccaaacttcttctgacttctaaatcaacttgtttttttagagtgtccagccaggagatgatcttcacgagaccagagcagaatctccaggacactagtgcatggcctggtcgcctctaccatcctcagactgatggtaggaggaggaggataaggtacaggagcgacatacctttcctctcttatgtttttttcacttagctccagtgttattaaaatgacctaaataatgagaacagacaggctcataaactgggtgttgaatcaacaaagttcactctggaagttctgtgaacaatgtcagaaactggtgattaaaatcaaagacctccctgagctgctaatgaacaaagacatttttattaaaaccagatagctagccagagactcacgcagtcgaaactcctatagcacaggggtcacttcagtcaaccctacatgccactgcaaaactgtcttgtgtagaatcaaactagatgacagagatgattttgataaatgaaaacacaccaaatatgtcttcatctgcatgaaagtgaacccctgcaatgcagagcctgcacccgggaagcagtaattctttgagtttttgctaaggagggctctgtacagaataatgtggcaactagaacaggttaccaaagcaccaagcttgcagtggcacttcacagacgcttgctgaatgaacataaacaagtgaatgtgacacttgaaaggcagctctacatcagaaagttaagagttgtgggttctagttccaagcatgtcacaaaagaactgggcaaggaaatattaccgtccctttctggacttctaggtccttatctgtaaaacaaagtgcctgagctaagtggcttctggtatccctccaaactcacaatgttttgattctctgatgtgcattaagagttattttcccatgacattgtagaatcaaagatgacatcatttcaatttaatgagagagtcagtagatctcccttaattatcaaaagaatttagcaatcttgaaaaacaaaacaaaacaaaacaaaacacacaaaaaaacacaaccttgctgtgtttcctgcttgcgctctgtctcaaaatgtgtagagctgaacagaactactttggcatcttcaggccaaaagccactcaaaatagcctttggctggctgatatttttcagtcataagtaagattttttgacccctgatatgaacataactcaagtgtgggctgatgactagcagtgcagcgggagggtggaggatattgcgcttcaagaaattctgggggcatttcatttcagatgctctcaaagcaccctcaattataattttttttcttagtttgctgttttgcaaagactgttacttacctcgggtttcaaccaggttagggcaattttaaatgagtatttgttgcttcaataacacatttacagcttcagaaagcaagcagtgttttgcttcataggacctgatagccatgcatcttgagagtgaggaaaagttacttgccaacacactggttccactggtagtgctggaggtagccctgggggcagctgcacctgtagcccccaatgatgttctggcagccatgctggcagcggtggttaccctcacactcgtccacgtctgaaaaagaagcagagccaccatgatgccaactcaacatctctctctgaagccagatggattctaataagaaatctggcccctacacatcctacacattattctaccaccaaaaacttcaagaatctctcttctggaactgctgctaagtccaaggagaaaatcattcagagagccctggcaaagtctacaaataaaaattgtcaggaaattagtgcaaagcccaaagcactctctgggacagctctgtaagttataagttatttgtgtttgctcttttttttttttatttttggtgccacaattagaaaccaaaacgtgtcaaagccacagtcaacttctaaaaatatcatttaaacttctaattaaatgtcatcagaagagctattcctcatatgtttagtccacatgggggaaatccctttatggctctggacccagtgaccagaaaattaatgaatcaaaatcaagtatatttttcttgactgagttattccctattaggttaaattaaaaacttagcagaaaaagtcttgatatacttaggaaaggcatgtgtgttagacacaatcaagcatgaaacaaaacacgactctctaagatacaggacctgtgcacactattttagctgagtgcccccctgggctcagatctgctatctcatagaggctgatgatgaaggtgccaatagccacacaggccacctccacaaggattcaccagctggatcgcagctgaagtctccacccaccttcacagctggagccggtctgatcaagtgagaatccccgctggcattcacaggtgaagcttccaggagtgttctggcaaatgcccttagacccgcacagattgatgtcagaggtgcattcattgttatctatgagaagcagtgggggcaaagaggggttaaaattccccaaagctctctttgtatcatttaaaagaaaattagaaggataactcggaaaaggccaaataaggccaacaacgcttcacatacatgtacaggtgtgctcacacatacatgcactcatatatttctttgagcttttattttcttatcccaacagcagaggaaatagaaaataatcccttaaaagaatcgctacaatccatgtaggattttttcctctcctactcaccaatgcaggacgtatggtgttgggtaaatccgggaggacatttgcatgtgaagccgccaatggtgttaacacataggaactggcagttgtgttgcttggttgcacactcatcaagatctacaagaaaatgcaagagaggcatttgagtcaagccaacaaaacaggatcagggaagctgaccctatgaagcagctccacgtttgatttggaggtctcaaatgaccctgactagaaagaagccacagcaaaaggcaaggagagacacagggggtaaagatctgaaagataaaacaaggtgtcaatttagaccctcctcccctcaaaaaaatataaagagatctttaggggatccaagaaaacacaattctaattggagaaatgcaggaattcctcaacaaaggaatttcaaataaatcatgacattttaaacaaatttttaaatgaagcgaaagatgaatgattctgcaaattttccagagctttgaaaagatctatttaagttaaaacataaagagaaatgttgaagctggaaatgaatttgctggcttagttctcttctgtttgctgtttttaatctactcaaatgaagtcatcaaaaacaaaatctgatttctttagtcgtgattcttcttaggataaaccaaaattgagcaatcaggaaggaaacaaagcaaaggaaaaattcattttaatagctaaaggcacttttaataaaactgcctccaggccaagcgtggtggctcatgcctgtattcccagcactttgggaggccaaggcaggctgatcactttgagctcacgagtttgagaccagcctgggcaacatggcaaaacctgtctctagtgaatatacaaaaattagctgggtgtggtggtgtgtgcatgtaatcccagctacctgggaggcagaggttgcagtgagctgagatcgcaccactgcactccagcctgggcaacagagtgaaacttcgtctcaaaacaaaaacaaaaacaaaaacaaaaaacaaaaaacaaaaaaaacaaaaatccaaaactgacaactgcctgcagtgtttatccaacattgtttcccacatctcaataaaaccctctgctttgaccaggcctcttttctcaacgcctcaacttctaagttgcattctcaactccaatgttatttcaaaataccaagagatgaaatgttgtgttctagcttctagctaaactttaatgataattttaaaattgtcgcatattcaggaaaaaacattagtgactttattttatcacaaattcaaccactatgccctcaccatctgcacaactgctttggagctgcagatcagtgccagctttgccagtgactgcttccactccacagggccagttcctggctagagtaacatctggagtggacctacactgagagaccctcccgagacctgtcctagttccggcttctcttataatgctgcctgtcctgtgctctttccactgctgagatcttgactgatatgcactctctgttcagctttctcagagtctgtggactggtttcccctgtctatggcccaaggagcttggctggagcatcatgacacatttgctgaagctcacctgcaacaggtgaggaagatgactcagtgatttctcctaacaccatttcatgagtacaacacatgaagaacagcagcacttgctgctcttgcctccaagatgcccttcctcctcttctcccctctaatctgcattctacccatctctcactggggatgtgctgctcccacggccacccttctggcttcctccttctcagtgactgtggtgcaactatctgcactattcatttgatatttagttatatataccaagtaagtggaagaatttgaaccttatgggaaaaaacaggaaaagggacaagttgtgagtggacatgtaaaaattacagttgctctttgcactcctaaagccataaagagaactttattgatgcattttcatttttcatcttttaattgctggaaacttttgagaattttctgcccccagaggttagaaaaaatgctataaatttgttttgcttgttacagataatatatacaatgagagatattttccccttgaatttggttcttcatttatatgaataaatttatggctctgagttatagcttcacattgcctagaactcacagtgaccccagatgtaaaataagttccacatttgagaagaacaaagctatgagcgacttcatttaagatgtttagaatgtgtaagtaggtctctcaacttcctctccccaaactacaggattatacaggctttgtgctgcacaggaaggcctcaggcacttgcccatgatgtcatccactattacatgtctcttaactctccctttcagcagacacaggaaagaggtcaagagcccaacttctctctgctctccacttctctcctctcctctcctccaatctggatcctccgtggggatgtgctggtcccaccctccacccttctagcctcttctcagttcagtggtacacacagctgcatcattcatttgatatttagttatatataccaagtaagtggaagaacttaagctttatgagaaaaaataggaaaaagactccactctatcctttaccttccttacttctgtatgtttctataaatttccttcaaagtttcatggcatgacatgatatctcttgctctaccacttggtctatcttttcttctccaaatctctgatttcccaaattattgttaagtatgactcactagtgctattcactaaatataatgttcttattgtggaggaagatgtttacaggagtaaaattaaaccaaaaaaattttgcaaaggataacttctggttgagaagggatttctgcccagagcttttctggttcttaattctgtgtgatatttatgtctcagggaagctcctacagggcagaaatagactttttctgcagaacaaaaatctggacacagcatctaattcattaggcacaatgtcctctacgatcatggcactgattattccgaggcaggaccttcctggaaacctgaactatatagctataaagaataaatacaaaaaacagaaagcagagaggaggtcaccaattaagaatctgccccaccagagccattgaagctggccctgctatctctgagacagtcatggatggccaccatggatgcccagggggcatgcagcaaggacagctgcttcctccacaatctccctggctttagcctccttccctccagcacaggaggtaggtcccatggaggcattaaccccagggaagcacctcctgcctgtagagcaggtctttcggcttgcctgtggagttcttacaggcaaaggaatgcagccatgtgtcaggagctaggtgaggggcaatggtcaattctactttacctttgcagctccttccatcctcttgcagaatgtagcctttcgggcatgaacactggtaactcccttctgtgtttttgcagataaaattgcagggtttgggagcctggttgcactcgttcagatctatgatcaaagaaatacagcgtgactgtgcatctaaaaatgatgtgtacacgctcaatttccacagggtctaacgaagaattttagtttcggggaaagaaaaaggaaactctgtgtagactttgatgattgtcctgtgctttcctatgaaactgcacagactttttagatttttagctttgggtttttttttttccataatctaaaatttccacttgaggataagccatcagaaatagacacttacctacacaggaagtcccagttatatctggagtgtacccagttttacaaatgcaatgatatgatcctctgtcattgacacattccccatttcggcaaacatcgtgaataaccttgcattcatcgatatctgtaatttaacaaatataaattaagaaatatatcataaaattgacaacattaatatgtagggggtcacttcagtgtaaatactaataaattgtgttactatattttgggcctaagaaattaaaccagtaagatgacagcataaatttaatatgtaacagtagctatatcaaaaggtaaacaaataacttcattagactacaattgataaaataattcagccacagaaaaactttaaaaacaactggtcttctaaatgtatatttttctcttctggatccatagaacagccaccccatctagacatatttggctttttgtgtcatctcatgccattaagcttgcctcctgctgacatctaataaatgaatcacagaagcagatccttttgatgaggaaaccccatttccaccccctagtattgcatgctcaaaataagtaaggttttttgttttttgtttttacattatttttgttgtctttgtggttaatcctgaaaaagttcaaattacataatattggggaaatgagatgaacttctgtcctctggtgaggggggaaactaaccagggctctgaggtggatgacagtgctgggtttttgcagcctgctaaggaagggagaccctcactcatggctgtaccacagagagaaagactgggtcaatatgcactgttgagcattaaaaccactgtcttccacatcttgacccattttacctccttactgcttggcgaagtgccgatacaagcactttctacatgggttctcagcccttgactgccaaataaccattttataccaacagctgggtgtatctgacctttacaagtctactctgaagtgcaatttagcacactcttattggtctccagaagtgagttttttcggctatcttattgctacatcctccaaagaatcataaattgcttttggtcactccatcttacctttctaggtctgttttttctttttttttaaatcacatccagttccattattctgccttcagccacatctttccaatacaaacacaaatccttcttaacctccttcttcccctttcacttctaattccctcccaagaagctcaaaaaagctctcaccttttctcagtccttttatgaactaaaaaccaattgtagttacagttgataaacacaggaatcatattggtgacaggcctagatatctctagagttgccttagacagtctgacacttcctcatcctgctctagttaaggagcttgtgcttttccagatgcaattgtgtctaattgccaggatatcagcatgatttatacttcttttatgcaatacagtttggccagttttaggagttccacatcttggtggactggtttgcacatttaataatcatttatttcaaagtttatctaaaaaatttaaaaattatattctgagtagccaattgacttatagtaaacggtttaaaaagttgaagactcgctggaatgcagagggagggtcctaagcacacacagcttaatcaagtggaccaaggccactttggcagcatgacctcaaatgtctaaaactccataatgaagaatttttgttggcctcagctgtgcaattcaacctaggcacatattgcaaactccatattttcatctgtgtttcacacaaaaaacaaataaatagattccctgcaagtatttttggactataaatgaagtacctgctccattggtcatgaatcctcggccatggggacagagtttcttgaaagccacagtcccctggaaagggcagatctcacagtggggaccccagcctctccctccgtcacagcagcattccgatttggtgacggggttcctgttgctggagccgatctgacacatgttttgtagcacctctgtgaagcagtacccttcccgattgtctggaagggacattatatggcaaaggggatgtcaggaaattttaagagcaaacaaaatattaaaaatttggtcagatataaaaaccaaaaaaggatgtaacactttaccctgggtgagaagaagcaagaggggaaagctggagacagcagtaaaagagaaaggatgacgtctgagggaaacaaataagacattcagtaagtaggcagaaagacattggcctagacaagcttataactctctctgctcccagaaatacaggggaatagccatgcttacagacagaggggcagagaaacatacggaagtggatcctgatcaccaagggcttcaaaggcagccaagaaattccaaacaagtgattcaggatccaattagcaaaggaagaatttagctgcagggtggtgctgagcccaatggacaatcacagtcattacggcatctccaaaatatgaacattttttatccttcctcagattttgacattttcttgtattttaaataagaagtctgggtttccagcatcccagtgtggaggctgaggttaggaaagtgcggtgccaactgtactcaccaaggcactcgtcctggttggggctggcggtaaacccatcattacactcacaggtgtagctcccacgggtgttgaggcagcgcccattctcacagatccctggcttcgtctgacattcattctcatctgtttgattttattgaaggaccaaaaacaagaagagtcatctgaccattttatagaggatggagctccttccttcgttccttccttcctccctccctccttccctccctttgttcctttctcctttccttcctcccttccctccctctcaccttccttccctctctcacatctttccttcttaacttagcttttgaatcactaatctgttcacatggctcaaaatttaaaaggtataaaagagacttcaattcattcttaactgtttggtttcattgaaagactgaaaacagaaagagccatctgaatcttttatagaagaatagattttcttctttcctatatagtttgtaaatagcttatctcttcacatggttcaaaattaaaaaggtacaaaaggagattcagcaaaagtacccccttcatttcctatttcccagacaccaaactcccctcctgaaaagcaaccaattctggggccgatttctaatgtatccttccagagctggattatgcatataaaagcaaatacatacataatatgtgtatgtgtgtgtgcacttcagatcttttaaaagcctaactgatagcattttatatacttaaacatagatggtagcattttatgcacacttacatttttcacttagtaaaatttaaatcttttcatattaggacataaaaaggactctcaaagtgttatttcaagtgaaggagggaaaaatgtgaatatcagcatatgaaagaaatattttaatacatgttagaataatatctgtaatggtcaatattgatctgggggagtttgtctagattaatcttcagattaacctagattatatctccaatataggttgcatttattgtaatatttcaacaatattattaagaaatcataaactacaactcagtttcccaggtttaaaaaaacattaaaatatctacagattcttagaattatctgatgattatttagaaagatcaaaaataatttgctgaggtgcttcccttcctttgagaatagttcagggtccctcagatggagctctcactaggaaagagagaaagttggaaggtgaatccagaacagtgttaaaacaggttcaaaaccccaatgcaatgccccagccacccccagaacaattcaatcagaatatctgaggttggacttgagctccccaaatgattccaaagtgcagcagaggttgagaattactgatccaggaggatccagtgtgtgacaattaatctacatattttctgattctgtgcttttagaatctgttctttaattcctgcttcaatctgtattgtacagagtaaaagggcaatgggattcttaatcttcttgaatgacaacataaaatatatctttataataccatttattattaaaaagaaagagaatgcgtgtgagaaggttttaataattttctcctgtaattattatctaagcagaggtcaggaaactttttgttagggtcaaataggaaatattttaggctttgtgggtcatatggtctcagttgcaaccacttagctctgccattgtggcatgaaagtagccatggacaatatgcaaatgaatggttatacctatgtttaataaaaccttatttataaaaacacacagtgggctggcaggctggaattagcctgtaggcagtttgccaactcctggtctaaggctgaagtcctcaatgttggatccctattagaatcagctgaggagctttaaaaaaatatcagtgcctggatgctactctagacaagaccagattttctggaggtagatcccaatggttttgagatattcctgattcagaggtacctggcatttgtagcaaagctaagtcaatagggaagcattccaatgtgatggggagaattgacccccaaatcaacaaaagagtatggaaagtaaaggaggagaatagagaaaaggcatgctgttcaaatcctggcagcaaatgggtcaagaaagcagacaaaggccagatcagagggacaatgacagtgctcttggaattcacaaatgatcacgaggcaagggaaccaccatggagagtcctgacatgcggttaagagaacaaaatgggtctcgccaagaacagtatcccaagaactcagagcccaggttccttctgtccactgtcacttctgatgcactcaaagctccttccacagggatcctcttacctacacagccttctccatcaggtctccgctgatacccgggtccacagatgcacatatatgtgccaatgaggttcttgcattccatttgtttttcagtacagtcatgttttccctcttcacactcatcctcatctgtaaaaaatgtacaatcacaaatttgtcaaagaaaatgcatatatctgccttaattacctgacttttaaacataaaatgttagtaagtaaccaattttcatctgttatttcactactggctgtatttccttctgctctgttgagtatgatctctaaagaatggaaaggaatcttctaaccacctttgaacttgaagaaattgctccctaatcaactgatgacctcttcaagaagcatgattctgatcatgccttttctctcttctccttcccttattttttatttatttttatttttatttatttatgtttttgaaagagtctctctctgttgcccaggctggagtgcagtggcccgatctcagctcacttcaacctctgcctcccgggttcaagtgattctcatacctcagtctcccaagtatctgggattacaggcatgcaccaccacgcctggctaattttttttgtatttttagtagagatggggtttcaccatgttgtccagtctggtctcaaactcctggcctcaagtgatccacccacctcagcctcccaaagtgctgggattacaggcatgagccatcgtgcctggctgtccctttatgttttatactcctttgttgaagcatgatttctaattcttgttgactaattgaactaaaagggcctcatgtaattataatataatggatatatcttaatataacaataattataacagcattataatcacaatatatgataaggcaataattataatagtactacaatcataatggattgtaagagtaacaaaccaaagcttacattatgcaataattataataataacacaatatattataatatgatattattatttttttgagatggagtctcactccgtcatccagtctggagtgcagtggcatgatctcagctcactgcaacctccacctccggggttcaagcaattcttctgcctcagcctcccaagtaggtgagattacaagaatgcgccatcacgccagctaattttttgtatttttagtagagacagggtttcactatgttggtcaggctggtctcaaactcctgacctctggttatccacccacctcggcctcccaaagtgctgggattacaggcataagccaccgtgcctggccaatatgacattatttttatatgataatattagtaaacaggatataatagtaaatgactattttatattatatatctcaaatatcttattctctactggttcttccctccttcatttccttttctggacttggttgggccttcctcagtctttactttctgtcctattgtacttctttatttttctatctttcccgtttacatgctctgagctgagaaatttgaaatttattctgcatatgattaggacctttcatttaggaaatttccccacccttaagcaaaattatatttacgccatcttgagagaacaggtgtctgttcatttaagatattgacaggagcaaatcagagctcttcaagagcaaactctatgattactgcagtttgtgaaatagagcctagttcagtgcttaggaaattgcaggtgttcaggaggtatttttaatggagatggtttagctaaagtagattccacgtgttaccccattcttgaaatagaatatcctttggtgttctcagagcattttgtatatataatcaccatagcatttatcacactgtattatgagaacgtatttatatctgtctcaatctcttcatattgggttttttgaacgtggggaaatgtctttttctttctattcccatatcttgtagaaatactggcgtgttgtgagcatgcgatgcacagtgagacctaataaaggatgtgcagtgcagtcctcaacttggcttgatgatgcttccagctacaatttagggggaaacgtggcagtgacaacccccgtattgtccacggactatttatattccaattcccagccttctcctactaagggaagctttgagggacatctcccctcacagataaagcttcctggcttagatgaccttgaacacgatgactcacctttgcacatcctacggtcttctctgagcacatatcccacgggacatttgcattcatatgacccataagtgttcacacatcggaaggcacagagcagaggattctgggcacattcatttatatctgcagcagaggagagtaagtaaataagggatcatggacagcaacaaaagggaacctaccaattgaactaaaactctaaaactttaccaaaagttgcaatgcttcattgtcataaacatggatggatcaagtggtctcccatttcccggaaattataaaatgggttgattattttatatttggtataaacagagtgactctccatcccggttctcccagcacagtcccagtttatgtttgttgtcctggtataattattaatgattatttaggtggatgggaaattacaggccacccaacatttgaggggctcttctgaaattttggcttagaaggctcaggttgaccatttgtcactcccaacagttacatggcgtgggaatcagttttgccccattccgccaaaacaattgtggtcagaacagaaaccaactcctccaatattgttaaccacctctctttcccccaaacaaagaggctcctgtgaaataacagcaattcttctgcccaagcaaatagtgttccagatcattttatactgacagagacactcagtttacacagatgcccatgttcaaaccttaaatagatgggaatgagtttactgttaatggaaaaaaagtcatttctgcagactgcagagtttggaaccatcagaatgtgttttggaaaagcaggattaaaatagaccatctcaactatcatgttgctccccaaggccagtgctgactaagaacacgagtgagagcccagatcatgacttagtcacaacctttaaagatttaccacaactctgacaatgggcatttgatagatcatatctgatgaagagctctctttgctaccaactttattctctgccttcacctctccttcattctttccttaggccagtgaatccctacttgagagtgtatcagatcacctagagggctgctgggctccaccccactctcggagtttctgatttaggaggtcttggatgaggcctcacaatgtgcatttctaataagttcccaggtgatgctgatacagctgctcctgggaaccaccctttgagagccactgctctagacactccctccctttccttctttccatacattccaccaggcttacggatggacacttttcagatgcttatatattacaggcaaccgcttttgctgtgattgcctccaaatggctacaggatgatggtgggtatcttagtgtgcagtgctcctagaaatagaaaagaagagaaaaagagaaaagaaaaagaaagggagtatgagagacagaaagaaggagaaagtgagagtaagaaagaaggtattaaacaacacggaagcatctaaatataagtggtagggaaacaccaatgagaactctctgtgatatacagtgtagatgtgccatgaacacacaactgtatcattcttggatatctctctttccctacagagaagaggccacaaaagaagaatgatcaaatggcccatcaggcctagatgatctttattatatacaccctgagttgtatttaatattaagacttgtaatcaaccaattgttcccaggatcagtacacgtaatcaactgttctctgtttaagagatgtaccttcacatgtcatcattggaccgggctcaaatccctcctcgcaggtgcattcaaaacctccaatcacattcttgcaggttccatttccacaaggattgccaacagaacattcatcagtatctgcaagaaaccaggaatgtgtccaaaacatgatgaattgagataataccttttattctatcagaggattttaaactgtaattttgttgttgttgttgttttgagacagagtctcactttgacatccagactgcagtgctgtggcgcgatttcagctcatgcaaactctgcctctcaggttcaagtgaatctcatgcctcagcctcctgagtagctggaattatgggtgcacatcaccacgctcaggtaatttttgtatttttagtagagacagggtttcgccatgttggccaggctggtcttgaactcttgacctcaagcaatctgcccacctcggcatcccaaagtgctgagattaaaggtgtgagccaccaagcccagcctgatctgtaatgtttaattctcattctgttcttgcaaaaagggagtgtgcatgtcttattatctcaggtttatagccgtgaaattcgacttgctcagtggcagtggcaatgacagtgagaatgacagtgcctggacatatagcccttacagtgctcttctccatgagtttctccagcctcccacattataaactaaatcttctacttggagtagatgctctaagggttaaaaaaaaaaaggcccctatcactcgtcaaaagtttctgcttgtttaaagcagaaatacatccacagtttggccttacattacatcactccccaagaagccttaaacatgatggatttttgccagatataaaataaaagactaaacttacgtaaaataaaagaccagaggttaagtaaaattaatacatcaaataaaatcaagattcaagtagattgtgttgattctgttgaaaccagatggtttacattaggaagaggaaaggctagaaaaaaatatgtttaggttatgaccgctctaaaacacaggcggagagaacaaatctttgaccagagacctaaaatgtgtgtgtgtgtgtgtgtgtgtgcatgtgtgtgtgtatatatatgtgtgtatatatatgtgtatatatatgtgtgtatatatatgtgtgtatatatatgtgtatatgtgtgtgtgtgtgtgtgtgtgtgtgtgtgtgtgtgtgtatatatgccttctaacccatccacctagaatactcaccattcttattctgacacatcccttggggagaatatctccccttaggaaagaaataattttgagaaataacattgatattttagctatctaaggcacagaagagtaatggctcttgtcaacagttgtttcttgtgctgaggttcttaagtcaaaagtaaaggcaagaggctatggtggggagctcctaggcgaagaggctcatttcatatgcacatattagcactaactgaagattctgaggagaaaacattgaaatatttgcttttgttctactataatattcaattactgtcaagaatattatttctgtttcaagttaataaaaatcccgataccattgatctttagagctgcaaaggtaattagaaatgttattttacttgcataatattatattctaaggcctagaaaagctaaaaaaactgcttaaactcccacagccatagctggagctgaaatcttcataacctgatttcttgtatggaaaaagtactttctaattcacacagacaaactctcagcatttatgctagtattaattatgttatattgaatcactctggaattcttagataactaaatatgatccttggatttaagttagagttagtgttgattaagggtcaaaggccagccagaggagccattatttgacattttaaaaacagggttacaaaaaaaagattgtgtactggttatatagcctttcatcttactaaatgtaaaagaatccagataaaatttttatttgataagggaataagattatgaccattaacaatttttaaaaaatttcacaaagactttcattatgatgttgtcctttctagtatctcttctgatatgtccagtgtctgccttcaccattaggctgtaaggtccatgaaaggaaggaacttgtctttgtggttcagtgctgcagctccagagcctagcacagtgcctgggacctgatggtgactcactagtattctaaatgaatgatgtatgagtggatggataaaacttatttcagtgccatcttggtacctatattcatggctatacagtgaatactgtatagcttaatttttaatttgtaaagttcctatggaagaaaacttattactcacctacacattcattccctgctagaatataaccaaagggacactcgcagcgataggaaccatctgtattgatgcactgtccatgtttacagacatcgggttctttgcattcgtccatatcttaagcaagagaaaaaaaatagtgaataacaaggtattttttaaacgtgaagataaattatgatcatttcagtgtttaatcaaaagattatctaataatgcaataatataattgctatctaaatgaagggacaaaaaagtagcacttaattttccaagatagatggagaaaaataagaataactagagaagaagcagattgagaatactgagaaatgctgagaatccagcacaggcaactgaccaactgctgaatcatcaggtcccacgatgatcccacttccataaggacatatctggcggaaggcctctgtggtggagacactcattaatagatagaacaatagcaattcattacaagcttctccacaagtattttgaggtagaaaattgctacatgctgtgcatattgataaatgatggaaaaaacaagcccagaaaccagaggaagttatttaacgagactccctaagatgttgtgtctactccttgggcatctgtgattcatgacataattaaaaagaaaataactaccaagctcctgagataaaataatttttaatgaacattctaattagacttacaattaaattaaattgtgttactgtctttaaggcctacagtcttacttacatcatggccagtctgcaccctgcatggcccagagagaaatgcagatgacagacataccatcaggttccgtggggcagagctcgcaggggtctccccagccttctcccttcaaggcacagcagcattcctgcttggagtgatttctggatttgggtgatgaacactttcctccttcaaacttcgcataacagtagctcattcgcaaatctgcagcataaatttatgacacccttcagttgctttcctactgagtccgtattgcaccatagcaaataaagaacaacccactatgttatatatgttctcctctcaggaccacagcaatactccttacgtgattctaatggtaactgagctgagattgttaaagtcatgggtatcttttgtatagtgagatctgatgaacaactctatgaacttaaatttattacttctcattttagtcactatttcaaagtaacccgatgtgaatccaataaaatccaaaactgacagttttcaaaactgacatctgtcagtgacttcaggattggaaagtccacagaaggaatcattcacaagattccttcattgatagctctgcttgcaatatcatgtttaatgagcacactagagtaagagaatcctcttagttctaatatttactgtgatatcacactttgtggtttattctgtgtcccctaaactctggaactaaaataaaatcccagatcacaggcacagaacaaatacagaagtggcaactttgtagatgggcaaaaatacaacacaagggttggtcactgaagcagatactcccggagatgctggctacaaaatgcaagtggggctttttgtagattttacacacacacacatatgcagagctgtgtcaatgttaaatttttaaaagaagcttgtttagctcaacacagagagggaaggaagaggagggcagggctgtgggtgggtgggaacagaatagtctttctttgaaagaatatatttcaatattgattattgctttgatgactccaacaaagaagatgggatctacttcctataaaattctccaacattgcttgacataattttggaaacgggcttttccatttctcatacaacacattgactccaaaaagtgagctcaaccagaggtatggactgtgttttccctcgaacttgacttcttaaagccttccaaaactcctctcattacacagaggccacaatctgcaggtttaaaagaaatgctttcatacccatattgtactattcttctttctttatatctgaccacctctgcctttttcattcacttccatcactgtttttcaatcccaggaaccatactatcataaccacctaagcacttctgttaagacagtctcaccagcttttatttcatgacaaagaagacaatgtaggaataacagagttgccagagataacaaaggaaaggttttcatgaattaaagtttctatctatctatctattatatttaccaagttatgtaaatcaaattcaggtagcctccccagtaaacctgctcaacctttcatggctaccaactcatccagataaatcatctctctaatttctattccacttccccatctgttgtggcaaggacctggcaagcacctttcaatgaattatccttctgaaggtcaagagcaataaaagtcaatcctgcggcatctctgccacccaaatgtttgctttgctgagaaacttcaagactgaacaaattcttgtttcttggagaacacttttgatctcttttattcttcaagttctttgtcacatataatgttttgtatttatcagtcttgtttttgttatttatgcctccaactacctttagatataattcagtgactactcacaaaaatgtctcaacaaatatatgaaaacttaactctgctttgtcttccagtttgtagtgtttctttaaatatgtatgttgtaatattggtgtattaaaattctcattctcttttcctttaatagctgacttcgtcccagaccccagctctatctcccccacaccactccaccccgaaaaaaaaaaatcttggcattagacagagactcaaatgcacgaagtcttgagtcagtctaagtggcaaattctcttcgttgaactttgcaagtgggagtggctcatttacacctgtggtcttttgtgccaggctctgtccacctgagtcccatggcattcgctttttaaaaaacattatccacggttctgtggaattttctcatttcatgagcaatagaagtctgactcctaatttgtcatcttacaagaaaaacccagctctcaatttcctggctccagcaaaatctgtgctctgtaggagacttactttagcttgtggtgattctctagaattggcttattaatcaagggtgtcttgcattggggaagagagctgtgcttgcccacatacttcaggactcactgggatgcctgtttaccagtccatctgcaaagagcccttaatgacctcgaaatttcatcagaactacaaaagtcactttccctgcttgcattcctcagttctggctctgcctcctggagctgagcatgtggcagggctgctcacagctgggctgattcttcctgcagcgttagcttgctctgtgatgggccagtgcaaattgaattaatagcctaggagtttcctctggcctgccacatcggcagattcacacctggtttctcactgctttctttccaaattcaggccaagccaaaggcacacaaaaacaagggagtaggagttagaatttatctgactggtctgtaccatgcagaatatctgttcgaattaagcaccaccctgaaatccacacagaccactgacaactaccaacaagctgaaatcaaccggagaactctcaaccctctccttcttacttcccaaataactagttgaaaagtaaaaagttaatcagatcattagaataacaacaagagtctacaaaggactcagaaactaacaaagctttgtcacagtaaggctggttgggcagatattattgttgtttaaaatgaggaaattgagcttccaaaagattaaatgacttgctctagactaaatatggcagggctgggaccccaaactcaattttttgaaccttaaatgatatccagtgcctcttccatatttggtaatacggaagcaaaaccaaaaaaccatgaaaaaaaaaaaaaacccaactcaacatcaaaacaacagtaacaaccaaacaacaaaagctacaagtggaaaaaaaagaaatacatgtgtttgtttcatctcccttccccggaattcatgaaactagtttgtgtatgtagatatccatacacaactgtattgtttagaaaagtctaaacagttttctgggacttaagtacatactgtgttatgccaaagttcaggatccttttgatttttgtttaaaatttgaaagtcattggcaaacccttgaaaatctttactcaaatagttgacaagtattattcctaaaaatgaacaatggcccagcaagaatcctgatcagtttaaatttatttttgttttcttggagaatttgtgatataagggatggttaccatattgtgggggcaaatgggttaatgtgcagtttttcagtctcaagtctaactttggacccacatttttcagcttatctcttcagaggtaggggatatgtagctcaacttcccccaggctttgctgtttcggtggctcaaggtgtttccccactgatgggcctatcagcatttgtgttcttagtgggagagaggtttatgtgtcagtacaattgtataagcaaccataacttgatggatgagtttttaaccttaaaagtgaaaatgaaccttctgacatatggttatcattagacctctgggtgaatgaaaactctccatcttcctgttcacaaagaaacagagctttgccatgtttgaaaaataagaccaccacaaataaacatgcagcattgaaagcccaaagccttcaaagacacttaccttggcaccttcttccactggaggacaaggaaaacccttctggacacagacatttgaagctgccttcagtgttactgcatgtgcccagggcacaaatttctggctcttcgacacactcatcaatatctaaaagaatcacatgagtcaaacaaagtcaaaacacgatggagacatcatcaggtaccaaacacacaatgtggacacacaaagggcaactgagtttccaaactcttacaataataaaggtatttttctgtaccataacactgtggactggacttctaggttgtcatgacttcaaaagaattagttttgacagttattgatataaaaatggaatgtgcaactgccttctaaggggtgcagtgacaaacgtctcttacccagactgagttgcttggctaactagaaaagtcagagtaatttcatagtaccctaggccaggaaagaagcatgaaattctagagtcacactgcaccattgttcaggaagcagaaatgctgagactttaagcacattgctagtgactcactcaatgtgagatctaggcctttgatccaaatttactcccctccaaccacccacagaacttttcccaataccctatgctatagccctaaaactgtgaattttacaagaacactaagactcatgaaaataagtataatcctatgaagtgcaaactaacgatatcatagaagatgacgctcctgatttgtgggttaatctttctgaagacacaaaaatacctttcttgtacaggctttttctttcatcatatagacaataggaaactgtacacttagaattgtggcatgttttctttagtatattatacatcttagctcctgtacagtggtagttaagagtagccaataagaagtttgaatggcttgagtaaccatatgtcctagtttgcctgggggagccccagctcatgccagttggcctgactttattgttaatagtgcccttttctactttcaaaattggcttgggttggtcaataaaacatacgattacctatggaaaaatatgcccactctattccaacaaactcacttatctttcctcctgactttcagcaggaatttttagtgaacaaagtggtaagtcttaattctgagccatgctacttttatgagaatacttttttattttttcaacaaaacacaaaatatccttgtatcctgggctctttatttttatatttgtgcaaaggtttctactcacaccaaaatgtacttgcattatacaactttattctcaagaggcccaactaaggaaaagttgagaaattaaccttattatcttgacttaatattgtaaataccacacaataaatattctagaaatgtgcaatgccaagtgattctctttctgtgcaacgcaaaatcagcttctccatcatgccatgttattgggttgcatttatacctgtgttatgttccctgtggtttattaatgaatctgatcttctattgccgattgaattactccattctgacactccttccacccctatatccaaccttttcttaatataaaagttaacttttgtgaaaatgctcaaatgttttcagttgtttttaattattactatgactatttatattatggtagaaattagcctgtacatgccaacttattaggatagggccaaatattgtagaatgggcacattcattgactgtgcagttatttttctttctatatatattctgttcaatttagcgaacttatgtattgataataaagccaatttttaataaaagtaaaataacatgcttaaaaaatttgcatctagacaatttcaataaggtgtttccattttaaatatcaccacttgattgttacttaaattggatatataataaaatttctaattgacgatattaaaagtagagaaaattctcattgtggattagatgcagacctgtttaaagtcaggggtgtgaactaggtgacttcttgaaaatcctttcaaccctacttatttatgaaattctagcaattaatgtccttcacttaatgatatgacatatttgttgaggttaaaggaaggcccttgggaggctgaggaaggaggatcatttgaggccaggagtttgaggccagcctggcaacatagggaggccccatctctacaaagaattaaaaaatcagccaggcatggtggcacatgcctgtagtcccagctactccagaggctgagacaggatgatcacttgagcccaggagttcaagcttacagtgagctatactcgtgccactgtacttcaacctggtgacagagtaagaccctgtctccattaaaaacaaacaaacaaaaaggaatgtaatactgtaaaatttgctgagaatttatttgaaataagacatttccactgctctataggtaaaaacaaaatagacaaacgatataaccacattcatccaaccttgaatgtggtcatttaaagtttttaaatggaatcaggagctatttttagctgcaaagaatcgccacttaaaaaatgtagttcggaaatactgggagtaggacacagcattcctaacaaatgtgtgaaagcacagtggaaaagagtcaggatcatatgatcagtcatatgcacagaacaaaataacttcattagagattagcatgataattagtgcttcttgtcttgccagaaggatgagaccatgtcatacctatgcccttgcatttgtttctgataaagtattccaaaatgaagacgtcattacaaaaattctcattctgctaagtccagtggacacccgacactcctcatttgctacaactgatagctttcctaccttcacacttctcattttgaagactgtatccaggtgggcaaatgcatctgtaggacccatccaagttttgacaggtacctggtgcacattttctgggttctagaagacattcattgatatctgcaaagaaaagggaaaaataaggaagaggttcccactggcatgacttccatcaaacaattaaaattcaaaaaaactagaatgaatcaaagaaatacataaagcaaattaaagttcataaaattccaccatggagaaaaataagcaataataaaaataagctttatcagctttcaaaaatgtatagcataacaaccatattttattttacctgcatcaaattaaatgtttccagaaaattgtagcatgtgaaaagtcagtgagtatatagattttaaggatactcaaaagatatgagagcttactacaaaagtattttaaagaaaaatatttaagaagggaaatcacaattgcttacagagcaatttagcaatttcactgtttaatagtttgagtattcttggtgagtacaatagcttaatttttaaaataagggaaaaagtgattatatatatatatacacatatatatatatacacacacacatatatatatacatatatatatacacacatatatatatgtatatatatatacatatatatatgtgtatatatacttaaataaaaacaagcctttatagggaggattaatataattctactctgacttttcctccaggtttccagaaagaagcattagaacagagactgcatgattccttgagtggtctctggaagcattctttccaggtctttctaagtcctgtacttacccacacaggtcctcccatctggagccacctcatagccttcattgcactggcactggaaagaccccactgtattaatgcattggccatttctgcaaagattcccatttccacttgcacattcatcaacatctgcagaaaaatccccaacaatcctttaatatattccaaagatgtcataatcccagcaataatcaaaacttctaaaagaaaaaatactttttctgaattttagtggcctttgctggcttagccaaacaagaaatgccaatgaagatctagtttgcaacaacagaactggctttaagcacctatacacatttaacaataagattacattattatattagagactgacaatttacattcaaatttcctatcagtttttccttgattttcctttagattttatttttaaattttagatttaaaaattttttgatttaaaaaataaaatcctaatacacaattcagctaagggcattcctttgtattcttgcaattagatttaaattagcctatagcacaataaaatttaaagaatttggcttattactcttgcctagtatgttttagaaggagattctgtagattcaatgatttatttaagagaggctacatgaaacatctagaccagaaggttcatagtcctgaatcatataatttctatacaaagaatcacttttgtatatttaaaaattttttggcttaatctaattccatttattttgaaatttatttaatttacagcaaagtagacataaaaattatagctgctaataagcattttaataaaagtaatggatatagttacagtggttccctcttatctatggttttgctttctgggggttcagttatccaaggtcagctgctacccaaaaataggtgagtatagtacaataaaatattttgagagagagagagacagtgcacaagaaagtacagtcatataacttttattacagtatactgttataattgttctattttcttattagttattgatgttaatctattaccatgcctaatttataaattaaactttaggtatgtatgtgtaggaaaaaacatggtatatagagggttcagtactatctgtggtttcaggcatctgctgggggtctcagaatgtatccctcacggataaggggagacttctgtaatatatttcatgttgagcacattgtatttgacaagtcccataaccaattgttatgcataagatagcatacatttttaaaagacagctggaacactagagatgatgctaattacaaagaacacatataaaactgacttcctttgctgatgcacaattttgcacacgcacctatacagtcattgttgtgagaaaggatgaaaccatgattgcagcggcagttgaaggaaccaattgtgttccggcaagttccattcccacaggcatctctttcacattcatttatgtctagtaggaagaaaggccataaagaaacataattataagtagaaaaagtggttacacggttacagtggctaaagagcattttagggttcaccaggcctcatccataggctgagaacttcttgatgttggtatcagctccagcagcagtcatccctgcaagataccaggcagcggcaaagctctaaatcttgggaataaatggtttccttggctggccagtgaaaggaggcaagctaaggacatgagacctgaacaagaattattttattctatttacttctagaattctccacccttgccacttttctcaaatattttcacttgaaaatggaaaaaactctgtgtgcatctgggtcttgaggtgttgccacctttggcaaacttcaaccttcaagattctcactccagtttaccaaaaagcagtgactcacctggcattaccccacaatcagcaacaaaataactcagctttctagctcacctgtcatttcagacaacttttcctttttccctacacccataaaaacatagaacaacttccaccaatgatgacttctctcacttttctaaactaccccaaagagatggcacttaatttgttcttttcatacatgcttgcattcttattcgccttttgattggtccgtacttttctctgatgattttgtaaagctactctgacatcttatatgtctttgcatctcatcacagcagctagcatatttcttataaagagtagatgcacattatattaaggaggaagtaataaaaaatttaatgaaagaaagttgttactgctggtttgaaagaatgaggcaccatgaagagggacaaggatgaaatgagagagagagagagtggaaggtaacaacggagaatagcaaaatgtaatgattagagctaggattccctttcttttcacattttggacatgaagataaatgatctgtgattcctgaatcaggaagctattgctaacccaaagggactctaatgtgtgtctgtggttgaagactacacccagatgagtcattgctagtaatcaagaatttttgccttgattcatttttagccaaactggtgaagttctttggttgggaaggttctatgttagggggctccagaaaattcagatgagagatgtagaaagaaagttgggcaggatcatcatagcttttacacaggttagctgcccagtgatgagtagggctgtcagtgctcttgtcattactctggagaagatacaactttatgagaaatgttcccaaatggatgaacccagtcatagccaaagtcaaggacttaaacattactatattaattgttctttcagctgtgaatctgatttatgttcttaatgtcccaaaaagacttaatggtattgctttaaagtagaaaaataaaggaaggaaaagaagaaaatgattcattacacactgaagtttattctaaatcagcatcctgataatagagaaatcaggaaagagatttaaaatcctgagctctttttcctctagaaaaatgattaacttttctttgcctttgtaggatttataaatttgcctttgagaatctggtacacactataaacccttccaaaaaaatggtcatctcacactcaaaaactcaaaagaaaatccacatcaatattacatatgaataatagcctattaacattaatatttttgtattaatatctttttcaatttaccccttagtcaattttttctaaactgacagccaaatgaataacaaaggaagaggtttatcatgttcagattgccaaagattaaataggatatcactgctgcatatctgtctgtgtttttattttgtatatagcaaaaatactactaaaagacttagtattaaattttatccatatttagaatcaaatgaagctttcaacagcatatgaaaaaaataataataattgcatacttacccaagcacatggtttggtcatcatttgttttaaaaccagtgtggcaaaggcaataaaagcttccaactgtgtcaatgcactgcccatgactgcatatattggggatttcttgacattcattacgatctgtaaataagaagcatcttaagtgagaacttagaagacaaaatataattgaataacttacttctagctatcattctcaggagtaatcctagctctaaactaagttagtgaaacagatatatttatttttgcatcaaaatggattaaaacttactctcatttaccaggcatagtcagagtatgttaacaatacttgacacaataaaaaataagggtaagtaatcaaaaaatattctgaaagatgagaaaacttagaagtaaaatggggggattcaagccgggaggattttctgtttgattatcggcctacgcagcaccacagactgtggaattaattgaagtattttgtctagttaagatttggtgccttaagtcatggatagttcatggcttcctttgtaaatttatatcaaagtcaaatcctatgactaagattaagtttttcttgatggacaacctacatggctgcttgttcaagttgcatctctttgttttgtcttatgcctgtaactttttgttccatcttcaccaagtattcacgtctacacagggctccttttagcatgtgacaacctgaacactgtctctttctttttactctcatccattcaaaaggaagccctctcatcttgcttctgccagtctttaagttctaaattatatttatcatcaactgaatctttgttgctttcctgaaatctgattatctgaggggcagaatttaatgcatgaattcacatatgacataattatatgccaacttacgtctctaattttttaaagctctatgtttagagtaaatgtactttgaagagcactgtgccattctgattttcctactgtcacagaagaaagcaaatggagtgtcatctttgctgcagatgctgtagggcagatggcatttcgctcttagttaaataatccagacttgccgtttgcctgcaatgtctactcagaacacagtaatcatgaatggacactttttgctgcacacagcaaccctccctgtgccagaatcatggacatctcctccatttcatgtgtccgggatgccactgttatggttatctcctatttagtagatgaatcatcataccatttagaagttccaagtgaagtggagtatatcattatgaggggaaattgaaatagagcagcttaggaactactactagcctatgcagaaatgctatttaacaaattatgattattcccttttgagaaaatgaatttaaagtgagccaactgcttcccagtataggcagaggagactgatttccgatcttgaggaagggtgtctcaggtcctaccatagttggcccaaaactttggcaccttcaggtaggactggacctggaggtatgcaggggacgaggtctgtctcatatctgagttccacaaggaaatggagagccttaaggatcttattagaaagggatccccaattaggaatttcctttcatctactgccctatttcatgatggtttaaataaatgaaaaatgaaacatggggagtactttggagttctactggtaaaactagagcagaaatctaggtttccacaagcaccagaatttgaactcttagatgatcatatttgaggttgggataggaggtctgaacaggctactgtggaaagaaacccaaatagtcaacagagaaagagaggaaaccacaaggaagtagctgggaagaaactgttccttgtcttttgtggggcaagacatttcagaagggggttgcatttgttctaactatccagcttctgctgtcagactagcatcctgagctcagatatctaattattctctcagctctctcagcaataatgtgggtgctatggccaggtgtgatttgggatttgaaataatgtgcttatgaattcaaataaggatctcatgatggagagaaagttttagttattttcattttaaacagatgcacaaaggagtactttgcagcatgcctgaaaaaaaaaatgccaagtatagaatagcatttaaagatattttaaaagtaagacataaataaagacatttctagaatgaggtcttcaacccaacaggctgaatggttgcaaaactcaagttaattccctttcttctgaggatttcaatgaataaaggaaatcaagcttttggctgcaaatgatgctcactcacaacacttatggctggctgcattttatgtatgatagtctcctacaagaaaacagtaaatgacttaagctccagcaggctatggctgaatgtcttatcttgatctataaatagctctgtcccacttcttacctgagtgtgaaatggtgtgaaatgactcattctatattatcagcaattctttattttgactggaattatttcatccagttctaaagaaatataaattatgagcaaaatgcagggaagtggtatcaatgccaagtttctctagggtattgtggttcatatcagagacgtccctgcttttcctgtcctgtatttttaatacatggatagcaacagctctgttgacaaaatgctaaatacttacacattttcctttaaactcaacaaaacaagtcttgattctcaatgcgatttttttgtttggcaattacaccctcttcccaccaaggtctcataaaacaatgcaaaataccctaaagagaacagtgcacttcctaccacttaatcactggtaggcaaggaaatccaaggaaaatctgaccacgttcccctgtgttgtttcattcacaaatgcataaaatatccaggaaaccccccgtgaaatgaaccgtgagcaaaataacacattcttcctgactaatatacaatgatttgctttgctaaatatacagtgatttttgctaaatatacagattcagaattacttaaaaacttacaagaaaatcattctgagatattattttgtttctgggctgaaacagcagtcttttaaattttcacaccactggctacaagataccatcagatactgaataacttcaccgtacactgaagttgataacatgccaacgtgcttcctatttctatcacatccctgacaaaagtgaacaccaaaaaaatctaatctctaggggtcatgggaataaatagctaataaaggctgttgatgtttgctgccttcagtgagtgaccctttccctgtaagatgactgggaagaaaagcgatggctttgtttgttctgtttctgcagattaatctgacccagctcaggagagcttcactgtctagatttggggtatgcagccaagatggtgaaaacctcacctttctgagagggattctgtggaaggaaaaaaatcatttggtcctaaatgttgcttaggggaatgtgtgtatgcataattgtgtgtgtgtgtaatgtgtgggggtgagtgtttgcaggcagggcagcagacaggcaaatacgaaatctatgtatgcgaatgatttacttcttgttttgaaaatatctcatccagaaagaggattaaaaagctaagtgtttagatattttgacaatatccctttttccaatttagtttaatattagagttcatcaatctaaatcttaactcatatattcttcagcttaactatctgaaaataaatccagatatctgaagcttcatgaagacaaactcttgggtaggcatgtccagcctgtggggcactacataccattgcactgtcctgtggaggtgaagcggtagccgggcttacagtcacagcggtagctgcctgcagtgttgatgcattcggcgttgcgctggcacactgggccgttctgacactcgtcaatatctacgagcagaagagaactgaatttgaaggagaacagaatctggtgtccagtcaacaaagcctctcacatgaaaacaaatttatattttattttgatctgttctattgaaaagacaacatagatgtgtacagcagctttatttattgccagaatttggaagcaaccaagatgtccttcgataggtgaattaacaaataaactgtggtacattcagacaatggaatgttacttagcactaaaaagaaatgagctatcaagccatgaaaagacatggaagaaaattaaatatggccaggtgcggttgctcacacctgtaatcctagcactttgggaagctaaggcgggcggatcacctgaggtcaggagtttgagaccagcctgaccaacatggtgaaaccccgtctctactaaaaatacaaagttagctgggcatggtggcgggcacctgcaatcccagctacttgggaagctggggcaggagaaccgtttgagcctgggagatggaggtagcagcgagccaagatcatgccattgcattccagcctgggcaacaagtgcaaaactccaagtccaaaacaaacaaacaaacaaacaaaaaataaaacaaacaaaaaaaaaacacacacaaaaaaaaaggaaaaaaaaaggaaaaagaaaaagaagaaaaaagaaaattaaatgtatattactaagcgaatcagaagccaatctggaaaggcgacataatgtatgattccaaccatataacattctggaaaaggcaaaactctggagacagtaaaaaatcagtggttgccaggggttaggggagattaggggatacacaggcaaagcacagagaatttttagggcaatgagattattctatgaatagttatggaatggtggatacatgtcattataaatttttccaaacccatagaatgtacaacaccaagagcgagctctaatgtaaatcatcagagtggactctgagtgataatgatgtcaacggagattcaattgtaacaaatgcaccactctgatggaggatgctgatgatgggggaggctgtgcatgtgtaggggtagggaatatatgataaatctttgtgccttcttctcaatatcgctgtggacctaaaactgcactagaaaataaagtctattaaaaaaaaaagaaagaaagaaaggaagaccgaaagtccattatctaaactttcccacttagtaatatttataaatgcaaggcttgatttatgaccacatatggactctaatgatgctcacatctaaaaaaaagtcatgaaacttggctgctagggccagcacttgacatgggtatagattaatatcctaggaagccttgtatttactcaaagatctggattttatgattcaataaggttgctattgtctgaaaggctgcaagagcagaatgtctcaaatcttaaagtccacatgaatcacttgggatcttgctaaaatgcagattctgacttggcatgtctggaaaatggcctgagagtctgaatttctaataagttcccagctgatgcaggtgctcctggtctgtagagagtgctttgaggtacagggctgtaaagacacctgctcaaattactaccacaaggcaatcaaatcaagaaaacctaacatgggagttatcataaaactactgaaaacaaaccaactctcattaaaacagaaaagattttggataatggatattgtgtgttccagagttttgactttgcttagggggttgtctgtctacaaaacaaaacaacaacaacaaacaacaacaacaaaaaacagatactaatatagttcaaattcatggcatcacaaaagttactacatgtccatgctatatcatggggcaaaatacatgtttccctcttccctgctccagtggaacaatctaatttacagactaagtccaataaaggggatggcctataacacaggtgaaggttggcccttagtaccagttctgggcttttacacagaagttggctcgaccaaagaagttcctacaagggggtggcaaatacatcagccgatgcctcttgggcgtgattctgtggtggaaaaccctcaggactgtcagtcagtcagtgggggttcctgtctaaggcaggtggattgtgcctctctgggcaacagacacaggagcaggagtgtgtctgccttgggttacaagggacccagcaccacctcactcaccaggtctgccctgctttgtattcaggatgtatagaaacacagggggcagattgcgccactggagaaactgagtagtgtcacagagaagcacttctatgatgtggcatctgataatgtggctacttggcaagagcagaggcgtggaagctccctaaatcacctctacaatccattccaatttcagcattgctgaggcatgtatgcactcaaccttcattttcctattctaagagctaagagtatgctaggaagcagctgaccctggattaaacattcaccctgaagacggatattctgtgaaatggaaatcagaagttggagcacttagttatctcaatatccacagaatgctaccctgacagcaaaatgccttgcattggtacagttgcatgtgtttaatctcatggatctagcaaggtctaagttgacttggtggtcatgggtggtcttgtctatgggttctggccaaggcctgcagcttcagcaaatataagtggttaaaaggtacctgggtacagtcatcatcaaagccatctctgaggggaagggtggggaggaaaatgccacaggcaggtggcaggcatgctgagcatgtttgagagggggaaaagtgcggctgtgagggaggcagccaactctagcactgtaagatcatctgccgtgggttccctctcccacatccatgcttcctctccaggtacctgatccttgatggcttcccagagcccagggacttgggccaaggtctgaactggctatcttcttaggaaggctcggaagggctattaccccattcccactaactcacacagcaggcagagtaagggacatgtgcccacttggacacagtaactgaaagcctggtgacaggaacttaacaagtatgtggttaggactataactttacttgtggtatataagttgtcttcagtatagacaaaaaagttttttttttaacattaaaatgttgacatatgtgctataatacgtgctctaaggggtaataaccctttctaacatgaataaaaattctgctagaggcctgaagtgtaagtattaaatagaaaattattccaactatcctgggcacatggtatatttaataaccagtaatgtcccttttactaaaatgtaagagaactatctttcccagatgcaggaaaaaatatgaagtgctataaggaatgctccgaatcacagtacatatacatggcaacaggaggtaatttgaaaatgaaaaaagtacatgtgcatgccaacattcttcatataaaatcaaatttgctgttcttgccatttggaattctctcatgcatttggaatatctgcattaaccttgttttcacttgggagtagcaaagtctctgtctggaagagaaatgattttgagagtcaactaggatgactgtccactcatactgattttccagcaatgtgaaacgaaagcaatctatgtgacacacccaggaactcaaagctttttcatatcagctgggaagtctaatattaacacactgtgtgttgggggaaaggggctgggaatgtgcctcctggtttttccactgaagttagtgaattttttttttttgcatgaaatttcatgttgttccacaccatgccctttactatttctagagcttaatgcatttctgaaatttcaatgttgtgaaattcgccaagtgtgtatcaagtagctcatcagttagctcttttctggatatgataaagtcatgatgccacttaccttcacaaaccaacaacttgtcattatagaagaatcccactggacattcacatcggaagctgccaaccatgttgatacacactccattttcacagacccctgggatctcccggcactcatcaatatctagagacagagtagtcattcatgagtgacaggacagcacatgatccctgtgcagggtaagacaagatggaaagtgcgtgcgtgtgtgtgtgtgtgtgtgtgtgtgtgtgcgtgcatgtgttggggtggtggtgatggcaatagggacatcaacgaatagcaaattgagataactaaaccactttccagacatgagtctaactggatttaaatatatgttctgggttttgcttcagaatgtcaattttgtacaggtaggagatatctttgtatcctctgggcactgtggatgcaccagatgagtagaatagagggatggtcaagggtaaacagcctctccacccaagtgtgcctatatttagggaaaaaggcagaggtgagctggtaaagaaccacagaggagcacatggtcatatggaactctgatctttcaaattccagtttaactcccccttcctacttcatgtggctttagaaaggaggtaagtcaggtgtggggatgtcagctgggctggggctgacaataaaaacgaggtcagcaccaaggaagaactgtcgcagtagaatgtgtgcttcctaagactgggagttgggcttggctctccaacactgtgttatggttccttagcactctacatgacaggtagtaagtgctcaattcaaatttgttcagttaagagcaagtgtctggcagtgtgttggtgagcactaaaacaggaccaagagtgagaacacagccaggatccaggctgctaaggcagggctggccagctatggatagagactttggacacctcaccagcttggccatgtccccagcctggagtggtcccatctctgtcttacccactctgaactcctgaccactgaagtgccctctaggataagagtagtaatagtagtaataatggtaatagtattaatagtgacagtatctcatttgctgcatgactggtacatttctcaagcattcaacctgtatttattggctgaattatcacagccaccccatgagatggtctcggtactatgactattctaactaagagatgaagcaagtgaggccaagccacaggatataacctgcccaagaccaagcagccaatgaaaggcagagtcaggatttgacactgggactcagttaacaggccatcctgcctcccttatcatataagggaagatcgtattatggtgatttcctgcatcaccctaatacaatcttcacagaactgtcatcaacacttttgttatcctggagggcccttccatcagccccttggctgggtttgatgaaacacctcagctgggaggtatgcaaagccttggtctacaatccaaagtcttccaattcactagtttctatgactgttgttgagatacgttgtttacttattatagtcaggagcctttgcaaggtacatactttgcttgcatacttgtgagaagatgatcacggactgaagtggagcctacaagagctgctgcaattttagaagaaccacactctataaccaatctgttttaaaggagaaatttgatgtcatagatttattttagaccctttttaaaaaagggcttgattttgtgtgaaggcaaaattgacctatttaatgaaaagaaacagcttagaatctcaaagggttcattgctattttgaatacacgcaattatgtctttagatctttcacacctttgtcattcatgtcatgaaaatgccatataaagttacatcacaactgtgtatcataagtaaacaaaaaacaaattcagatgccattcattcagtgtgggttagaacacgaaacatcatattcacattcgttttaaatataagtgatatattattatcaagtttaacaataacgggctgagtctaatttccagccattgttaggtataaaatagcaaaaggatatattaaaaattatattttcttttcctgtcaggattttatttgaacttcaacttagtgaagtttatattttaagacaagattgataaacatgctatagttttaaccctatatgaatggactccacatgccaacaatcataagatcttccaaaaggagagtataaagcttaaataaaacaaagtttttcagtcatctaaatattttgtcatgctggaatttggtaacaataagcatatagctaaataacagatgtccagttttcaagagctagaagcaaactaagccatgagtcaggactgtgttctggtcccagctctgttattaattagctgggtggccttgggtgagtcccttcccctctctgggcctctgtctcctcaaatatgaagcaaggcatttggactagatgaagtctgaagcctttccagctctcctagtggacaacgctaatgttctttctagtctttgcttactgccaaacttggagggcagccttgctggggtacatgcctggttggtccgtggagaaccactaccattacagaccacttatcttgtgatcacagattctagggaggttaaaagatctgttttgggaaggggaaaaacaaagcagctagggccaggtgttccatgccaatgtcatttagcagtttttctttccaaaccatgaagtttctttggacgtggacgagactgtggagccatatggatttggcactaagggagccaggctgattgctggaccagactcttgttttcttaaacaaggtcactggaaaggctgatgtggattttagtttacttattatgaataaggtggaataaagcaagtggtgatgtttgctactagacacaactgtgcagacttaagagggcatctaaggatgcatataaatcacaccagggaaaaactcagagaatgcaatagctttccatctacttttatgttatttggttttaaaccacaagggcattgcctgcactggctgagtgctgtgtaatacttctgattcttgcacaagcatctctcccaatgttgtgttctctgcttcatttaccaggcagggcctcagaccgaaaagatttttatttcacatctgaaattcccaaagcagatgacctgaggagattccatgtaagataaaattgatccacgaaaggactttatgtaaacaatctacacgtaaggattggtgtgaagtcacttaacctggtcttagtcagaaggaaggattgagaattacagttaaatcaaatgtcaactggccccactcccagaatctctccccatgttgatgcctaaggttggtgtaactatgcttgattgtaattttgggaaaagctttccaatccccttaatcatgaacaacaaatgttgttgccaattaggtggagctgcacagggtgtttgcacagtttgtttcaaactaagaatcagtgtttcaataaagtgaaaggcattgtttaatattttttttcctttaagaaaaaaatgggaactgaaaaaataatgctaacacaaaggcaaaaaaccagaaagttctgacaatgccgtcatgactcaccaacgggtaaaccggtataaatgtcgatgacaaagcctggcctttgacttccacagagtgtagcaaactcatctgcaatgattaaacaaaggtgggatgggaggataggggtcagcaaagaacaataattggactgaaaaaaattattttgtaagcattcttgaaaggtatttgtctgtagtttgaagaatttaaaataaaaagtaaacctgaaaattcctacagatataatcttgcctgtaagacaaatattgaagaaaaaaatgacctaatgttgacgtgataatgaaggagaagtagagatccccagatcacatgccactcattcacatgagtttacctgtaggagtttggatttcaatatggatgttattcagctctgaactcagggactggtaagagtgcctctctctactctgcatttagagatctagggtttgaggaacacgtataaaagccattttctcggtagattataggagaccatagcaaatctagccacattcttgacatcagatctattaatgactaatttgggtcaatcaaccaaccttcaccagtttttcagtttttggagctggatttcatttggtacagctctgtcatattctctccctctccctctctccttttctgtctctctctgtctttctctcacttgaattagtcaaatttaacagataataaaggatgaactaaattctatcagcagtcccttctaactgtgagattttgtgattccagatcatgactgtaactggtaaggtatggtatcaatctaagcttcagatggccattgccttattggtcacgctcagtgaaaatcagtaaaagatttctggaagtattttaatcaaaatacagcatgttattctccttgtgttttgtctccttaatctatgagtgttcacttccaacactgtaacgccagctgacattggtcacctaaagaaattacagggactcttaaaatatgtgcagatttcacagctaatgaaaagccatgactgaatttggtgaatatccaacatcaagaagaaatcttgcattttacacaagagtatgtagatattcaaaactcaggcaatcatttctaaaagtaaatgttagtctacattaagggtttccaaagtggtctccagaggaatatgcaataatccattaggataaaaaagaaaatgcgaggacttctatctatctttggaaaaatctaatctttaaaaaaattaattttgtgtacactttatattagaacagctcagaaaaataataaatgtatttttcaatataattgaaaacaaatacatatacacatacatagatatatatacatagacttttacatataaatgcacaccaggtgtgcataagcttcagattttttaccaacaggtaagtaccacctaaagttgtaaagaccattattcaagatcaagggtcagcaaactttttaataaagggacagagagtaaatatcttaggctttgcaggctgtacagtcagtcaaaactatttaatgttgccatgaaagcagtagtagacaatatggaaataaattagtgagctctaaaaaagttttatttatgggaaacaaaatctgaagttcatgtaactttcatattatgaaatacgattctcctgattttttccaaccatttaaaatgtagaaatccttcttagcttgcaggccattcaaaagtagatggtgggacagatttggcccatggggtgtattttgccaagccctggtctagaaacattttgcagggtggaggtaaatcagaattctaagtggtggttattatattatttctggagtaaacaatggatggaataatacattttactaaaaaacaattttctgttgcatgcaatgtcaggtagtaccaaacaacagatttaatattttatatatcactgtggaaaatggtgtaggattccctttatagaataccctaatcaattccttgcatgataatttcaactaacccaaatcataatcttggcaaatgatgtcatcatcatatacataatgcacagcatataccatatgatataagaacagtacactaatgtctttatttattcaaaggatgcaatttagccttttttttttaagacaaataacattatttagtttctttctccatgagaatataagaagaaatttatctcgatctcaatatcaagaaaagttgcactttcctttcattttgagttttctttatgctcattgagaattttgtacttgatcacatctcccttttcataggagctgctagaaagtttggggctaaaattattgcttatttcaggcaagtgtgtagaattcccggcttgaattttgtgtattagtcctgctcctggctctttcttattcttgtttgccatttgccttatgcttatttcttgtttaacatttacatctttgtaggctgcctttaactatttttggaacaagtttagctttaaataagtaaaaagacaaggaattatgtttcccttactgtcacattgatttgtctaatgtttacagtcttttagatacatgaagaattcagtaacaatgagaacattgtttatagtttatatttttgtgatatgctgagtctacaagtctggttacgtattagggtatacattagaaaacatattctgtgactcagtgttcggctggaatgaccagcaccaactgtgaatttaaatcatgagccgtttttttccctgtaaagataaacaatgcacactttgcttccttcgctaagactgatttccccaacaattcatgggtaatttttcaacctatatttttgataatggagaaactaaaactcacctgtacttgggatgggacactgttcacagggcttgttccacgcccggccaatgttgtaggaacagcagcacatcttcttggtcatgttgaataacaattctccatcacaggtctggttgtcagcatagtagtttctgtagcacaaacttcttctcatatctagaagggaggtaaaaaaaaggattggagggttggtgatgccatgtgggaaatcacaacaaatttctaagtggatactcaacaagcaagtttcatttgaattgtattgtagcttgactttgataaggacacaaaaaacttgctcttacacaactttctagctacctatgctgctacaagataaaggactttgagaaatacattccctgatatttcatgccacagaactaagtcattatatagctgtagcattaataaactttaaatgactctctgcccagtctcctagtaacaattccctactgccatttggcaataagtttctcgtttccgactcgtgatgttttaatactgtaggtcagcactgtaaatataattgtacaaagatacacccaaaagtcaaacaaaagaagtactattaactgttgtttgggattttccaacatacattttagagaaaactcccaaccacccacccgtggtggtgaaaaaatgccaagttatgatttataggggaagagtctcctaacaagacagtgaagggatgccagcactcagtctgatgagtaacatcaccctaaggtgatgaacttgtgagctctcttcctctttgtagatgagaaccaaacatgcattactgagaaaagcttggacttacccatgcaattatttcccccattcacttgcatgtagtctggaggacagatacaggtgtagttgccaacggtgttgtaacatgtccctggaccacagattccaggagtctcacattcattcacatctataatccaaagagaaagtggtatgtgaatatgaaaacttcacattttggaatggcctgatacttaatgaatgttgacattagaggagaaaatctatagggtattttcaaataagataacgaaaataggtatttcattcatccgtgtcctctctctgtgtaaatgtgtgccttttgaggaaagagggttttagaaaaggaactcttggctgggcatggcggctcatgcctgtaatcccagcattttgggaggccaaggtgggtggatcacttgaggtcaggagttccagactagcctggccaacatggtgaaaccccatctctactaaaaatacaaaaattagccaggcgtggtggtgcacacctgtagtcccagctactctactcgggaggctgaggcaggagaattgcttgaactctacatgcagaggttgcagtgagccaagatcatgccattgcactccagcctgggcaacagagcaagactctgtctcgaaacaaacaaacaaaaaacaaaaacaaaaaagaaaaggaactcttgccttctgacatgaggcattatcaaatataataatgagtctcctaataaattaacctataatatcctcaaaggtaggcagagatagaaatgtggagaaattaaaatatcaaatatcccttaggaagacaagtacgcttcttatgctcacaaaatctatgatagggtatatagtatcccgaagccattaacagctggcttcatgaatctgcattggtaaggcagcatggagcatatttcacatcctctccccacttccaaatgaaggagttgattctaatctttgttaactccatgggtcttagagctgtgccatatacactgtgatgttcaactaatactcaataaggttgccattgtctgggtgacctaataagccattaaagagccaggggaatatttcttatgcagagcacaaggaggtctctttcctaaacaattgtgtgattcctccatgtagatgaaaaccatggctcatggctgaagtgctctgaaacctgtaagtggttaatattctccacctttccagtaacacaggatgaacaagggccaccactcatagcataaagccaaagggccgccttctaggagaagcttatttgaatacatgagcaccaatggtaagtggtgaaggattaaaagaagagggcccagaactcctccaaatagagaaggaacactgaaattggacctgtgccattcatgtaaaaaatggcttttctgaagagcatggaaaaatattttgtaagcataaatgaggctatggtccagcagaataagattctgtttttctcaggaaaagagggagatttaggacttaccagaaatgacatcacttgagtaacattagtccaaattgccacatgtgagacatatctacctggctatgttcgtgtttagaacattgtgctacactgctaaattctattttcctagtaaccatattctggttttgcaggtcagttcttgatatctgcaagaccttatcatcctaccaggaccatttaccatcacacactcgtgtatcttcattcaggtagtagccggttggacagcggcactggaaactcccaaaggtgttgatacattttcctccttggcacagccctggtagctcctggcactcatcaatatctatcaaaatcaaaacaaaggcattcctttagcattgtaaataaacccaaggaaattcaagttgtgtgtgctttaagacaaaggaaacacaattaccttccaatataacggtgataggatttggtcggaaaccttcccctccaggacaaagaattttgtactcggctattgaaacaaaaattcaaattgagttgttttgaatctaaagtttttagaaatagtatcctcaagagaaatactcacatatccaactgaaaatgttcattttcaggaatctttagttgttactctgcccgtctgaagtaagttaacacctttgtgtacacttcccattttccagtggtttttattatgtgtccccagtgcaaggccactgtcctcagtccttgaactctaaccactccctggtcttacatgtgtgtggactgttttataccttaccttcatcccttatttctttttacagattttctttccctttttattttctgaaaaacttcatcttcatttttatgttctgttcagcctactttctgggaactacagcttcccttaataatcttaattggcttctttccaaaaccctttccaaatagagccttaggaaaagctgttctctgttgattcccatcccaattctctccttaatgactagagacatttcttgcacctctgtttctatgggtggcaatattgattctcttggtttccaaaaacaactttctatagtgtccttgggtttcccccattaattctttcatccaagtattttacccagaaacatttatttcagtggtatgcaccaggacggtgatatgtacaggacatgtgaataagaatgtctgtaacctgctgcatcatcccagtgaggagctataagatcagttctttcataatgtcatggtctgtccagatctgctaatccctgtcctggctccctgaaattatatgtacacatgcctatatgtatatattccagttctaactctggtccagatctggtgtggtgtggatatctattgttttgctactgtcattaatctacaaagctgactccccaaattaagtgtcttagtttgcccccttcgacaccaatgaaatgaaaagtcctcctcttttacttgttctcctctttctgcaatcatccatactttttgaatttcttctttcatgtcacaaccttcttgaaggctcaattaaaaaacacactaagtccccaccctctcccaagcagaactgacctccctttctgaagagaagagagaaggaggagccagctgagcactcacccctgtgctgggtgctctgcatgagtgatttcatttaatcctatgaggtattttatgaatgctaaggaacttgcccaaggttacatgggtgacaactagtggagtcctaatgtgcaccaggtgtgctctttgtaccaacacagcactgtgcctgctctttcttctctttctgaggcctattttgaattatagcgcttatgtttaggtcataatttgcctactatgctgtattctcctgaagggcaggatctagtctaattcatctttgcacatccagagtacacattctaggtactcaacaaatatttttagaagaattgaataaatgacccttcagcaaaaaaagaatccatacctatcccaacatacgctataagcagtagccactgaattttgccaaagaagctacatctaattctgaatcataatacaggactcacttggaaaaacgaaaacccttttatatttttaggagacatagtttgtatgtccttacaatcatatgctaaagccttctttcaagccaccccataacaatggaataatcttccattttatagttgcttaactaattgcttctcttcaaaccccgggacactgagtctggcgtacagccttccaaactagtcaatagatgagaagaggagagataatcaatgtgtccctggaacgtaagcaacatggtgaaagtaccctagtctggaaaatctttaaagtaatgctatctgcttttcacttacacagaagtgagatgttacctgccctacctgatcttttagtgtgagccaaccaggaatattttctgactctcgaattgggaataaggtcccctctacagggctgagaggactgatctttcttctctgatctaagagtagaaaaggtttgtcttctgatctagaaaggagaactggctggagttgaaataataataaataggaggatgtccacttacatgtgttcacagcaggacacatctcacaaggagtaccccaggctttacccagagaacagcagcaggaagctttggaaacaccaactccaatttcattgctgcaggctgtatctccattgtctcctcgaggtcgaatatccaaatagcaatttccagagcgggtatctatttaccatatacaaacacaaaagcatcaggcagaatctttctactggggttgaaaattcaaacccacttcaggaactgttcaaaaaccgtaatttacttttactgagaaactaaaaagtgcccatgaacattatacactaccgagaattttccctatggaaaagatatctgaatctaaagtagagttaggaaatgtttaaatttctgtatcattcattttgcaaactttgagaatggaatgtttggtgctgttttcaaaataatacacagtatgcttgcttctctgaaaagtttttaaggtcttaccaacacagccaactcgagttgggttcagttcaaaatcaggtgggcagtcacagatatagctgcctggagtgttgacacagttcccactgatgcacgtggttggatccaggcattcattcacatctaaaaccgaacagtgagtagtggagttatcacctgagccagtgtaggcagacatcaccataaaagaacagggcccaatctagagctccaaacaagaattttaaagctactagttataactacatctagaaatgcagtcttccacttcagagataaaacacctcaggaaggaaatatgatatagtctttggtggtctttccccagaacacatttaccattcaaatttgtcatcaggataaaatataactttgggccgggcacggtggctcacgcctgtaatcccagcactttgggaggccgaggcaggcagatcacgaggtcaggagatcgagaccatcctggctaacacagtgaaacctcatctctactaaaaatacaaaaaattagccaggcgtggtggtgggtgcctgtagtcccagctactcgggaggctgaggcaggagaatggcatgaacctgggaggcggagcttgcagtgagccaagatggtaccactgtactccagcctgggcgacagagcgagactccgtctcaaaaaaaaaaaaatatatatatatataaaatataatatatattacatatatatataaaatataatatatattacatatatatatataactttggcactaggaaaaatattccagtcaaggtaactgaaggcaaaacactgttgtgacctcggtcaaccaaaaattcagacacaggttttaagaaaatatattgagtatatgtggcttgttatttcatcaaattagagcaagatgtcccaggaaaccctcagaagggcaactcttgctgcttcccctgacacacacgcgtgaggcttagtgtgttccctgaggtcggcaaggagtgtctctcccatcatccatgctgagttgaatatttccctttcagtttctattccaaaaatatgtacagaattccagatatttaggacatgggttttggcaaattccactctgtacaattccttttgtctgttttgaacactcatgaaatactcaagaatagacaaacggcttctgtgaggagggactggagaagagggacaacacctttgccttggtcctccccttggatctggcaaccctcctgcgggttgcgctgcagatgatttttttgttcaaattgcatgtgaatttggacggacagggccagagtaacagaaacgagattagacagaatgatgttgatagtgatctggggcacgcaggacagggtacaggccatggagagggggacttcctgaggcatgcaagagacccagcctggtctcgtaatagctttaaggaaaaccaagggaagaatgtgtggctggagaggaatactccatccagagcatttgcagggtggtggtggtggtcatgatctggagagcccctgagtcatggtttgtttaggtggttgaaaagaccagattttttccggaaatttgaactcatacagaacataagttgtttcttcagtatccttgaacagaggggtgaattaggaaggggaaatgcaaatggctttcaaagtcttagtgccaaagagaaccgagtgtcagtctgctgggtgcctgtagtttttctaagctttttctaatgttccctgagagtccttggctcaacaagaaaatgatttatacactagagataggtggctgagctctgtgtacccagtactctggtgaccacgagcagggcaggggtaggaaggagtggggtgggtattgcaacaacgaagtacaaggagaaaacccatgatcccggggcatggcctccaaaacgaaactctccaaaaatgtacccaagtagaaaaggaaatggctgggaagctacaccactagagcacccctagaacattcctttgtagccacaaactcaatttcaaggctacaaactgtgctccttcaattgtcttagactctttcctctggatcctcacctccaatcagttccaggtctgagaaaaggtatctgtgattcttaatacttcccccttgcttttcttgtcttctgtgacggcccttgtgtagtcccagggaggctccaatagctgggtcccccgggacaccagggagctgattttgatgccagtggaggtcttacctgtgcagttcccgccgcttctgtccagttcgtagcctatctcacactcacagcggaacaggccagggaggttgtggcaagttccaaagacacagatgttcggaagggagcactcatcaatatcttggggggagggagaaaaaagcaaaaaacttaacttatatttttctaaaaaaaacctgccaaatataattaggcaactaatgtaaatactaagaaaatgcagagtatctaacaccaatctgggcacttctcctatagacttttagatgatttgccatgcacagtgaagtctcgtaggtgagaggttacttttcctcagtctctattacatgccaagcagcgggctgagcattttatagatacatatctcatttgtagtgttccacgtaggtccacatcactttcgtaaagtaagaggcaagcaagccaccttacgctaaattcgttttttttttttaatctatctatgtagtcactgtttttgttgtgaattaaaatttcacaagccacaatgtctttcagggaactgtcataattagttgcataatctccagtgtccctagtcctatggcatgtgtttgcctttgttgacggagattggaaaaccgcacacgcttcttccaggcctctgtctctgcctcctgttaacattcttcgtgtgcagttgacacacagtcacattttcaggcttgagactagctttaaatagccatgaccactccaccagccatgatttatattaagaacaaacaaacaaacaaaaccttctcttatagcaataagagaagcaaaactttcactgtgactatttgtgtcaccagaggtggcacagtacctgttttccttggatatttggagtaacaaaagtaaacaaggtattaggcacatgatcaagagcataatctggtttcttgactccaaggagttttatatcaaactctgcatatttaatataaactgtataaagaacacccaacggttccataacaaagaaaagtattcacataaaaatacatgagggaattagtatacatgtcatagctaatgactgattttgagttcacgtcttgttaacaaggaacaactattaactaatacattaatcagggtcttgtttaaacttctactgacaatcgttatcatttgtttatttctactgaaatcttcttttcaatgaaggagaatgtgcttaaatttgacaaatgtgggtaaagggaagaatcttgtgttccctaatgggatccagccttagctaacaggttcccaggactcttcgtgtctgaccaacacttatcagaatgacagagcctaaagctgagcgataccatgccatatggcagtatcccaagggtcccctattgaacagatttgcaaaactgttccatgttcatatatgttagatatttagagcaaatgtgagacataccattctacgtatggacaagactatttgctctgcttttatttctacaaaccaaatacagtggagattaaaacctgtgtttccatatttagtgataatcccacaacaggacattatcagggaacttgcactttcagctcttttctccctcagtagggattaacaggttgcatccccctccgtagggataaatgggttgcactgatttaaccacacttggttaccctcattgaccaatggatacacccttgcagaccatgcggccaaggctggatgtacagcttgtggccagtcagctgaggttttctgtgcagcaagagaaatggtcagctggaaacctaatccctctacaaactgaactgaccagcttagaaatgaagctaaaacacacctcagtttaaaaaaaaaaaaaaaaaaaagcatcaggaatgtttaaataacctaatctcatcaagcccagcaaggctcccagtggcttccccatcagttaccttcacaggctttcccgtcagcactgggcacgaagcccatgtcgcattcacagcggtatcctcctggtgcattgaggcactggccattgccacagagattcaggttctcagagcactcatcaaggtctacagccagaaagaaacacacgttactcttcctcggttaggggctttctaattcctcaggtctatcaactttccagtgcagcaatgttttggcataacttcaatttgacacatttaaagtcatttatttttctctttggtaggctaacactgaatatgaaatttacatgtggctgattcagaatcctgaatgataatttaccctgaatgatataaaatgaataagccgaaggaatcatgcaaactaaggcctgttcaagaagggtcatccgcatggagggcacacccatgacaggaaatgacacatcatgtttgtgtctatttctcaagtttcaggcttagcttagatgggcaccaaaagtgcaaaagaatggcaaccatagggagaagaaaaattccatctgcttaatctctacctagttttcttaataatcacaggcatttaaatatcaaacacataaaccacacatgcctaatacatggaatttgaatatgttctcaaaatgatgggaggtttttgatgacaaaacatcaataagttaggcaaaaatgatttcatctgagataaaactttcagggaataaaaaaaaattccaggtaaatcacttaatgagccttagcctctattgtgcttaaatgactttttatgaacaaagtgctcaggataaatcaatgttttaagttataggagcagctatgcgacctaatggctaatggatcttattattttatttaactccagagctctgatataaaaagtgctgtctgtaaatatatgcacatgtaagtatatgtataatttatgtaatgacaagtctaatcatgtatgtttacatgtgtatagaagtttatgttaattctatggctattaattagagccaaaaagaaaatttcattaatatattattgcaaaactggaagtgaatgaattccatagcaggtttgaaatttttacttataccaatatggaatgttgatgatgacgataatgatgatgatgatggcctgttggagagaaatacatactgttcttctaatctagaacatctaatcccttctccttacatagttccctacagcaagcttatccttgtgttggtacagaaaggaagtcattggtgagaaataggcaaaaaaaaaataataataaataaaggctaggcatataaaaggaagtatgatttgtttaaactaatgacatcattatatacagtcatataatgatatatatgccaattgtaactattataaggcctagctgacttgaggtggagaatggtatgacttttttggtatcattttatgttagagcacagatcactgtaaatgatgtgataatggcacctaaatatctatctatctatctatctacctacgtatctacctatcgagaagcttttgaggtctccctaattgacctggttccaattttttttttcccacagagctctagtgccaaatgatgaatcttttctattaactgacccagtcttcaaaaaagaattgctagcctgagaaatgtggaatgcctggcttctctgactagtgttgacacagttgtttccagcgtgaacatacctgtacaagtgaagccatcacctgtgtatccttccttgcacagacagcggtaagatcccatggtattcttgcagtctgcatgctggctgcacatatgggttccattggaacattcgtccagatcttatagaaaaaggttatatcattattaacagaaagggtggtatttaaaaccaataatacacaaattaaaataactttacataattaatattttcatatgtgtaatctatgcagtccttgataagcaacctctgttactttcctactcaccagtgcacttaatgccatctccaatccacccgggactgcagctacatttgaagcttcctgctgtattggtacatacagcatgtttgccacagttgtgtgctccaatttcacattcattgatgtctggaaaaatgagcagtgatttagaaaaaggctcagcacaaatgtcttttggtttttaaaataagtaatattcaaaagttgacttgccttcaaacttcccatggtatagtatagactggttttgcatccatatataaactctacatatatcaaacagctttaaatttcaaattataaagatataacaatatgattgtactagctattgttaactctaattattttccgtattttaatgtaagtttccagtcactgcaaagtgactttttacagctgaagaccataaaaaatgagttgcttaattttctatggttttaatactccttgtcacatattttcttttgctagtatttttagtaagtcaactatggagtaatgatgcacattattttcatatcttgtatagacaaaaaatacaaacttgttggcaaattagaaaatttttgcattatattctatatataaaatatattttattcttaaacttaaaacacttatttaattatgctttatttctacaaaagctttcctttaggtattgctaatttaagcatttgcagaaaatgttccttaagacagtatataagccatcttttccctagcttcttagagtcctagcacattggagagccaagccttcttgtatatttcatgtaaaactcaagttaatccaatggggattttgtcagaatataaggaataccagattagggtcacattactaaaagactccaaattttccaaaatgctctattctccaaaattctattgtcaactttagccaagatagactctctaacataaatatgttacagaaaagaacataaagtactaagtgaaaattttccaaaacgagcccattctataatgggttaccctcataatcaactttgtcattaactaagaacaagaactcataaatatggtactctatatggaaaccaacatctaacaccaatcttaggtcaagaagaacaattttgccatacaaaacactgcaagaatttccagtgaacacttgaatagtggcatgaaaaagaaactgggcaagtaattcatgtttgcctttttgtttacttatgaagcccaattaaatgatttgaaagtgtttgcaaacatgctatctgccaagtgttccatctgaagctctgaaatggtcctgggatctttggcttcttcataacttctagagcaaacacaaaatgaaataagaacagattgctcctacaaaagaactttataatatcactaatgatcataaaaatgaagcagcatgcctggaagaatgtcctttcagtcatgacacattgtataggtggattttagtgtaaccttggcagccacatggacctatcaagttattactgcaggtcaagagagacacatagctttagactgtgactgggagctttaaccagctaaataattgagcatggcacattccaaggaaatgaggaggaaggccaattcagggataacagtgctaagtaggcacaggaattcaagaatgtatgtctttccatacctgacctaacagatcccgcagaactagcacaaatactcccaagcagggctgtcgaaacttctttctgcctcaggtaattgctcccctcagaggtaatgcaacaaatcaccatttttgtggagttttgcctaaatttctctcctatatttgtcatgatctctgacaaataatcttatgtggacacaaaaagcttcaattgcataagtatcaaagcctccagatgttatagaatcaaggaattttctaagtggaaagaactcgtaattccattctcccaatctcagtttctcagaagaagacaaagaagttgggccctacaagtcagtgaggggcagagccaggacctcctgaaactcagtttccccatctggtgattggcactccttcccttgggccacagctgcctagctgagcttctttctttcttttcttttctttttttttttttttttttgatggagttttgctcttgtcgcccaggctggagtgcaatggtgcgatctcggttcacagcaacctccgccacctgggttcaagcaattctcctgcctcagcctccctagtagctgggattacaggtgcctgccaccacgcctggcttttttttttttttttttttttttttgtatttttagtagggatggggtatcaccatgttggtgaggctggtcctgaactcctaacctcaggtgatccacccgccttggcctcccaaagtgttgggattaaggcgtgaaccactgcgcccagctgagcgcatttctttagtcatatcaggattttattctaagccttgctttatggagttaccaaaatattggtgaatattaactgacttatagaaatactcactaatatcttctactaagcataattttcagagatgaccacaacctattaatctagtaattctgtaatctttttctttccagttttctaatgaccagaggtactcttattttatgagtattatcattttcatatggcttttaccttccatgtttaatcttgcaattaagaaaattatcatttctttttaatggaaagtctcctttaaaaatcatcagtaatatgctaatagaaatttacaactttagaaagtgttttcagttttatggcaatgttttcaaggtgaaaagaaactatatttacaacaggctgtgtatcatgggcttttgggtaataggagagagtaactcaggagccaatattcaattctccattttgtgactatttgtataagttattatctcaatgttttacactctcagtatgtaacaattggagagacttcaagtggtcataaagtataaaagcatctccaaataaaaggtttttgcatgtgggtgtgtgtgcatgcatgcaccaactatcattcattaattgtttctgtggcagacttggactgtaattcatcataaaagcaaacagaaggggaaagtgagccataaggaaaacaagcaaacaaaaatgctgtattgaaacactcttcaataacatgaaggaaacatagtacatgtttgccaagaatatctctttctgtaaaaatgttctctttcctgcacaagttcgctgcaaacagaaaattcctgtttaagattaagaatagcataagccaagaaaagcaaagaaattcaaacttaaagtgacaccgcaaccttcttaaccccaccaaacctttgtcacaaagactcaaaggtcctcttgcatggctctcttgaagggcaagggtgtggtgtgagcagaccctgctcacaggctctgggtatgtcccatgcaagtatgtcatccaagtatgggcttgtgcccggggctgctgtggcctcctcttacagtcacgcagggagaggctgtatcacccacacaaacacctgccttctctgccatctgggcatctgtctcctggatcctaacctggcagagctgtgcactgcagaaactccttgattaggcattgaggaagagggcgttaccatgaatggagaggccaaacgtgaaggctacttggatttcttaatttggatccaaatttgagccaacactattaactgaacacccatggagttttcacaggccgacagccagtgaaggaaaattagcagtgataagaaactggaaggaaatgaacacaaattctcactgactgttggtggttgaaatatatgattctctcctatgaaccaagatccaccagagacatttctcttatgaaagaaaccagctagtttccaatatggaattacccagaaatcccgctattttaactgaaaacaagtctgatttaattccacttaatggtatgcttgctttattcattaactaagtaagcacatgatgggaggtagggtcttaaaattagcttgtgaaagccaggaccacccatcaaagatgacacctagcagggccttaattatgtagaacaagcagcagaagccttacattgggtcatagaaaaattgtaatccagcccacttaagccaaggatagaagagctgtgttctgcgtttcaagcaaatgtgttctctctccattaaatggaacattcccccttggcaatacccagggtctgaacaaagcttacggagtaaaaagaaacccttagcatctgtgtgggctgggaatgtaagtcagtgggtggattctgaacattgctaaagtgattgggggaaaaaacatgtttatttgttaaaatggaaatactcagtaatgacagggagctgaaatatttagacaaaactgtaatggagcccagaggtctttttcttagttctcatgaagcaaaatttctccttataaaatagcatacatattttcataattcttttcattaaacaataatctatctaaataaataaatagataaataagtagacatattccttttgtctgcttgcttatccaattaggcaagatacctatctctacttacattagttgcctggaacattattagcaaagccatcaccaaggtaacctgacggtgttctaagttgtgaatgacacgaattttaaactaaaagcagctaaaagagccttagtgacatggcattcaaaaaacattttgccccagatttttaaaaacacgttttcaagtataccaaacttactgtttggttaagccatttccaatcaaatgtgatgcccttccacaggtcagggctgttacttacccaaggagaacatttgagtaactgcagagcaccctggtgatttgttcaagatcatgaatgagtggatttactaagaacacaattcagggtactactccttcagatgagaatatcacatgccatgttactctggtatcaaaggggcataaaactcaagtcttcctacagtgctagctggattttagcaaattggaaaatcattttaggctgtaattttcaaaactggaggaagagctcaagtgtttctttgacttcaaatctatgaaaaagatttgaagaggatcaaatgtttctttgacttcaaatctatgttcatgtgattgactcaaaggctgctgttcttaacgtaaagctggtgtcacttcatgcaactgtagtgcacagctctgttaccatggtcttagtatctgtgcaaattcaactacgaaaaacaagcctttcaatataaagagtaagattttccttctttaaactgagttcaagcatgaatcagtaaacagtagcataaaatttttgctagactgttaaattctcaaatgaaacaacaaaacaatggacaatagatatagactagaagcaatggctttcactaaaatggcctctagacactgtgtctatgtttcatttgacaatagcttttatttattgaccagcactgcgccaacagcattgtatacattatatgtcatttacctaaaactacattaaataacatgaaaatttaagctttcttcagggtaaggcctaaaataatcagccactgcacatgacccagttagctagaatttggagcattgaattctagagacctctttcttatggggaatgaaggttgttccatgagattaacttctttcataagcatcactgcctctgggttgaatttcaatgtgctcagcttaacaaaacagtagtattatcctctattagttaaaacataatacagaactatcttacctttcttttcactactgccagaccatcatcccttaccaagtcctatatttatactggaagctaaaaataaagcttgaaccatagacatacaaagctaggcaccatttgtaccgagaggccgtataggagttgagagtttaaacactgtgccatttatcagaatggacccctagacaggcttcatgtaaggagtagcatagtgaaaatgaaaacattccagcttcatgcttcttctcataatttggctagcatctgttatttttgaaccaacaataatattattgcccttatcctacatatcaataaatttgaaatagcattattggccagtttgaaacaataataaatatattttggtgttttcttgaaatatgttgatataattaagaggaggatctgcacatttgccccactgccaatctgcaaatattttaatatttgttttaagtcataagagcttgccaaactggtttttggaattaaagactgttatttattaagaaattattcagttacctaattcaagctcaccatggtttccattatgttttaaattatgttatatgccataatctgtcaaattaatataagtaactagagtaaaactttattatatcattccatggacttaatgtcattgcctcatatttgaaaataccaactaaacacttataaactaaacacaatgtcattagcacagagtaacttcttccatttggcatttaataggatagtctcctacaaatattgtgaaaacattttctcatgtgctattggtaacagacaacattgcaaatggtttcattatcacttcataagatttgctaagtcccatgaataaagacttccttggactaatatgacttaatacatcaaaagtactcctatttaaggcactggaagactagtgagaattgatgaaatatatgaattgtaggatgttttcctttaaagagcaattccagttataaaccttaaatgaagtgttggcaaaggaggttattggaaaaggcttgcttcggtgaagggccatgaatatttggtaattagcatgttcactaatttgatatgaaaatgtgatttttaacctcataaaaatgtgctatttacagtgttaatttattcaatacacctttttccccccacaggtcaagaaaaaaacctgcaacttggatccaatataaacgatgacaaatttcaaagaagtggaagctaaattaatgaaaaatgttatgcaaaatgttttataatatagttaaaatgtatgagttttaaaacatgtatcaatctataattatgataccaatctcttaactacttaatattttattgttctacttgaacaaacacacctgtacagccagtttttccttttttgccggagtagcccatatcacagtggcagataaatgagcctttcgtgttttcacaggtcccacttaggcagatatttggattcaggtcacactcattgacatctgtaaaacatatatactattaatatatgtagctatttgatatcattgagtactttcccctcgagacataataactatgacaaatacattagaaaaggtaaaatgctttccctcagaaaaacaatgttaaattttagaggccaatttacatttgctcttcattctttacattgcaagctcattattcagactggctttcatctggcccataagcagcaggccagttaatcaaataaacagatgggctccatgctgagtttagagctcgtttatgtgacagtctagaaaactttttagaacagcatactctattgcaggatgaaaagtttaattcagtctgcatgatgataacaatttagttttcatattttgaaagaaaggatagatgaactggttgtcttagtgtaagtagtttaagacttcacttcttttccaaattaaaaattattcattttttatgacattcattttaattctaggacttcaaacattttcagtaaaggctttcagaagataaatgtgataaaaatgtaaatataatcaataccagactcttgcttctggccaagatagaataacaggaattaaaattatattctcagatgaaacaaccaaaaaaaatagacaatagataccttaaaaagtggttttctagacattggacattaggcaacaaaagacagtgatccctgagagaaagaaaaactaggtgaatcctacaattgcccgagattactgaataggagagttttaacttcatggcataaggaggaggtaccagatggagccaggcactgtccttgagttgaggagatgaatctgggcatcctggaaggctgaggtagttagggttcatagggcagagtaaaggacaggagagagctacacagaagaaagcaatgccagagatttgctaagagtcttctgcaagtattcagatgagtagtgaccagcacattcatataaggaaacaaactactcaaggctggggaaagcactacccaagaaaatgagagggaacaatcctcaaagttcacagggggtctgggattgtgcctgttcccaccagcctgactggaaagcctcataattcacagggaattgggtagaatatccagaagggtcttacctcactaacagagcaaaattacccctagactaagtgtagcttaaaagcttaaaagcaagactttgaaagggatccatgtgtttccaagtaatttacacttcagaacaaagttcaaaaatatttctaggaatacaaaaatatctagcactcagtaaggcacaatttacactatctggtatccaatcaaaaattaccagtcactcaatgaagcaggaaaatatgacctaaaataaggaagaaagtcaatttattcaaatgacctagaaccaatgcagatgacagaattaggagacaaagacactaaaagttgttataactgtattccatgtgttcaaacagctagaggaatgattgaacttatgcagagacacagaatatatgaaaaaatacccaagtcgaacttttagaggtgaaaactacaacatctgagatgaaaaatacactgtatgtgaggaaaggcagattagagatcgtagaagaaaagtttatcaaatttgaaggcataacaatagaaactatacaaaacaaatagatcagttctaaagtttactgcattcttgtcagaagtaaattttgtttgcctttagtcaaggatttaaaaagcctacatgatagtcaaagcagaaggagggttaagtggacaaaagtaatggataggcataaaagaaatgtccatctggagctgacgaatggccagtcagtcctcataacatatctgacaagagtaccatttaatagccacaagaaagctctctttggaatgctggttaaaatatgagtattgtgcctctaaatatccttacttttcctatggaatctttctatcactgacccaaactaactttatgtaatttaacagtgcttatgactaacaagacaagatgaaaaattctgtcttctttgcttacctacacaagtcttcatgtcttcagatgccatgaatccatcataacacaagcacctgtactctccagggatatttgtgcactgaccaccatcacagatattgggattatcttcacactcatcgatgtctgcaaagaataaaaccaacaaccacaggttgttgatattggttccactgttcagtgagaaaacattaactgaccgcagtcaaataaacttagcctactagcataagactattaactctcaaatccaaatgaagctttgcataaactagcccattgggttatccttggtaaaaaaggaaaaaatatttttcaatatttataatatactgctcaagggcaacgtccacacctgcttaaaagtctattatttatttaaaatctttctttcatttaatttatcattcaaaaattattataaatcttattttccctattgtcaaattataaatgcctgaattctatcaactgttttagcaatattttaaggtaagaattacttgaaataaccatacctacttagatgctcttagtaataatatttactttcaacaatttttttttttttttgagacagagtctcactctgtcaccaggctggagtgcaatggcgcgatcttggctcactgcaaccaccgcctcccaggttcaagcgattctcctgcctcagcctcccaagtagctgggattacaggcatgtgccaccacacccaactaattttgtatttttagtagaaatggggtttcaccatgttggtcaggctggtcttgaactcctgaactcaggtgatctgcctgcctcagcctcccacagtgctgggattacaagtgtaagccaccgtgcctggccttattttcaacaatttttgtagccaaatttatatctagattttttaagggacatttttctaggtcagtaaaataattttggttcctaaatccaaattctcttcttaagccaagccaaaatcaaagcctatgttattacccactttgtttctcacctctacctggctcacagctctcgcagccagggtgatacaaaaggaagtgtaaattagaccactggttctcaaactttagcatgcatccaaatcatttggagagattgtgaaaacaaattcctgggatctacctcagtagtttctgatacggtagatctggaatggggcctgagattttacatttttttaacaagttctcaggtgatgctgttgccaatggttcaaggaataaacctggagttgcactgaattaggccaaaacatcaaactcttcaaaagtctggtcaatgaaggaaaatgtattttatattccatttattatatgccaggtactatggtaagctctgtaaatactattttatgcaggcaatttgaacttcattttatagatgaggattctaataataggtatcttgattaaggatacagttaaaatatatgacaaacaagggtttggactcaagcctgcttgactccaaagcctgggccctaaactactttacttaggaacctactgagagattcaacatgaggctagaacctactcaccggtgcatgatctctggtcaggcattagtgcaaatcccggctgacagctacattcatagctgccttcagagtttgtgcagaaggtttcacaaccaccattcattatgctgcattcatcaatgtctaaaagaaatgaaaataatatcaccttctgatatggtttggatgtctgtcccctccaatactcgtgttgaaatttaactgccattgtaacactatttaagaggcagggcctttaaaagaggtaatcatcctatgagggctctaccctcatggtgggatcggtgctgttataaaagatcaagttcagccccctcttgctctctttcaccctcgtgctttcttcaatgggataacgtaggaagaaggaccatgcaaaatcctggcttcttgatattggatttcccaccctccagaactgtgaactaataatttctattcattataaatcacccagtttcaggtattctattacagtatcacaaaaatgggctaacacacctccctctgtgtttatgagcatggcacatttttaacatttccaggcatacgtcaaataaaggggaaaaagcattctagggcaactgagtcactgattccttcaacaaatgttaatgacatacctactatatgctagagatgagactctaatagtgaatgggacagacacaatctttgacttcaaaatgattacactgtggccaggagacagatgaacaattaattgcaccatgcatgatgtgccatttgcaatgcaggagaagtattgggtgctaggagaacacatctcagttatgataataggcacgtggatgaaattctcttggccacagattcacttataaacttgaaattcagtttgattggctgaggttccaatctttttcaataacctgagttgaagttctgagttgtcctgggccatgtttcagaaaactttgggctgatttatggttttgggtggaaaccatgtgagacttggcagttccacatggtgtacaccccaaaccaggcaaaaactggcagtttctacaaagtttcactttgactcggggcacaataaagccacaggactgtctgtgccactcttcacagcacgactaaacctacagagggctgaccacaaagcaaaattcttgtcccacaaaaacccatctttaaggagagccaggcatagcctcaattgcagtgtaagatatgaacattccatggtcttctttccaatagttatttttttgaaatcttttagctgatctaaaccacataagggcagtgatttcaactcagctttctgctcttttccacagcactcaccgtgtttagtttatttcaggtggttagttaccatttgttaatgtgcattggtatgcatgtgtgtagacaaagcacatgctgctactgttccctatccaaacggcatgggtcaaattatgcttattagagctaaaacatcctatgtccttcacttaactggctctttaaacagataatggagatgagatccaaagatcgtgagccactataaaaagaatattgcagggaaacaagaaagataagtaaaagtagcgatgaaaacaaaactcagagtacatagagtgttttagggagagatgaaataaaataaaataaaataacataacataacataacataaaataaagtaaaataaaataaaataaaataaaataaaaaagaacttaccaacacaaaatagcctatcgggagttgaatggtagccagggttgcaggcacactgatacttccctatgaggttcacgcaacggccattggggcacaggtgtgcactcagctcacattcattgatgtctgtcgggaaaataagaagaacaaacacccaaacataagcttccaactttggcaatgatgtcattcaaacaactgaccacaagtaaatggtgtgaaagtctttctccttaccgatacacgcggagatgttgggggacagctgatggccaggcgggcattcacagcggtaacttccctctgtgttatggcaaacaccacctcggcataggagaggatctctctgacactcatcaatatctgcaaaatggaaatgaccatgttaaaggtgggggcctcatctcctccaccagaccaagcactcctcccccacccattgctgggtgtccatcttgacctccttgtctcaaggtgggacaactctctggtgctattcatacaccagatctccctgcaggatcagactaaaaccaaaatgcagccaaactcttggtttattttcttctcctgcactaccctgctctccttacttcctgacaagtaccttctgagagaatttgctcacagtaagaaataccacttttgcaagaatctccatttcaaactttgtttctaggaaaccagacctaaagcaacaagtttaccaatcaccttttctagaagtgttggacagacatcttgtaaagggacctctactacagcttctgtctcaattgtcctctcttccgcctgggtatccatttcaggtgttaaaatcacttctcaagggcccacaactggtctccgccatcacccacaaacccacagcatgaattccctcattctttctacctcagtctccctctgttgcagactgattcctaacttcactggttgcactggggcagcaggaagaacctggaacataggctatgagccatcaaagcttcatggaatccttctctttctgtgttgatcaaatgatcccaaacttacccatgcagttcttcatcatcatgaatccactttcatagccttcgtcacacttgcattcaaagtccccaggggtgttcacacactggcctctgccacagaggtcaggagatatgcggcattcgtcaatgtctgcacaaaaacagcaagtggcagcaaatgagtctcaggacagccttaattcttgcgacaatatgttaaagataaagagttttaaaggacgtcccctctcctggcccttaaggctcattaactgacctgtgcagttcctttcttcagaatcaagagcaaagccgctgtcacacctgcacttaaagctgccaatggtgtttctgcacttgccgtgggtgcagaggctgggtatcatcttgcactcattgatatcttcaagaataagaaaatgtggggcaaaataagtttatgagcaagcagtcaggaggtctcaatgcccaccattttaaatcatgaaggttggaagttcttgatttaaggtcttggcagtatacatttccaagaatgtgtgatgatccatgagatatatgactttgtaaacatttctagcctttcaaatttctacattttataaagcattgttaaagaagcaaataatgtgtctattcagacttctagggcccagcacactgcctgacacatagtgaatatttaaccactacttgctgagtgaatagataatatattctaaaccactagtatctatatttaaagcacatagaacattattagaatatattatcctacagctatcaattgactgtgtagcagaatgagatattcacttaatactgtttggtgcttttttggatatgccaaaaatataaaaatttcaaagatataatttataatttaaattatttgcaaataatttgtacaatttaaaaatattttcttaatgtatataccttaagatgtctttctttctttttttgagacaggatctgctctgtcatcaaggctggagtacagtggtgtgcttggctcactgcaacctctgcctcccagattcaagcaattcttgtgcctcagccatctgagtagctgggattacaggtgtgcaccaccatgcctagatatttttttttttttttttttttttttttttgtagacacagggtttcaccatgttgcccaggctggtcttgaactcctggactcaagtaatctgcccaccttggcctctcaaagtgctgggattataggcatgagccaccgcatccagctcaagatctcattaatataatttaaagagcttcttgtacactagaaaactgcatacatgtaacatgtgacctgagtttcccactacagggcctttttccaaaacaagaccaaacactcaagaaatacgcaagtaatttctacatgtaagacagaactgggagattaaatctccagaacaccaagtccttcttcagcaatgaattaccatagcttttggaagcaaaattaaagttcctttgagtttacgtaactgacatttaagagggccacctagaaactatctgaaactatctctccatacagaacaattttaacccccaggacttcttggaccaaacagttaaaaacaaaaagttcatacttttctaaacaaagataattatataattcagaaagcaaaaagtccatgctgggatgatcaagtagagtgctgagatcatgaaaatgcatcctatttgtctaaaaagggaggcaattggccatggaaaacgtaacattgtacctttgaagaaaggctttccatttgtaatttcttttgtggcaaatccgggtcctctcggacacagctcctcgtactcaggagtatttctcatgggacactcctcgcattcctcagtaccccaggctgccccgacggagcagcagcaggcgtccatgcggtggcggccagcaataggcagggtgcactcctcgtcctcgtacctcaggaagcaggtttccaggcggatatctgtcagagggaatcaagggaggttaaatagagccacacggcttccactgccccaaactgccaacactctgttaggtaaaatactgcacacataataatttgctgtatacttattgactggaattagttttattcctcaaaaaaaaccccaggctctggggtaagtatccttgcctaataaagactctctttgtcagcccatgtttgcacctcctacttctgaaaagttccctttcaacatctgataattctacataaggaatggtattctgagagatcccacagtgttctttcgggagatgtttttctcctgtacagaaatacctatcaccgatgcgtgcatgccatgatgtcttggcatgtcctccacagctaaaagccaactgtactctttattgttggagcgtgtctgccctagtgcaatcaccttttcctccgacccacttcatttttggaaaggtggaatgatgaactctggaaagaggactgctttacttgagattaaagagaaaaatgcaaagaaaagccattcactttacttctcaaatatttctttcacctaaacacgtgcttaagggcacattcttcaaggtacttgtgggatacctctagccccaaacccaaattcatgggattataaagaagagcagaaagcctagcagagcagaggtcagaagagctggattttggtcctcttctgtaactcagtggattgtcttcaataaattatcctaaacctgaatttccacatctgttacaggatgttgcactcatctctcagaaggttctgtgaagctcaactgagattatgcatctgaaaataatgaagtgtaattgaaatgtaagatgtatcttccttctctttctccttcacaatggggtcattaacaatatatctaactccctgggtttcctctaacgttagaaagtttttgaagtctttatattcagctttatattcagactgcccatattaagataaattatttttaagtgaatcctaaattaaacactgaagcatctttcaactgaagaacctagaagaagattctcattaaatactgattcttcctaaacaaataaactaagactcagaatagcattaactgacatccttaattacaaaaatacttttggctttgaattcccggttccattccatattatttatttacactataaactataaagttcaatatttaaaggtttgttaattctaattcgtaagtgatcaaaatccttcactgtataccactttctttttctttttcttttctttttttttttttagagacggagtctcactcttttgcctaggccggactgcagtggcactatctcggctcactgcaagctccaactcccgggttcatgccattctcctgcctcagcctcccgagtagctgggattacaggtgcccgccaccgtgcctggctactttttttgtatttttagtagaaacggggtttcaccatgttagcaaagatggtctcgatctcctgacctcgtgatccacctgcctcggcctcccgaagtgctgggattacaggcgtgagccatcgcacccggcccacttttttaactacctacaatagtcttcactgagcctacacttcaaagtaatgtggtttcagatgcaaagtacaggtaagcatcatttccagagtcatgaactcagaaaccagtgatccaagggatatactctaggcaggcagaagccatagtagtaacaccagaataagtctgccagaccttagatgcatgagatgtgcgatctcaaacttgccactatcacgagcccatagggacttaggacttagagttctaaggacttagggttggggtgagacaatttggctagaggatcccatttgggctctagcagttggcacagaatatcccactatgactagcagtgatacctaccctgggctgagctttctcaggttcacttttcaggggagtggcatcttcactcctgatctccacaggtgtttttgcaaggacctgtccttctggccaatgtcagggtatgcttagaagacatgggctacagtttccaaatatgtgcaaatattgttcttttctccaccactcagcttgtattttatagttcacggcatatggggccgatttaagagctctggaaaaataactgtgatgctagtgatttaaggaatagttgcatatcaacagaaactacagttgctgcttactatttgaaagactgtcaaaggagtggccatggaccctatcggacatgctgaattttggagtgtgtgtctgtacctgaagctaagtgctcagctatatcttgttaacttcatttttaataatcgttaataaattattattagaaaaataatgagctcagtatttaccaagacagatccttcctgtggcatccaaagtcattccactgggacactgacacttgaatgaccccctagtgttaacacacaggccatttttacacactcctgggaacacttcacattcatctatatctaaaaagaaaaaaaaagtataaagttaatatatctttataatatcattctaccttattctactcatagagtcataattattccccattttgaacctggtaagttcataaaactagtttgcctacaagtagtttgtgtagaatttctagggtgcctgaatagcaaccagaacgagcccacctattactaaatatgtaagagtttctccattggtttcagggaataacttttgagttgtagagacaggcagctggtgtgagttcttggagacagctctggtagctgcggacatttcaggtaaggttcccagcaatataatttgctttatgagaccagatgtctggaaatgagtagagaagcaaaaacctggtttttcaaactagcaaagaagaaacagcttgaagttcagcatagaaaaatatcccaccaaggaatatgtgggccagtgaagggtctcttttaagaagttctgataaatcaccagaaaatgtacaatcaattctaactcagccatggtctcaggctgttctgtccatgctttggtctcagcttgggttgaggggaattaaaagatactcatgttcattcattcatcattcatccaatctctctcaaatgtaccagtccttcccagtttgcctaatggagagcaatatgttctctgcacttaatttggaaaagtattcaccaccaagttaatcaaaagaaaggcacttacttgccaatgccaaaaaaaaaagaggggggaacattagctaagaaactcatacacactgtgtctctatttagaagaaataactttccacaacaggaatgttgaaaaaatattctgaatctttccttgtaagagagatcaatggggagagggtggaatctacctttttgggttttttgttttgttttggccacttgtacaacaaaatatgctgctgaggtcagataagttattaacagcgggtctggaccagagaaaggccaaaggattcagtcatcatttggaaagcaagaccttgggtgggggttgtagtgtgcctctttgttttaacagggaaaaaacttcatttcatcccacatatgggactaattgctgtttttaaaatttttcagctgctgtgtcatgtcaggttgtgttagtcaccatgacctatgtctatctgaaactccaggagaaagaatcacagcaaactgaagaaactccatgcagactttcaacaaagagaaaacagaatgtgtccttctaaatcacccatgactgtgaaacaaacaaataaaaaatgccaggacaaaccaaagaaaggcaaattttacagactcatcaaaaacttcctgtttttctcttcctgatagcattttgaaagtgcagtctctctaaactgcgatcaacctaaaacattttcagccacccaccctgtcctttggacatagcgttctgacactagcaacagtatatatatgcttgtgaaattaacagctgttccgttttgtagttctcattattttttttctctgctgcatatttctccctgtgaagttatatgacagctttatccagtccgagttaacacaaacattcattatgcacacaaaaatgtatggtttataagtaatcagaaataccttcacattgtgttcctttaattcttgagtaccctttaccacatatgggatctgtaataaaaagcgaaaaacaaaacagaaaacaaatttgagataacaatatccagactttgcagttctgacatagtgtaagaaacatgaaagatgacctggaacatgaagtagattgtgttgctataagtatgagataacaaaatgtttctgcgattgcataggtgaggaagaacagtaatgaaatgtctcctcaaataaagctcaattccactaagatactccaaaagacacagacgtgccctatagatcatgttaaagtgatagctaagagggaaactgaaggtagctttctctcttgctgttcacctgaaaataggaatcacactatagaattactttaacctgaatatagaaaactcaagtctataatttggagatctcatggcctccagcattcacataaatttacacatttatatatttaaacattaaatcagcaaaaccatgagcaaggttctcaaacctcaagttcccaacagatttagaagttcaccagaaacccttatgaagtttagtcatgaataccggtttctttacatcaattagctttttgaaagataatctgtacctataaaaagctcagaacccctaaccacaaggttcccaagagagctggcaggcactggtgctccagggaagcaacacaaactaaccacattacaatgtgaagatagaaaataataaatgaacaaaatcacataaaatttgacacttcttatttcccattcagcaatatgttcggggccatcaggattaaatctttgaaaattctcatgtgagcctagataaatgaaatactaggcttcccctttttatgcaaagaccattggagtggtataggaaccacagcatgggtttctcttaccaacttggcatagggtgcacgggcttccccacgcagcaccgagggaggagcagcactgggactttaaggtggctccattgatgttgatctcacatcgcccatcaatgacagtctgccagcaagtgcccttgatggtttctgcagaggagggaataatatttaatagaatctatataaaaattcaaacatacaccttggaattatagacaaaaatagcatttgaaacaaggaataatgaagtttttaatattgttcatccatacttaaattcttttgcaggaaaagctgacattaagtataacaacattgataaacatagaaaaatcattctcagaaagataaatacctatgcagatggtttttgttggatccaaagtactttcagaagaacattcacaaataaaagagcctgggctgttcttgcagactccattaatgcaaggacttgattcgcattcatcaatgtctgaaacaaaaacaggtctacattactgctaaaatctagtcttgggcctaaaagagtacttcaactttgaccccaattgctactacatatccttaatcccacacagtaaagctgggctaaatagtttttcctacactagatggaatgccaaaataataactctatagtatagactagtacatctctatagtatagaatacgggacttggctgaatctttttatttagaaaatctggagtaaatgtgtatgtgatttctgaatgaatagctcaaatagcagacacataacattttctttatctattaaatgatggcaattaaaatgccaattacaagtaaataccataagtggcttacaaagtacatactagtgccatgtagaaccacagaatttcaactaaactggcataactgtctaaaatacaggagactctaattcagtcttatggttttctaatggcattccaaaagatagcaaagtacacagtataagaacaaaaatatggtttaccttcacatgtttttagatcaggtttgtagataaatcccttggggcaggtacagacaaaacttccaggagtatttctacattgtccattgtcacaaaggagactgttcagtacacattcattaatatctgcaaagtcaatgaaaataaacacttaaaaagggcccaaactttgcctgtatctactttgctcttttacattagatctttaaagtcataacgacgtgatcaattcaagcaaaaaggcaaaactcctgtagcattagcttttacctaaactatctcattttaggaaaacagaggcttgacctggttttaaactaagtatctaaactaaatatctacaaagcctaaagtcactaggctatttaattcacttatttctttagcaggaagaaaatacagatttgctggaaatcattaatctttatagagttacattatataattaaatttatataatttaattcattttgtcgaattaaaaggattaaccttattgatttaaggaactaaataaatatttagaaagtatggtccaactttgaaatgtgttagttccagaatgggtgtttcttccttataataattcaaattgtctccaggtatgattataaagtacaaagtaatctgtagcatttatgattgtcatggggaatttagcttcatgattcagggacctcaggaaaactgcttgcttttagctgaataatatgcctgtctgaagcaaaacccaactttaagagagcaggtattcctgaaaataagctgtgtttttttctgattaagtctaataaatggttgggagaagagctgcttctctctcagtaaaatcaaggttgactttgtagtcacatgagaatggctcagaatctctgcatcttatatctaaggagcttctctttgaaggagtgaaatctgatacatcattattttaaggagcaaatcatttcaaggagtgaatctgatacatcgttattcataaactgtgaagattcagtgatgtaaatttttgttactaaagatatgtatatgctgtgctaacatccgaagtataaagtgtccatttgcccagtcctctaagctactcaaaggcagttttctcccagcaatgaaagaaggaatgcattatgcaggcaatgtttcagaaaatgggtaaaacttctcaccaacgcagtttttcccagttgaatccacttcatatcctgaattgcatatacatttataggtcccacgaaggttttcacagattccatttgggcaaatatcaggatctagtgcacattcatttatatctgcaccacaaaaaaggtcaaaatcaattaagattataaaataaatactgaatgaattgttaaaaatataacactacaataaatgtaatgaccttaggagctacaggaggaaaaaaatcgatttcactggaaagagaacactctgtctctttttctcactgtaagatattctgagtccaatctttctcccacaagttcctgagaggaactttgcatctcagctggaactacaagataaccaatccttaatcaagctgaaggagacctcctggacttctcctagtccaagcaccaagatggaaaaatggatcgacagcagatcccaagtcccgacaactggtctccctaccaccagcccctctttcttccatctaccctgcactactctacactgcaaccattcttaccatcctaaaaacaaggtattatatcgttctcatggttcaaactttcataggttcaacaatatcctcaagataaaactaaaatataaattctttgtttacttatcccagacttcacactcttctatgaacatataatgccctcttcactctgtgtcaggaatgcttggagcaggcctatttacaggtcaaaagccagctccaacaccacatgctctgaaaaagcctccgttgctctgcccacctgaggtggggccctccctcttctgtaccctcacaactgaggagggaatctcatagtcaaggcaggtgcagaatgacaaccagtgaatggatagtctcaaatcctggtgcctgactcttctataaattagggttgactttttttttttcttccaagtccctatcacaacttacttattccccattaactccttattcgttataagtttccttacctctcctctttcctcctctaaatatcccctccacattttcattcacgcacaatgatgaaactaatcatactgaatgaactgacaatcaattcagccagtccatgttctttcagatctccctgaatcaaactatgtagctttatattaataaaataatcccttcctctttcttgtcacctattgtcatacttgttccaattctcctttttaactttaattccttgcatggcaccaatatttctctagctaaatatttcattctcttttaactcagttaattgttgtcactgctctctattgccattttataatactgagcacttaacagttcagaatccttcagaatgcagatggagaatggttcaactagcccatcatcccgagtggtacttgatagtggaagatccacaagagagtcaggctgccccttctcaagcatgagcaacaaaagtcattacacatcatctgcgagcacccatcaaccacactgagagagcacctgaccccctcagtggccaagtcccacagccacacccagaaatcctagagcccacagtgccccggctgctctgccactgaaggcttctgagcatcccagatacatggcacagtgatggccagagagggagtcaggccagactagtgtaaagggatcaactggaaacccacaagaaagcctgatgctgcctctgcacatactgaaggtagtaaattttgaaaggaatccttaccactgcctgctgacgtcattcctggcccactgctgcagagtgcctgatattccgctgcaataaattaacagatagtaaatgattcccttgtttgcagaacaggtagatcctgcccttggttttgcacacatcatttcctccaaagtgagtagaaccaaacttaagtggtaacggaaaaggaggtatctccccagggagtcacctttacaccaggctcccattttaaaggctacacatcatcaaggaaaacaacttttaaggatacaggcaagttatagcaattccttgtgcaaagccctttcggaaaaggtgtttttcctataacttgattttgttcaccagggaacactttacacttacggtgaaatgtgcctgttaaaatgtggtttcttaactgttaataaaactttctcccaccatcttggggataattttgtttctcagtgctagctgttttttcagtacaattggttcttaacatttcctcatttctctctgcaaattctctagcctcctctcacaagagcaacaacagaatacctactcttgcatttaagtgtatttttaaagttaatatgtatcaggatactggattcattctctatggtatatccatagagaaagtattgcttaatgttaaaactgtgagatcatattgaaaaaactgaagtataaagaatatgtccccaaatttgagatagaatcaaatttctatttcttaaaattaataccatgttttatatacaattccaacaatacttaacataagagtgaatgatgaaaatgtagaactaactggaatcacactatccaaggaaaggaaactagtgtccccttaagttgccaatggtttctggcaaacacagtctcatggtcatatgtaaatcatctgtgcttaagtggaaggagaactggatatcagggctggggcttattgtagaggctgactgcacctcactgctgaagcaaatagttcctatcccctgcatgccagagaattgcatcctgatgacattggaggtaaatgagttatacaaccaaagattatcatgtcttctaacaaatgtgaatttgagaaagcagtgatgatttaattttcaaaccatcttagaaggggtcaaaaaaacaacagatgggaaggtgtgtttgaaagccaggtgtgggaacaaaaagaaattcatcttttttattctgctgtatcagcaaaaagctaaaatatgcatgaaatactgtaagtaataaaacaagaaaaccaaaatcataccagttttataaaaaggacttttagagataatgacaattttgctgatgtttggcctaaatggaagcaaattattgtcaccattgttttccatttaggcaggatctggtactagaccattttttgtagtgagttcaaataagcatgggttttaataccgatgacaacgctaattgctgggagttttggaagcagcccttttcctctgttagtttcttctcccataaatttggaatgacaactcccatttcacctggtggctgtacagaattaacattacatgtttaatgattgaacgtgtactgtgcacagctcaggccctgaataaaaaaataagtaaataaaagtattataaacacatagtgaggggtaggtgttgatgagctaactccgcgtagtgccatggagacagtgacatgagggatccatgagaaaatccccccgaattaccctcctgtgggtttaactgaccaattacactcccgtgggtttaactgatccatgtctgtgaaatgtcattgtcagaaggctgaggacacaagagggcttgctgaacaatgtgaatcagctccagcaaccagtgagaaacagcttcatatgtagcttgcctgacttgcagaccacaaagatgaacttcagattttgtatatttggagtctctccctcaactgactgaagacattccttttgaatattttcagtactttaaacagcctaccccccattcttgaaatgagggatatcctacattcggatggttcatgaccaaagaggtggagaaaccaaatgaatgaaactacttccatgtgtggacccttttttgggtaaattcattcaaatataagacaaaagttagtggaaccgggccttacatttaactctctttaagctttactgttgctttggtttgaatgtgtcctccaaagttcatgtgctggaaacttcatccccaattcaatagtaatgctgggaggtgaggcctaataagaggtgattaggtcgtgaaggctctaccctcatgaatggattaatgtcattattatgggagtgagttagttatcatgagagtgactttgttataaaagcacattcagtcctctctagctttctctcactcctgcatgctctgttgcccttccactttcagctgtgaagtgacttggcaagaaggccccccacagatgctggcaccttgatattggacttcccaggctccagaactgggagaaattaatgcattttctttataaattactcaatctgtggttttctgttactgcaacaaaaactggactaagacaactgcttaaagaaatctggtcttttggtcacctttttataaacccacataatttccctgtggattttaagaattctttggaagtgcacttggtccagaggaaaatacaaaggcaaataactatatgcaccaaggttcctggattctaaatcttggctcttccaatcattcaacatgtgaacaagtcacctgtactcttgtgtgccagctttcatgatacttgtctgtattgcaaattcaaagtaggtaagtaaagtactttgaaaagttaaagtaacacacaaaaggatgatattaataatatacaactataaagttataggcaaatgtcttcaacagaatggtatttgtatataataaaagtattataaacacatattgaactgattggtgatcatacataaaatgataatttctatattattcaccgggtgaagtcattagccagagcagtttttttctttaaataggcatccctcatttcctttttctttctttattgagacagagtctcgctctgtcacccacgctggagaacagtggtgctatcttggctcactgaaacctccacctcctggattcaagtgattctcctgcctcagcctcccgagtagctggggttataggcgcgcaccaccacgcatgactttttgtttgtttgtttgttcgtttgtatttttagtagagatgagatttcaccatgtcagccaagctggtcttgaactcctaacctcaagtgatacacctgccttggcctcccatagtgctgggattacaggtgtgaggcaccatgcctggccccccatttcttttaaagtcttccatttaactttctctaacttttcatagtgtattttaatttccaactgttactttcaaatactatcatttttaaaataacaaatcttttaaaattatgatttactctttaatttgtttcctttagggcagaaataaactgactaaatcctatatgtaaaaacaaccaaccagagctacatattttcaatattaggtctaactttattttaggacattagaggtccactgccaagctaccttaaaattgtgtttaaatactggcagaacattgttttaatttcagtaatctattcttgttttataaatagaaataatttacaactggacaggaccttttggattatctaaggcaactcattttgtagatgaagtgtctaaggatagcttgtctgcattattctattttataattatgtttattaatataagccacctcaaatccttttgaaaagtaggtgaggaaaattcagaaataagcaaaatacacaaataactaaatcccctgattaagtaatttggctgcctgttgatggaggaagagaattctgactcgctatccagttctcttttcattaggccatgtcacttcaactggagaaaaatagttttttctctcaggttaaatcaaatcattaaagaaaaccacaccggtccgggcgcggtggctcacacctgtaatcccagcactttgggaggccgaggcaggtggatcacgaggtcaggagttcaagaccagcctggccaatatggtgaaacctcgtctctactaaaaatacaaaaattagccgggcgtggtggcgcacacgtgtaatcccagctactcaggagtttgaggcagagaatcacttgaacccgggaggcggaggtggcagtgagctgagatcgcgccactgcactccagcctgggcaacagggcgagactccatctcaaaaaaaaaaaaaaaaaagaagaagaagaagaagaaagaaaaagaaaaccacaccaaaatcaatacgtgggatgtaaacaaaatttacaaatggccttttggaaagctagtggaaatagtcaagtaatatgacagttatttacttttacgctgtgtaaaagtctgcttttataatagtttctgcaaaatgcaaacatcatgaaacaactttagaaaacaaggcaaggtgcatgtattgcaaacagcttgagtattattgaggtaggagagtttatacgagaggcacaaatgcaatgcctattccaaataattatgaggcttagataagtacctgtgactagacactggctggcctctgccaagaccccaagaaggcacatggcgtacctggagagcaaaatgtcatcttccctgtgaattccacaaatgcaaagacctcaatggtggcagaaggctggcagtacgagggcatctccatgataccacatacctgaattctgtgcaggacacggctggcaaggttccccaaatgcatactcagtgctggcgcaacagcattcagatttagtgacagcaccaaacaaaggtttgatacactggcctctcttgtatccaccatagcatgtgctccgcatgtgtgtgtctaaacaggaagaagcatctgtcatcacactgtcacttcaaacagatgagaaccccccaagtcaaagttgaagagggctttatttatccatcatccctggtgtaactcacagggaatgcctctgatatcggggctccatttgaagaaaaaataaacaaaaacagaaaaacaaaacacgttcagcttctaagcactggaaaccaatggccagattgcttcagttttctagggagtatcatggtttactaaaatgtgaggcccttcaatgctggaattatatctcacttattttgtctttctcgggcctgtgcagagcaggcacttaataaatgttgaattaatgatggatgaatgttgaatctcacatcctgctaaataagacctttattagaaatgcggcctatcccaaaataaacacgcaattactgaatgtctgaattaggtatactttccaaaaaggagaaagtttaatctgtaaaaggttcgttatataaatatgtagatgttggtcaactaagctgtgttatctttaccaccaggaagacagtctcctgctatgccctatccttttccaattcaaatggcttactgagtacctttcttaaaaataatctggataaaattggtatcaatttttcaacaagtctcatactttttataaagcctcataaaactactatcatacaggtttctggattatccatattctcctttgcattctatactgcccatggacatcaattctctattaaaatgttcatcatgagataatagcatatgcacatcaatttcaatgaccaatatcaacaaaggaggcctggagaaaactgaagacagctacgggattagggaagaaaagggggaaggataggtggggattcccttgcttttcacttagctcatctttctaatcctcaaattaatgttcaatttacacaaaaagagaactgaccctgttggtttgttgctctgcaaatattctttatatcttatctgctacagtagagagcgtttgttaccattgggctttattgagtgacagaggctgaacctctctcataaggttagccatgatgttttcttaccaacacacacacggccatccagacccacagccagtccagggaagcattcacatctgtaggagccatcagtgttgacgcaacgcccattcatgcagatcccaggggtttcacactcgttaatgtctgtggcagagaaaggcacttattaaaaatgaagtgacatttatctaaaattataacatgttgacaattatgttttaacccttgaaaatggggaagataggaaataatatgcagcatcagcaacaaaagctcaaatggcattctcattttcctttgaaagaacagtaacaaaatcaagagaaatcaactgttggaacttattttccataaaaagtaactttaatatattctcccaagagatttttgtatccaaaataatcacaaaggcaaaaacagaatcagaggaaggagaacaatggctgctaaaagacaaagggttttgtgaaatgtataaccagggtagctcttccagggctctcagaaatctagggtaatagtaaactacaggaagactttccttttggtattcatcacccagactggcatcacttctagtatcacccatgtcttggctctctgggaaaattcgcctaaaattaaaggatatacaactaaagccttgatggaacaccacagaaaaagaacagaaaatgaatatagattattttcatgaccattcttggccaataacagcactgtatgcagttggaacccagcaaagaaaaatctttcttaaactttacaaacactttatggtattttatgtgtatacttaaggaggtctggtaaaagactttatcggacacatattaataatagcagagggttttttccccccttaatatggggaagtacaaaaggcaccaaaattgtggtttggaaaacatacaacacttagaagtaaatgattttaggccaggtgcagtggctcacacttgtgatcccagcactttgggaggctaaggtgggcagatcacttgaggccaggagttcaagatcagcctggccaacatggggaaactccatctctactaaaaatacaaaaatcagctgggcatgatggcatgcggctataatcccagcaacttgggaggctgaggcgcaagaattacttgaacccaggaagcagaggttgcagtgagctgagattgtgccactgcactccatccagcctgggagacagagtgagactgtgtcttagaaaaaaaaagaaaaagaaaaaagcaaatgattttataacaactccttttataatatacaactagtgtatgggactattaactttctcctgaccttaaaaaggcaaattgagagtaaaacaccttcgtgttttacttagcttgtgttgtttggcacaaaatatattcgggtggtccaaggttctgtgtacagattgtatttgaaacagcagttatatttaaatacaggaactcaaattggttagttattctggtcaactttttattcaaattgtgacacacagcaaaacgtggagactacaacctgaaaggtaacacaaagggtttttaataagaacggagatgtaaggtagatccaaagggaggtaaccttggtcaaagttagtggcttcaactttcagagagtgaacagagaagccatgttgttgatcagatgagttaactgtggagactgaattagcattgatgattcagctttgaacagtcacatctttgtgggctcagaactaagtgctcagggctaggagaaaatcttaccctatggcataaagacaaaaattataaaaaggaagaaatccagtatacatgggattaatttcttttttcatcctttagtcttattacagtgtgtgtactctatgctctataagctagaaaaaaataagacattgataataatacagagctgtggagctctctctctctctctctcagatccttaagccagaatgctaaagtcagaacaaaccatccatatcatcagcactttcaaattaatagaacaaccaatttattgataggatactatttcactggttgccaatggttgccaaacctggtttcatctatgaggtcacagcattatctattggccatacttaatgttgggacgctgtggcctgggtcagcaggagcctagaggcatgaagagtgaatcttagtgtgctctgtgtatcatcaagaagattatgtattctcctaggtctgctcacaaaggggctttcatatctctttctattatttttttttggaagcctaattccaaatattccagcaatcattctcttcccttttcttttttacttgtacagtgctaaatttgcacaatttggcactttgttttatgctattttacactgtagaatatttctatgtgttaatcctgtcttctcatataagttcctcctagcacagggctcaaaagtacagaaaccaccttcctccttcaaatttgaaacacccaactgttttctcttgctgggaagacaggtttgcacaatattaagagccattgatgtgaaggtcatagagaatgtaggtaaacaaccaagggcttgaagttcttttaagcctggagaaaatgcacatcttgccaaggacttaatacaaggctttcttccataacacgtttaccaaagctgtccactaggggcacacagagaagaggcaccataggactttattctgctttcctctaccttgaatagcttgaccctctacacttctgcatctgaaactatgcccagaagctctaagtgcagcattttagcagattttctggacctgctttgagtatgaggttctttaagaagtctggttccaactcagatcctggaccaagtgcagtaatcactgatccctacataagacaggagacactaagcacaaatttgtctccagtaacttttcttaggaccccaattctcaacagcaaaaataaaaatcctcatttttgcttcgatacctggggcaatgagattatttcaaaatggtttaccaaactaaaaaaatggttcttggttgtttatttattctgcttaatcctgtttcccttcttgcttatgtaacttgataaagccgaaataaattatccttaaaaaaaatttctgtgtcttaagatgcctagaggaaattatgaggaagagatcattgcaaataacagtctacactattctgtccaggtaaagatgtaagaggtggcaaataacagccaccaagaagcctaaccaccattattccctaactggaaagaagaggtagaactcagcttcttgagaacaatgcccacatctgttggaagaccaataggcagtttggattatttatttgctacatagcttttgactcctttgagaagacctcaaataccctttctgaaataacaatagtcttctgggcataaactgtagctctttggatggctggatttaagaaggagtttcagtcaggtttcccaaaccaaaattcaaggtactttaagtggggagaatcagtaaagaaaggtagtacctctaaacaacataaggaggagaaaaggcacgtgaagaacatgatctagggttttatagcacgaacctttgcaataacgtccatctgatgccagctggaatccaggtttgcaaatacatttaaaactgccatcttcattgatacacattccattaaggcacatgttccttatgctgcattcatccatatctgaaaatacaaaacatacattttcttatgaccagaagagtaagcttacgaaggaaaccaatctggatgaaaataattctgtttcttcgtatttctttctttttgttattacagcctaaggctaactttcatccaaataagatcatctaaggaaggagaagatgggacatatgaaatacatatctcaagttcttgagttttggcatgtgcatgcaaactctagggctagatgtataggtatatctatttataaaatttgactccatagaagttatcaggatcctttttaggaataatagtttacaaactgaaaaatgtgctaatagcctagtgggtatatttatttcacagattcatattacttctaatgctctgaatatgaacataagtcaaaactaagattagtggaatttgaaatgtatttaggctacatcctaattcttttaaagatgaaaaccagaagataacttgtagtttgaagcaattttaaataggggcaggtaaaaagtggacttttagaatacatggctcaactatggattatagctgtggcagtgaacctttaagatcccttaaacattggggatggttctttaaattcatcactatgttattttatttgatattaaagctgtcttgggaggcacttgctcttttagacacagtgttttcacttacaggctttagaaagaccaaagtgatttattatatatacatattttagatatatataatatatatattagacatatataatgtattttaaatatatattatttatattttagatatatattatttatatttaaatatgtattttatgaatattatctattacatattcagaaatacatatatacataatatatatacacatattacatatatagaaaatatacataacatgtatttttacattatatctattttagatatatatttcagatactgattagtagcattttattactaggcagacactttaaacaaaaagattataaacggctagataatacacagacttaggtgtgtcctatttttaaaaaatgtacaaattctgattgtaaaaaattagaaagtatgaaattgtgccacagaagtttcatcacaccagggatctttaaatggcaagctctcctagcatattaaaatgttatttgattcacacaaatgtaaattaagaaatgaatatcatggaaaattaggcttccttttgagataaaatatataaaacatatttgatactttgacatttcactcattatttggtcttgttaaagacccctgatattgaaactgcaatggaaggagaggactaacattagtatactattattaccttcacagttcttcccatctcgtgtaacatgaaagcccgcattacacacgcaatgaaaactgccatctgtgttgatgcagcgtccattattgcagatccggccattctgtaaacactcatcaatgtctaaaatcaaagtttaaaaagaagaaatagctttatttaggggagttaaaattattttatttccccctccctccatttgcaaactcatgatcttggcttttggttttaattacttaataatattctccaacataaattggttatcaaataatgtgatatttagggttatcagagttgaaaagacatgataaaaaacctgtataatggcattagatgtaactctaatttctaataagactccttaaatccgaagtctgtaaacaaaatagattcttcttcaccattttccaagcacatctatttaaccagtataaatcactatttatactgaaatttggctggcatctttaaacatataattttaaaagacatattttatagctatctcagaacaatacaacatatgctatttttttaaacaatcaccttaattctgcctgaaaaccgtcaatcacatctctaaaatgtccatcttccttataccaattctggtttacgtgcagggttactgctgatagattcttagtcttttaaaaaacaactttatgagtattctaccaaccaaataaaatattgattctatgagggtatttttcctttttttctattgtggttaatattatgccaaggtacacaacagagcttgacacggaagtgttaaaataacaataactgaaacaacctgtatctgatttctcccttaaatattaacaatctacccaaagtggatagcatggttccctggattatctgtttctctcagtttctagaagctacaaacctggataaacatcaaagaggatgaacacaaacctctttgtctacacaggcacacaatcacttccagggcttattcccagaagacagggaccaagaaactatgtggagttggatgcgagcattcctatctatgcagagttgaggtcacatttgtctgagtataagtgccctaaatatcccctgaacaatgagcacgtgcgttcatggcatgtcagttactctgactgtttaccctgtgtctgtgtggtgtcttgtggttggccctcagatgcactttctttctgggcagatcctgcagtggtttccacacaagtcattggacgagctgaggcagtctgggcttttcttctgtctgatctttgtgccaacaacctacgatctttttctctctcgtttatttcttaatccttgctaaaaatcagacttgctccacactcaaaaaaaaatggtaaaaaccacatattcttgagcagactttttttttttaaggatcccataattttttgaggcccaaggttaaaataaacaggataaaaagttcatatttttctctcttcctcaatttcagaatgtcatggggttccccattgccctataagacaaatttaaagcttgtcattcaaagttctcctctactgtgtttctgcccatccttctatccccttctactcggcccctcacttacttcccagttatgtgcacagccttttggaccattctgtggcaactttcatcagcaaaataatgtgagcacgttctcaacttcttattttcaggataaccttagtgctagctcttaaagaaggcagtgctttaagtattcaggtcatcctcagtctccaatactaagtctcagattgataacaaccacatacatgagtttatactggctggtccttgccccagctgagtgctctcaataaccacctctctttgcttatttaacagtgcagtctctggacattgatttcattttattttctgttattgcaaaatgcctagtatgctatttgtacatgttaattatattaaacaatagtcataatattaagaaggttctcaactcagttacgtgttcaacctatccatatttataactaattaatagaaatgttagtgagttcaaagtccttgctccagtttttttctgcttaaaatggtcatttatatgtagtgcactaaaatacactggtggcaagaaatctctacgtgagaacaaaattcataaattttgaagccagttcactgataaaaattaaaacttctatatgtcttcaactcatgaagagcttttgctaaaagaggcaaataagattaactcttgtcaatggctaccaattttctaaagtgatataaacctcgctatcttttacttaacttttaaaaaacttttaagtttagggatacatgtgcaggtttgttaaataggtaaacttctgtcatgggggtttgttgtacagattatttcattacccaggtattaagcctactacccattggttatttttcctgatcctctccctcctccaaccctccaccctccaataggccccggtgtgtgttggtcccttctatgtgtccatgtgtcaccatttagctcccacttaaaagtgagaacatgcagtatttggttttctgttcctatgttagtttactaattataatgacctccggctccatccatgtccctgcaacggacatgatctcattcttttttatggctgcataatattccatggtgtacatgtactacattttctttatccagtctatcattgatgggcccttttatttaactttaacagagtatttgcctgttttttttttctgtctttactgaattaatgatacagttcattttgtgcttaatttagagatagagatggagatagatgtttgggctccctgacagtgatcattgtatcttatttatttctgttttagaaactcagtacataagagtcatttaataaaaggcatattgggtggcttaataaattagttaataaacctgatgggaaattttttatgaggggacatttatagcagtgcttctcaaacttcaatgtacatacagattgctgggggatcttgttaaaatatagattctgcaatagtatgtctgtggtggaacctgagattctgcctttccaagcagctctaggagatgctgttgctgaccacactaaaaagcagcaagggcttagagtgacatccctatcttttagaactttccattaagaaattaattgcacataatttcaactgaaattttcctcagttgctgtgtcataaaggacaattccactctctacttctcagatgaaaacttaagaggcaataatagtgacgagacaacaatactgaaaataagattttccttcaggcatagacgcatcttataaaataacttcaatgcttgccagattttatgacactgtctttcagaatgacaataggtggaactaagttcaaaaaagccacgggactgtattagtctcttccggcatgggttatttaaactccatggaactcctttgaagccaacccccagttagcatatatgtcccacattccacgtcaggagccaggaccatacctcggcattctgtccgcgtgagtgtgctctgatatccagctcggcactgacaggtgtacgaaccctggttgttaatacactcaccaccagcacaggggtttttctcacattcatcaacatctgcaaagcacaatgtattttagtgcaaaattacatagcaatacctcataattctaagactttctgggttccttttatacatataaaacattttccttttgagaaataaataacataataaaaggatcttttttctttccactacaatatgtcattagccatttgaagactggttgagcagttaaagtgtattattttcatgtgtcattttgcagagaaaaattccaaacatgtagcaactcaacaatctgatctaataaacattttttcttccttgagtctgatctaagaggaccaaacagactaacatttcagaagtggcttctggataggattccgagtatctcttgaagctctgtttttttccaataaaaagaaggtctaaccatatccaagcattccctgctgagttccactaaaatgttagaacaaaacatgaagcaactgttgtttaaagggcagttctcaatcaccacagagtctcccccatccccagatgtgttcaatacacaggctcacactagttttacagtcacttagaattatcagtacatttagagataaactggtttatatgaccctacttgtaaacaagaggaagctaaaatttagcaaagataacccacttgtccacatgcttcttagtgccagatacagatttgacctcacattccgcaaccctgagttagatgttcccacttctactcagctctggatgacctctagaaggggtgttcatatcatcaggaaattaaatagtttgggaaagtaagaactcatcatttctgacaaatcataaatttataattataaaagtagaattcataacagaactaagaggtgaacttattttaaaaacaagttgataggagctgagtgttcttatccaatccaaaaattgattattctttcattacatttcctcccttcaccagcttaaatgcctcatcagcaatttaaactttctttcttccatttaaaataactagtctaagagagttggtaagctacacatttagactagtataatgtgcaaaattccataatttggggatatttttaacgctttcttttaatggtagggcttttggtagggtgtcttaaattggagttaccagaaatgatttgagtatcttttacaatgaaagttaaaagtaactttaataggcagaataatgacctcccaaatatgctcatgtcttaattcccagaacctatggatatgtttagctagcaaaggagaattaaagttgtagatggaattaaggtagctaatcagtgatcttgagatggagagtctcctggattatacaggtggccaaatgcagtcacaaatatccttaaatgtggaagagggaattgcaagagagagccagagagagacaaagagatttgaagatgcaacactgctggctttgaaaatggaggaaggggtcatgagctaaggacacaggcagctgctagtagctgaaaaaggcaaagagatggattcctcccaagagccaccaaaaggaagacagccctcccaacacctggatgttagcccagtaagacttctgttggactactaacctacagagctgaaagataatttaaatttgtattgtattaagccaccaagtttggggtaagttgttacagcagcaatagaaaaccagtagagtcaaggaacagaattacaacagacccttggtgccaacctaggatggatcacgtaccaatacactccccacggaggtccagctggaaccctttgttgcactcacaccggcaactcccaggagttggaatgcagcgtccattttgacagagatagcggaccaactggcagtaatcagtaacgtttactggcagcacccctagaagaacattaagccccattaaaattattttaactatggtatctttcatcagtacttaatctgacaataatgaacaagatgttgaatcagaaaggaaagaggatactctttgggcaaaggtcgtctggtgacaacagagcatatttccaccctgccaacagagatcacattgcactgtgagcactggggagctcacaacccagctgcagcctgcttttctctgccctcttcaccacctcactctcaaacctctagtttgcagaaataacaaaggcagagagatattggtattgaactacttataaaactgccttgcaagctctgtaacctaaagtctaatattatacctcctctattaatcctttctgtgaatcagatttaactatcgcccataactctcccatagttgcctgaaaacaccaataacaaaaggacattaatctctggagaataggaagcctcccgtttttctctatgcaataggaaaattgagacatacatatgatatagatatagataacattatgtaaaccaaaaattaatataacaatttacaaacttatttaatgactaaagtagcataaataaataataaaaaaatgttaacttgaacaatgcaagaaaaataactagatgatttttgaattcttacttggtggctcccgagatggatacagatattccactggtggtcgagggaccggaatttgaggtccaggaggaaagccaggaggaacagggagaactggaggaatggggccaaggggtgggggaggatattctggtctcccaggaattaccataggaacagagcacagcttgttgaaatcctctagaaaaacacaacaaaacaaaacacaacagctgagctgtagcttatgatcataggcccacagaagtcatccttatttttttaaagatatttttgaataaaattgatcctcaaaattcacaggtcaactggagaaaagaaaaagaaccaactgactggattcccatttttaatacctgcagcagcaaccactctggaacaataattcaaatccaaaaccatgttcctcccaaaacctcagagtctttatctgtatcaaaattcacctcatggaaaacataaaagtactactttctccatccagtcccacctgtggattccacagggctctacagaatacattaaaaaatttgaattttattttatgcgcagtgcaaaaccactggatgtcttcaacgggggtgggacatgatcagatgaccattttcagaagatcatgcttacaattacaacatatgaagaacattactgcggggaggcaaggctgttgcagaagaccaagggggagatgatgatgtccggatgggggagtcagtgattgaatcggacagaagtggacaaatctgaagcacattttagagataaatgtgtagtgttcagtgaagtagatttttgagataaatgtatagtgctcagtgaagtagtaagtgtcagagctcaggacacaagaagtcaagaatgactcctagttttctggttgagcaattgggtgaatgttggtgcccttgcctggacgggaaaaatcatggtgatagcagatttggtgggtagaaaccaagttccattttgaacataggagttttgagatatcagacatccaagtggagctatcacttcgcagttgtaaaagacagtgtgaagcttagacgaatcaaggctagacgtgagtttcagagtcatcagtacagagaggtgatactcaaagccatggggatggatgagctcatgtaagagtggtgtggaaggggaagagaagggagtgcaaagacagaaccctgaagaatactgattcgtaaaagaaagcaatatcaatggagaagtggcccataagggaggagaaacaccaaggggtgtgggtcgggtatgaatgctgcatagtgaccctctgaatgaggacatcctgacttcatcatctgcttccctatgattctacatttttaggatgattactatttttcacagtgtcaggtctttatcaaataaatcatctttaggtttccacacatttgttctgggcttccaaaaaggtgtttttaagcagtatccaggtttccaaggatgtatttattttatttattttcatgttgcctacaaatagccatgttttttcatagttcccttctataagtaacctatgtgacttttaaatttcatttttttcctcttttgctaggattttggtaattttattttcacagttgtacagtgattttctcatggataccttctatgctagtttcagccattaatagaaattagactaatatttttcttttccttacagactaaaatttaacttattttcagacagtaataggtcttactgaaatgcattcatatttcaacctcacgggacattctgccaatttacatgaggttaaataggaaagtactgttggtactttctggtccatttctaaaatttcttcattcatatttgacatttccatctcaggtcaagtttatgttttcagataattctcttacagcattttaattacgatttcactggaatttcaaattacagagatactgacgtacttgaatgtatttgtaaaggaattctatgttgttcatgcttccctgactcaagatgtctcaatcctgtttgtcaaccaacagtgattcttcctatagatttatcatctgtacgtgccatatccaccattccctgggaacctgctctcaccaaattcccaccactaagactgtgtagtctgtgaagtcagggatcatctctaactcatgactagttcccactctcagccttgccctgcaaattgcacataacaggaattcattaactatgtgttaattttattaaatgacagttacattaaggaactcactttgcttccaagcatttgtaggtaccaattcggcctttctttttaagactttttgaatttatataaaagaaatttaatagcttatcagcatttctgctaattaggtgggtattttactttaagaatgccattaaattcatcttaacctctctaggaaactgtatcagactgaatctgatatttcttcctattttttacagatttagtaatcttctcattgcccctttacattcaggatcagcaacgtggggctaattttgttaagctgatgtccatctttcctatctccacttaacccaagatgatgctgatttattttttaaagagtgaaaagctggccaatctaaaatccttcctgcatcactctctgtaagagcccagatctctgtagcaccagtactggaacatttggacaaacaaaaacctacctgcaagttattttgctctataaatctgttttgcccaaggcctctgagggctgtgcatctctcagtggtatacctgggaggacagctccctgtaaagccacacacaggaacctggtcttctgctccaactgtcccaaagtaggtcttcctgcaggcacctaaacctgctctagtcctcttctctattcaaagcctcaacacaggaaggaatccacatcaaagctgctgattcctaagttaacatatgcattttaaaagccattctcctggtacctaagccatgtcttagtaggaagtcatgtgcttctaaacagtgatctactaaatggtcccctactggactcaggaaggtaaacttcatctatgtatttgtttatttatgtattagtattttaattgacaagtaaaaattgtatatattcattgtgcacaacgtgatgttttgaaatatgctcaattggtgggaaagatgttgcctaataagttgctctctgtatttgaatgcctcctataagcaagattttgctaaatactatggaagtgtaaaaagcatgagaaatatgagactacaataatgaatgagatttcctaatgagattgatcaaccagtaaaagagcaagatgtgaacacacatatggcactcatgccatagtgatagtaccagccagaaccacaggagcacaaggaagaagggagcacttccagctgcaggtacctcgggatattcatggattaggtcatgtttgagcagatccttaacaagaaaagaggatatataacaggcaaggatggcaggagtagggagaaagagcctgaactggcaagaagttttagaaaaaaaagccaacttgaattcagaaatgctcggattgggtgcaatgaaaactcaatcatataatttaaactactataaagaacaagaattaaaaagatgaactgggattagatttgggactctaaatactgtgctaagtagcaaatgttctttgcaagaaatggagtgaattggccactaaatattgcctgagttcatcctggggaaatatttttggacatctttctcgactaacgaaagtgtgctgtatttatgtatttgtttagttatgtatttttaaactaatgaataaaaattgtatgcattcattgtgtacaacatggtgttttgaaataggctcaattagtcaaaaggtgtctcctttttctcccctagacacaattttttaaactgaacttcactgactcatactttgggaaaggtacatggcaatggtggatttcagagactagttaggagactactggaacagtccagactagagaaaatacgcttctaatagaaacaaaaaaatggacagataaaagagatactgtgaaggaaaaaaaaaacaagcaggacttagcaggaaggaaagagtccaatgttaggaaaaaggaaatgtgtctcctgaacaacttacctgaaaaattctgaaagctgagttttactctactgagcttttgagtactccatgagagccattaagtactaaaatgagaataagtacttccccaaaaggtttctgtttagtagtaataagccagctaagtaaaaagcagtacctgaaaacagtactctttgtacagacccctttttttttcctgtgcattttctagggaaatttccctggacgtcatctcttatatttcctggagactactcatttacccaagtttccattacatctgcatcatgcacattgccactgggcttgtgagggctgggatgggatattctgcagataactggaagggctcttaccggttgctctgatgggacacatctcaggggcgacagtgacccctggagaccagcatcggccggcatcacagcagcactgcattttggttatggactgtggcagctggttagagcagcgcccgtttgtcagagctgtgtaacagtatcctgggcgaacatctgaggacaaagaaacacatacacacacacacatcgctgagataatacttgtaacaacactcccctgcccgagcagctccatacttcacactggggctacggcaggattaactcacacctctgccccccggaagggaagctgcgagcgctgcacaggaacagtgctcagtcagaaatccctggtctcacaccttttgcccctgtgtgctagtgcacttggctgaagtcccacattccatacccaaggtgggaacgagtgattaaaaccatgtgtgccataggaaaagagagactaagaaaatcactagcagtgacagtttattatttataaagacatgtctctatgctgaagagagactgggttgtccctggtttcaaactgcttaattcgagccattttaggaaaatatgtaaatctattttaaaacaacatttagtctacatttctaaaagatctttcttattttccagtctgcaactgtgagagtcagacataagtttttgttgttgttgttgttatttttgaagaatgagtcactttgcatttagatccaatgcttattaatcaagatttccttttgtcttagggccctaacagattttataaggtactagttatttataacttcaaaatggcccttgattccaagttcttagtcctataggatacaatagctctagaaggattttgttgttgtttttggcagaaagtgtcttctcaaagcaacatggtaagacgcatttctatatcacttttattgggttacatcatgtctaattgtcatgacatccgacacactgcagcgcagctctgggttacggaaagagtttgtggcataggaaaacctaacttctccatatgcctttgagatattaccacgaaacagtgaaggcaggtaagcaaaatgcaaaacacttttactgcctgacatgtgctgagggtgtacctctcttcaagtaaactatatctctacagagatcatataaaattaaattttgaaaagcaaataatatcgtcaatatgcttgttatttaaagcaggggtctctaacccccaggggccccaatccccagttctggtctgtggcgtgttaggaactgggctgtacagcagggggtgagcggcaggtgaatgagtgaagcttcatctgtatttatagccactccccattgctggcattactgcctgagccctgcctctgtcagatcagtggcagcactagattctcataggatggtgaaccctattgtgaactgcgcatgcgagggttctaggttgtgtgttcccaatgagaatctaatgcctgatgatctgccaatgtctcccatcaccctcagatgggaccatctaattgcaggaaaacaagctcagggcttccattgatctacattatggtgagttgtataattacttcattacatattacaatttaatatgtaatattaacttgtattaattaatttaatacactttattgtgtataataaattaatattgtgtattaatttaattaatttaatataatacactttattgtgtataataaagtgcacaataaatgtaatgtacttgaatcatcctgaaaccatcctcttctcccagtccatggaaaaattgtcttccacaaaactagtcccttgtgccaaaaaggttggggaccactgatttaaaggaatataagggttaaatccttttgtaaagcaaagatctttcatagccaaaaatccatccctgggtttcctgtaagtctgaatattaaatttcaagttttctcaaagagggtcatacctgtaattgttatcatctacatcattcttaagaacacaaagccctcatgtcttgaggtttcaataaattaataaaatgaaataaaataaaaacaaggctaatttagaaacatttaaattattaacatcaagtgaagaagactaaaaccaacctagacaaaccataaaagaaaattatgggtcagttttaaaggatacaagattatttccgaaaagtacttaaaaccactagccagtataaatgtgctttccagaatttttttgtggttccagttcctgtacctctggtcagactaatagtttcaccaaagaggcagaacaagttttattccagcctggtccaggataaacggctggagagggagtatagacaagtatgctctctgtgaagcctcaggtggtacctcccccgtcaagagggcagagaaattgaacttcctacattctaatttgtaatgccttaaaaccactaatactttatatacttgggaattagtaaatatttggggcatggaaaccaaagactgttcagaatgggaagagatattcaaaactggcttatatcccagcttcaaatgaattcggtggtcaaaacccagtgtaaacacttgaccaaattatggaatttgtacatataattttcagcatgggctatctttcagagcaaaactagggcctacagttgccaatgacaaaagcttaatgggctaatgtctattattttgcaaatcaactatgataccatgttattgcccatctggctgacttatatgttaaatcaatggatcacaaactcttgatcaaaatggtgaatgttgggggtaaaaaaaattacaaatcaagtttgggttactggcagtccctgatttacagatggcacctgcacatataataataatttttctaatttatttttttgctgaagaagcacctttgttaaaaatacacatttatataacttataattttaatgaaaacctacaggctaataagtaaaggaagaaaaaactgaaaattggaaaccatttggagtaaatgacctccaggacacagcagcctgaagtttttcacttcgttaggcagcagtgccacaccaagggtggctgggggggggggggaaccgttgtggtggtatgtcactttgtacagagggtaaggggtggctgtagaataacttgaagaccttcaggactcaagctaaggggacataaagggacacagaaggaaccacaaacaccttccattttaaatctgccctggccaagacatctggcgaagaggaggaggaaatctcactcttttctccccttttgaatcacttggcccttattctcaggacccagaaatcacattatatcaaagcaaatatattatggattaaataggcgtttgcaggtcgtctagcctgtcaacaggcttctcctaacctgtcacgaacatggttgtgtacaaccaggagttaggagttgtgaggctcaaactagggaaaggacatctttatgactcctaggagtcgaagagagagaacacaacaatataaaaagacaaccctacaggcaatattacaaatgccacaggaagatcacagaacaagaaataaaataatactaaaagagcttagaacacaaagggagctcggggctgggaggtctgagagtctcagaatgtggtggcagcaggtgacagttggaattttacggttagaagaaatgtgcacggaagatactgcataccactatctacataggaggttttctattggtgagacctactcattccaaacaactgtcttacgaacaagccttggatttgtttatactgtcaggggctatttgtattttctcatcactacggataattttgggggtctctgttgcttaccatggagggaaataggagcaccagaaggcagaaaggtcacttggatcattttgtatgacaagtgtctaattatgggcacaacagagttgcaaagaagaaacggggcttgcctagggatctggcaagaaagagtgaactgcatccagagttgaggggtagaaggcaaaatgagggaaatctgggctgtgcactcaggtcacggtggaatcccagatccctctctcactacccacttaaactattgggccattatttatctaacctctctcaatctcagctgcttcccatctacaatactgctgtgaaatgaacatcaagtcagataatttacataaaacacctcataccctgtgatccatgaatcttagttcccttccattcctcctttgtaaaaagttagtatggatacatttgataaaaagaaagtaacttttaaaatgtgaaccatctgatatgtaaatatgtcttaatcctcatgtagtttgaagctctcttaaaatccttaaatatcagactgtgcactttggaacttgaattttaatctagaacactgcacttttaaagaagtcttaacaattattaaatccagcagctgtcaaatctattttttttttttttcagatgaagtctcgttctatcgcccaggctggagtgcagtggcgtgatctcagctcactggaacctccacgtcctggcttccagtgattctcctgcttcagcctcctgagtagctgggattacaggcacccgccacgacgcctggcaaatttttgtatttttagtagagacagggtttcaccatgttggccaggctggtcttgaactcctgacctgactgaagcaaactgcccgcctcggcctcccaaagtgctgggattagaggtgtgagctactgcgcccagccaaatctattttttaaacaatagaacccctgatttaattgatacctgacatggaagtctaacactcacagcagataaagtgaaattgctatgcctagaatgtgtgtgggagtgtggggggacaagagccctttccactcagctctctcccttttctctgtgccctccgcaatccctgcagccctggagggctttgaaacacttgaaggatccactggacacagactgaaaaccactaatttctaagtcctaatggaaaactaccgagggtttgagcaagagtgttatttaatcgaagcactattttaggaagataaatctgacaagatggattgtagagaagccaagaagcagggagaccaattaagagattattgaaaaaattcaggccaaattaacataggttctggggaatgactgaaggtgggggtaaaaagagagagacacctgggatggcttcaaggtttaatgctgcacgactgcaacattaattaatagactgaagatacctgtaaggtctcctggatcatccctcttttatgggaggcaaaacgtctccaaaatgaccacaaggtgcctctgttctttaagagggcagtcaactgtttaacatttttccaaaaatgtacattttacctcagttgataaattatatgtgctccttaacaagcttgtttagaaagttgtttgttatggaactgacttacacaaaccatgcatgctgtttgtcattaaacctacctatgcatctggtaccatctggagaggtgtaaaaaccagggggacatttgcaaaagtaactgctgactgtgtttgtacattcacccccttcacagattccaggaatggtgctgcattcatcaatatctggaatataaaaaaaagaatctcagcatttgtagaacacaatataaaaccattcgtcagtagaaggactcagatgttaacactagtcaaatcatgtccctggaaacagccatcattaaaaagtaaaaaccgcatggagaacagtcaattcaaaggtagatgctgcttctttcaacacagacttacccaaaagatttaccaaattcaacagattagggcaaaatgaaatcacccccctttaaaatctaaacctgtgtactgttgtttcaccaagtaactatagcatgttaatgttacaaatgtcatttattttaaaattttgttttccttttgtttccatgttttgcattaagttaaactctcctactaattattttatattctgtatcacttcttgcgctgcttttcaatctattttccacaacgcggatactggaatcctacagaagagatcttgtggtctgagtgctgatcccaacttggccaacttggtgttctcagtggcacccaaactaccattatgatggtcttctgtggttggtgaatgaactgtgatggacactgggtgccctaaccaacgtccccttcaaagagggacttgctgcccaggaggctgggaatactgtcaacacacggtctttggctctcagccccttctaagattgcctgagtcgcagagagccacctcgcccgaggtcacacccttcccaggcacccgacacccaataagcaattgtgaaggaggatcaaagtctggtgcatcctgccccaatgggagacaacactgaaggcccctccgattccccaattccttctggggccagtggaggctgttgatgggctgcaccccagcttgccttctctgcacgctcttgcctcttcctcttctcttctgcaggtgttgatcccaaggacatcctctaataaacatcctgaatgctatggaggccaaagctggggttagccctcagggcttgacaccactggttcccatcaaggaagcagtaaaattcccttaggacaaatatggccatttccttcaaggagaggttttcaatagcctgacccacacactgacaaatgtcaacagatacggcaccagcagaagaagagaaaaaaatgacagcttccttcttaggctagaagtaaactcagggcacagggaatctgcatggcctcctctctgagaccagcagagctttctgcactgaccttgggaaaggagacatttgagccaggcctcctgggagtattacaatggccaggctgacaccgttaaaactgggaaaggcttacaacccccaataagaacatttattctacaggctaagtactctcttcatttataagacaaaatagagttctaagtgaaccagattcaagtatcttctgactcaagttcaccttgttagtaaaaaaggcagcaatgacagtgtttacatgcagtttaacctttttaaaaccaaaatcaccattcttccatgctaggctagaggctaaaccaaacaatatttcactgcttatattagagtcaatgctaacataaacagcactgtcattgcaaaattatgtaacggtaaaggtgcatattctattctgacagatagaaatttcattagagtctgtgaaagggtcaggtagagaaactgccaagggcagacagagcctagggttacccacgtaatatctcaaggcagccacacttctacttaacacaaacaaaaagcaagtatgtcaaagagcctacaggattcaaagcttcatttaaggatagaggaagctataattgtaattaagaagaatgtacctttttcaaagtgtccctaaaagttagtatctgagtcctacaacacctgccaaagatcgcatgaggagacaatgtggtattaaatattttttctcaacccattaatataaatgacagctaccattcttattaaggccacttagcgtacatcaatatctaaaaggtttaaatgacagcccatgtcagaaaaatttgtttaaacaatagaattaacattggcagaatgggggaaacatcttttccatgctggctgagtgagatttgggccctttattgaagataacaataacaagaacaataatgatgagagtttgcatgtgctgagtgctagacatagtcaaaatgctttatgtgtacccaatcatctaatccttataatgcaggtaggactgtgggcctgattctatacctctggtgcccaggtacgcctcttgcattacactgaggccttcagaaaactgacatgaatcaaacctgaaataagagcaaagaggcccatcatttataaagtgaggctaaacccaagtctccaactggcaggggtttttagggtgggtgtggggagtttccacctaggtacatgcctttgaaagccagcaggtcaggaaatatgtcatagtgcacacctccctgagttcacatagattaagataaaatgggactaggccaaattgttacatttgaaagagcttaaacgacttcaaattccccttaatatgtccccttctcagtgacacacccttttgccttcaggtgtctagtgcctttcccctttcctaaaccaccttgtttctcagtggcatggcttcgtaacaaataaaagcaagagttctatctattaccaggctgtggtggaaagttcccgacagcaaaggccagaataaggtgtttgaataggattgactcacactctgaaactcattcatatgaatttattatttctccaagttcttcccactctgtgttcatctccttttaattgaatttgaggcatcccaagttaagagggaatttgagaacggtcactttctcagtttctataaatcaggctgtgtcaaatgccagccatgaaagcaaaccaggtggggacgcttgctggggagtggtgcttggctgggaagagctatttccgtgctctggacatttctccctgcttccttgaggcagaaaaggaggcagagctgctggggagtagctgtcccatggtagctgtccatgaccccactggcttcttgctgtgaccttaagaagagtcacaaatggcagatctcttccttccttattcgccacctgtcctttgtttctgctccttcccatccttcagtctcatctgttctcccagagcattcttcccatgcctaagccccttcatcctagggctcctctggcagaatgggaggaaagagtgtggagggcagatggatggagcttggtgtctgttctgggacaggcatcaccatctattacttggctatctagaagctccatccaagattgtggacttgacaagagaaacctgatcctgacagttaacctgatcctgactgcctagatactaatacaatgagagaaaaaaactaaaaactgtggcagctgtttaaaagtaacatgtgacacactaatgatcatgaatgccactgagcctgtgagcttaactttgattgtacaaactcaacccagtgtaaaatgtatcactaaaaactaaacaagctgactcttcatgttgacaaaaacgtcagccatactattttatagtcacatcacgtacgccagcttttatccatgctgcatccgccgcccgatcacaacttgaaaatggagtctgaattcttatccatgctgcatccgccgcccgatcacaacttgaaaatggagtctgaattcttatccatgctgcatccgccgcccgatcacaacttgaaaatggagtctgaattcttatccatgctgcatccgccgcccgatcacaacttgaaaatggagtctgaattcttatccatgctgcatccgccgcccgatcacaacttgaaaatggagtctgaattcttatccatgctgcatccgccgcatcacaacttgaaaatggagtctgaattcttatccatgctgcatccgccgcctcatcacaacttgaaaatggagtctgaattcttatccatgctgcatccgccgcctgatcacaacttgaaaatggagtctgaattcttatccatgctgcatccgccgcctgatcacaacttgaaaatggagtctgaattcttattcatgctgcatccgccgcccgatcacaacttgaaaatggagtctgaattctggaactggaaagaacccccacatagcatcttgttcaaccccctcatttgaaagctgaagtaactcagagatggtaattgacttatctaagatcacacaaagcattagggacttgaccacggggcatcaaggacgggagccaggcctgccttatttccagggctctttgaccttcaccgcagagatttttttttttttcaactaattgtatagagagagccagttaccttgaacagtgaaagtctagggcctgcaaacagctgaaagaggatggagccccatctatggtagtgggttaagccgccccgggaattctccttagctcctgagaggataagagcccctaacagtaagtagccatgagataaatatgctattattttggaaaggggaagtcctgaggtttttggctcacatattatggagtgcatggatttaaaagctacacttttaaaaaggtcctgtgcatcatgcagtgctattataattgctaaaggctgggctggcgataatctaaatcccaaaatattagtggttaattaggaatccaacggacttcttccagaaataaaacttaatcccttaattacgctttttatttcttaatttcctcccatagtaacctatgcaaatatggacttggtttccaaagaaaaatgttcatgtgttctttcagcatgcgtactctacagtcattggaaagatcaacaaagaaggtgggcatgaactctttccttttttctcaaatcacagctataaatctcaatcttttccttcttaaatgtatgaaaatttaataattgttatttaaatcccttcaacttgttaatttacatttcaaaatgtcctccaattatatgtatttataaaacacttttccgtaacatttcttttttttttagtttttggaaagagggacattttaggaaggaagtgagaattctgcaagaggaagatctcatggaaagcaactcgaataatggcattctcagatctgagagcgtgagggttagcatcttgtgaatttgctaaagccaatttgatggaattggtttttcttgaaaaaattctatgaaaagtactcaattccttcccctccaagtctaaaggaagctacctttaaaaagccactcaaagcaatggcaaaggtaccaggacattttcacaagggcacagaaccccatggttatactcatcatctttctagggaacatattcagtgattacgggccagacttcctgggttccctctattggccatctagacaccagccgatgcccagagttatgccatttccacagtgagacactgtaaccggaaaagagcaaggacgtcgaaaaagtgaacccggcttgccaagagctctcagggtacttcctgattactttcttaccagagtaagacaggtcaaccctgttcacaccagtctccaggccagagaatgtatagcactaacaggacattctcctctagtatcaattttgcattgatactagaaggaaaagaaggaaaaaaccattatctaaattaatgtaatagtagatggcaaaggaaaaaaaaatctagccaaaatagtctgtttttatcttgctgctgactttcacatgtagctggaaaatttttgtgtgtggaaaaggattaagtaatagactgagtttttggtccactggatacaccaccataataggtttcttagcatcaataaaaagattcgaatgatttttctttcagtctgagcattaaattagaatcttctgtctagtccacatccatagaccattcctgttaattgacttgtctgaatgaaaagcaagagacaaaatcaattctactcaggctggaagccatcataatttcagaaaacaaaacacagactggacaagtcataaggactatactcccctcaatcttgaagctgattatatattctgaagctgaatatattaaactgagaaagcctaaaagataaaacacaacctatcgttgatgtaggttttgcatgtgataaactttaatggcttgttaagttaatgtcatatatatatgtgtgtgtgtatatagatatatgtgtgtctatataaagatatgtgtgtgtgtatatgtgtgtgtgtgtgtatatatatatgtgtatgtgtgtgtgtgtgtgtatatggcccgaaaatctattccagaataataactttcatctaggaaagaggacaatgtaatatggctcagcaagcaccagagtgtgagttaaagaggtaaatttgagcagtcttgtctgaatggcctcagacagggtacttaatacacccaagacaccattccttaatatataatgtagagtgtggaaatagctgagttctttgcccctttcagtgccaacattctctgcttcaaatttagatctacagtacaacttctaaaatacattggcctatcaagagtcaactttattgttctttgaaacttaaaatgtttttttaagaagtctttagaaagaactattttttcacaactaccccgaataactatgtataacatgttcaagaatgcagtatcaattataaattcaatgatgatttataacctaaaaacaattccaactcataaagatagttctatcagagttagattattcagtttcagggcaagtagatattaaatgtcttacatgtaacttatgaattgcaccttaaatttaaagctgtcttttgctcatctgatatacagtggcaactgacaaggttaattatccagcccagacaaataacttagaatgtactcactgttagagtctaggggcataaatataacagcatctgttttcaataaaaatgcatccatctaagtgaaacctcaaggtggggtgagttgaggatgaaggaaaaagttttctcttctgatcttgatgagagatgtagccctgagaatgctgttacactattgttggacattactatatataagttacatgcactcatcaaagaaaagagagtccaatgctgcctacatattttctagatgctcccctctcacgaagaaattatgactgtaattggaagtcaggcctcatttcggcaaagagcagtagcagtagtggtgactataaacacatcctctgtatatatatttgtagaagttcaatctataaactaaatgtaaatataaaaattatctcaaattacttttctgtttgactaacattaaaagcttttcatttgataggcaattaccatcccccagaaaagaaaatcatgagcatgtactaggagcataaatataagggttaatagatcaatctgcctccccacacacaaaatcaaacataccttttaactagaaaaacttcggaagatatattattctgaatgatatctaatgaccaaatttaaattcatgtctctagaactatgcaaaaacatgtgtgttgaacattttaaaccaaatgttggttcaaaaatatttcatgtttttaatatttaatttgattcagatggacctcttgttttgggtctataaaagtggaaaaagctacagggtttttctggtccaatagcacaaaggcatattattactgttaaaaatattatatttacacattcacagggatgacaaagacagaaggatttaggaataatttgcaaacaagcttgtttctaatgttgagttttgcctgcccccactacaccccccaactgcaaagcataagatttcttaccttcacatttttgtgacacttcattaagtttgtgtccagcagggcatttgcactcaaaagacccaacagtattaatgcaatttcctccctgacagagcccggggatggcctggcattcatccacatctgtcagattacagaagacagagagaaaaaaaaaaaactcatatgaaattcattgcagaataaaatgtgataatttgtccacaattatgttaccatatttatatcggtgagttatttgtccatcacaatatttggaatatgattagagaaactgtttctcacaattgcattatgtaaaatacatcgtttgattaataatgttccataagaagtcacaagtattttttgttttcccaccttccatgtttcctaatgtagaggagagtgcattaacttttgcgggttttagcacatatgcagcaaagtataaagatacgtttaaaaggccattattcacggcctcatttttatctccagattggtagtaataatcagagttattcaaaaaatcttgcaaatcaaaatgcaatacatttctacaatgaaactacctttaagagttgtactgagtgatttagttaaaacggaatttattgaaggtcactcagactacacgagacagctaatgtttttgcgcaaatgaagtggaaatgttcacttcacattctggagaagtgccttgcacagtaaaaattaaacaactcagaaaattaggccaagaagtgagagagattgttaggtgagtgagtgtgtagtttcagctgcagacttaccttgctggcacagtggccaccagaagccacttttgtaaatgtcagtgagatcatgtctttccccagctcaacgtgcaagtgtgtactatgtcctggggagttcgacatgacttctctgatcttttacccattttccaccctcctatctctcccaccacactggattcctcaaatatgccaaggatgcacctgccacagagctctgtaaggctgcccctctgcccggaatagtcttcctccagagagctgcatggcccacgatgtctcatcctccaggtctgtgctccaatgccactttagccacgagcccttcccttgacagtccaacagcaacacctggctgctggctctaatcatccttccttccctgtttatttttttccacaggactaaccacccactgacctaatacatgcctgtttgttttatttaataaattgaatgtcttcaaaatgtcttcaatataagcttccagaaagcagggactttgtccattttcttcactgttgtataaccagcacctaaggactaacttgggttcttatgtgtaagcccaaatattaaccttccaggagcaaaattaatcatttcaggctcactacttttgttataaagattataaagtacatgtacattctctccatctctttgttcataacagaaaagtctgatttaataaagaatccccaagcaaacagtctaatgtattctttttgaaacctggaagcttaatgtgctctttagtttcactcttcattgagtaaagaaaaaagtgattgctgtttataagatctcaacctgtgttcttgagaaaagtcagcatgcagtaaaagggatattaaagaaacaacaatttagtttattataaaagtatcacttactgttttaaatgaaatatcttaacccacagatacatgattatatgtggaaaatcattaaattatgttttctagccaatttcagttttgtcttagaccagaattttccattctcttgatgtgttgaatgtattttttaaaatgtttttgaaaatcaagatttttacatataggcagaactagctgtcttgttgatcatgatttctggccaacagaaaatatagacaaggcaattctccactggctgtatactccaggtctgaagacagaataagctcctttatgaacccatttgcccacagcccctcacatctgacccaaggactggaaacaccagcaaggagcaagagccacaacctggtggcagaatctcttagaaaaaacaacaacaacaacaacaacaacaaccaaacatgaagaatttcactctcaaaatagcaatataactgccattgtgattcaatgggttttcaaaacttttcttataaaaaacattttttttcttggatgttgaatagcagagttagaaagaaacaggaagcaaatgctggaaagatccagatttatgaaacgaatagcaaagctaaagagaaggcagttcattatccccacccccccaattccattagcaccctaacctctgacaatgggtcactgatgggcagctgaggcagttaaaagtctagctctctggtcactgtcaacaagttcatgggtattagctaactttgtaatcccaagatgaacaaattcttcaaaactcactgggattttctaaaaacgggaaaaataagaaggcaccaaaaaacaactaaacttttgtaaaatactacaatccatcccttgataattttagagtttcaaggtgacttatttcttctcctgacattcagagggatacatttaagggcatccaaaggagctgtatgttgtacatgggagctgaaggccaggaatgacaatatcagaagtggaatttattgaagtggaatgtaatggagacccacaaaactgtgtgactaagctcaagttctgttttattgcacattacccttagaattaacatacaaaacaacgccaaagtattatctatttgcctcagaaaagcatatcctgaagtttctgaaaatattgcaacttgctataaaaagtcctgaggctgtctaaaggaaacagatacaggctgagagttttcaatcccatcagtttagtgtggagctgcctctgttcacttcctcctgtttcctgccagacatccagacaataaaagaatttgtacagctggaagaacaggagtaaaagccaaaaacagagtaagggcttctacgggaggcaggagaagcagctagcaggcgacatctggggatatttaaaactgtgaaacaaatcctaatttattttggacttgtaaaaaaatgcaaaatgtagcatgcaaaatgtcgagagaaacaattttcttcaggtcaattaagcacaacccatgagagaggaactcaacagtttcaaatgaagaaaaaaaattaagaaaaacataaactaccttgttcacaaaccttgctttgtgtttctacacagcactgccataatgcactgcatcgctgtaaacagaatcacaccacccctggagtcagaggtacatacaaacacctctggggtcagaaagggggaatggttggcaagaaaacattcagtaagacttcagctgctctctcgagagccacgttcctaatgccttagttggatatcatgcagtcagcgaaattgtgaagttatgtagctgacactacttttccattctcttcaacttcattggagaatggctctccagagcaaataagattaatccattaataattccatcagcccgggtttaccttgacaagctcccgtgcggatatttggaatgaagccacggcggcaggggtgaggctgggcaggacacatctcacaggggtggccccaggctcggccgactgtggcacagcagagcgtttttgtgcagacaatcccgctgagttgtccctggcacatctggttgctgatcacagtaaaacatgggcctgtcctgtaatctgaaaataaagaataaaaatctgatgaaaatccagaaaagcaggaaccatcatgcagaggaacagctgtgctccatcttgcttgactccaaattgagaaatgaatttcagggacagaatcatgcatcactgtccctgtgtaaggccttggatagaccattctacttctgaacccgatttcctaacctacaaaatagggatgaaaacatcagttgttacccactttgaaaacggcattgtgaggatcaggcgagctaatggaaaactctttacaactgtgaattgctatacaaatgtaacatggtaatattattatccactcattacttaagaaaatatatcagtgcctacactgaatcagctcctatgcctgatacagatgcttcagtgactaaaagaggccaaatccctgacctcacagagcttccagtctattgttatttagggctgagaaagcaaagaattttgaagcttgcagtgaggcaagtcatggcaccttcttcctgggagttccttcaataaaagaaatggttatctgtttcttttgagttggggtcatcttatttcaaatacaaaacaagcaaaccaacaaacaagaatttaaaattttgtccatgcaaaacacattaggttttaatataaagagtgaggacactggtctgaaatcattgtaacccctaggcaaaaggaccatcttaaagcaaaacagggataagctaagtccacaagagaatttccaatcagagcagtctaccaccagctataagatctgcctcttttttttttttcctacagagagagagccaacaacaaataagaaagataaagacgtagtgagcacagaggaccaaacccaggttgtccccttgtgagagaaatcagggccataatatccatttccgtggttctacaatgaccttgacagacaagggaggctgggctggggtaagactcatgggcttctatccacaaaccaacatttgcatgcttccaggtcattttcagaagtgtttaggtgcagtgatccctgtgagtctaaaaatggactcaatgaccccagtaagttcctttcacctgtgaacgcaacagttttatgaaaatcactggctgtgctaatgaaactactgggatgctttcattattttcttctttctttaagtagctcataggacatcgcagacatgctatttactaaggaaaaaaggacaacttttcattacagtaccagcaagagtcaacattctggatcgtaacaatgttttggcaatagctgaatcttatctgctggcatccctctatcctgtgtgttctctcttgctttctttttcttgcatctccactccaacccctcccttggaatttcaactccatctgctccccatcactacgtgctcttcctccctctcctctgctatctgcaatgaaccacctctgttcaatggtgttgcagaaacagcactgctctgatgcccatgctgtaagatcaaccttctgaagaattccaaaaacaaaactccatgccagtcatatatgtaaagaagactaccatatccaagctatggcagcactggagagacagacaggatggtccaaatgccgagtccccagttccccagctccctccctccatgccagtgttatgtcccactcacaggatgcaagataattttagattttagtagtcacatattaattttaatgtgtattatgaaacagcataaatatatcagactcatgatttcacagttatgtctgctatgaggatgatgaattgaaaaaccttttaattcaattttttaaaaatattaaatactagtacaggtgatatgcaaacaggtcaaaaattgtgtgagtgatatctacatgcaaccagactcaccatgccaaaagacaagcctaagacctctgtgtccctcttctctgcatgatatagccccacccacctttccagccctgtctcctgacactttctctgtttatcatttgtctttttttttttactttgtttatgcatttcttactctactgtttttttagttttatatagtcaagctgtaggtatagtttaatattttacattgtatgccagatttattcaaaacctgctatcttcttccacagatactgaattcaaacaaaaatataaacaagtattaaatactgagctgttgaataaatctcagccctcatttcgttctttcgatgaagaaaaagtcactcagcactgcagtaatttggaacaaaatctctttaaaatgcaggaactatgtggacaaagtgaaataccaaagtcatctttatttttttggctcaattctcccaaacaaatacctatagggatttaataaatacatctttgctgtttggtctttcctttctatttcaatattttattatgtattttaattcaaaattaagtaattactttagacaattgagaaaaggcagtagcatataaacaaatgtaattacacctaaagaaacccttgataacgtattgattatattatcgtacgtaagattttgtgtgtatgcatgtgtgtgttttatttttttaatcataaaataaggattatactaaaaatatacttttgaatcctgctggattttcttcacttaacattgccaaagctttttcccatgtaataaatgctattctacaatatgattttaattgctgcataattttccatcaagttataacagaatgtgttcagtaattttcttactgtctatcatttaaattgcctctaattcttcattattacacatagcattcagtgtacattacaatgaatccttttcaggataaaaacagtcatcaagatttttatgactatatatatcctacatctgagactagaaagatcacagcagtgtaatcttttatttaaaaaataaataaaactctccatgttaggtaacaagaaagagaatttaggcttgtttctttctgttaatttactgagacaagtgcaaatgctttaatcaaacagattcaggttagcttgccatattcaatcctttttaaaaagcataacgcaacatgaattttaatttataatcctctcttcaacactgttgggatttgtttttccacctcctcttgccaagatactctatggaattatcttatatatgaggattgccaaggttcaggatagatacaaatatggtgttttgtgagtgacaccagcaaaatccagacactctacaaaatgctaatacaaatctgattcagttctgtctgccactgattcataacttcacatgtgaatttctcattggaagatcttcattaaaaaaaaaaaccccttaagacttttccagggtcaataacgtattattcttatttcaatatgaaatacatagaatcgagatggtagttgttaattctgacaatctatattaggcatcccaacagtccacagggatccaatttattaagtatactatatatttggcgaatactttatgtagaatagaaactatggacttagtacatttctgtgctagatatttatcactatagacaaagttattttggaaacaaattcaaactggcttatttgacagtacagattagcaagtggatataaatgtatttgtagatccatattttaaacaaaaattgctgattgtagagggagaggcataatctggatgaaataaaattggatctaaaaatgtcttggaaggtaaatgctgtattaacatggttttcaaatgtcattccgatttggcggcatgtgcttttcgtcctgtacttcatttagattgccaaggttatgctgtttttagtccaatactccaaccgcagaaagaaatctgcccacactcccaattccttactaataatccaattatttacaattattcccatagcacttacatgatattaagctaaatttacatactcttttttttttttttttcagatagtctcagcattagacagggagtgtgcttaactcaaagcttgtgtaacgtctgactcattcctggcttcagtgtaaatcattattcctaatgcaactaaaatatagtattagaaatgctttctatttgcaaattgctctacaatcacttccttataagaccttcatgaactagggcaacaggccaagtctttccaaaattaaagtgcgactctaattgtttttaactggcttactccagtgtggctggttcatgggaaattctgcatctccatgttcccattctgagtggttagctcaaggattgctctccagtcccgttagatttggcctcaaggcttgggctctgaccaacatgtgtctgcagcctctgatcctcagctcatgcccagctctgcagctcagaatgctgtggtctacagcattatttcactttcatttgtaatcagacttcaccccgaagcaaatgcatcgtttacagggaaagaatattctgtggtacaatgaattctcgtccctcctgcccagtcactaaaccacaaactgcagggaaggcacaaggatataattttgggcactaggctccaattattttaaatccttcttttcataaaaatgacaaacaaaagaatgagatatcaatttatccatgacatagagggtcacagcacacttatttctcccaggtaggttggcctggggaacattaggctcctaatgtgtggaatttcaatacaactttctgaggaaggagttcagagaacttttagtctaaggaaaattaaagttaagaagttccattatcataatcagcctcctaactgctgttacttcttcttactgcaatcattcttaaccttaggacataatagaatcacttgggggagcttttgtaaaatgctgatgcctgggtcccaccctgtcctcccccagttttccccatggaacccgattcagtagatgtggcatggggcccaggcatatacgtcttgcaaaagctccccaagattatttctgccctctaggactctaagatgtgtgtgtgtgtgtgtgtgtgtgtgtgtgtgtgtgtgtgtgtgtgtgtattttttttccttctttctcttttcctttaatgaagagtactcgtgtgccatgattaattggagatctctgcaagataacaactacttatctgaaagtctaactttaggaacataagccagcccataaactggcatcactgccactcgacataacccagtatttctcaactaggactgacatcctaatcatggcaaaatactattcatttccacagtgctgcactgattatgaggcactttattatgttctttactaattatattatagttaattatactaactaccagctcatcaaagcaaacaacaaagtcaaaatttaggaaggttgatcatccactactgcagtgtcctaatagttagtagaattcccatttccagtctctttccttctagttttacaaagcacactgatatacatgatctcatgccgctgtcaggaactctcacatccaacccctacccactgctgcagcttgtatctgagtggaattccaggggcattctccaattggggcccaaatacaaggcctatttagcatcagtaacaccaaaagtcaactcttgattcattccagaattgcactatcacggagatcgtctgaaattcttccgggactcctgattttataaaatataaagtagtgcacattatctatgaagtttcttgtcaaaaagtgtcaaggcttaatctaatcaaacttccacaccaaacttctagctgaaagggaatatagggatagaggaacaaggtaaattacaccacaaggaaacaaccagaaaactcagaacatgtgatattttctaaggcaattgtctagaacttttccaaaagcaaattactttctcttcaccaaaagaagtacagagattattttagattaaaaatcataataatcaaaactcaactggatactgtttctaaaagagacaatttcagaaatcttatgtggactacatactacatgacactgcagaattgttgtttttctaggtgtgataacggtattgtggttacatacaagaatgtccttagtgcttagaggtgacgtctcatgatgtatgcaacttaactttcaaataattcagcaatgtaaataaataataaatacatattttaatatatattttacatattctatatacacatatatacatacatatgtgtacatacacatagagagctattatgtgtataaaagtgggaacaattattcaatataagtggaaagtatatgtgtatactttatattattccttcaactttaagtttgaaattttttataataaaatttcaggggaaagaaattcctttcaggcctacttttactatgcaatgttgcttctcccatcttatttaagctacatggcatttttaaaatgacacaataaggtttgaatatactttccaatccatgcatttatataaaatactgcacacaagattacctatttaacatggtctatacagtgttattaaaagaatacaaccttttggcaaaatttaccaaactgtattatgcaaaatgtttacctttaacaaactgcttctgaggtatggcttaattgtaactaaatgtttttaaaaagcactttagaaataaaccatataggaaaaaaacaaaaccatttctacattagtattttccctgattttattttctttattccataaatgaaaagtattaccactatgacttaaatgtaaatgtcattcaaaactgcagaaacaaggtgatttgttgtacaccttttaatctaacatgcagactaagcaattcaccaaaatccaggccatagttctgtgggacccaattatgtgtggcagcaattcaactgcagcaaattgttaccacattttattctgttccatgatgaagaaaacagttagaaatcttgttcagagtaaaagaatatctcattttgaaataatcatttacctgatattatttgttccttcactataaatcctacaagtcattactgactttcatcttcctgtaaagttatctctacttttactagaaaaaaaaagactgggagaatcggtaaagtcaaatcatagtttgggtgacatatttaccatcaagataataaaatcatacagaatactttcattcttaatggtctgcaaattccactttaaagaaccagttggctctgattcattcccttttaaaacagcttgtatgaaatgccacgttaaaccaaacactgaagtttgaccacagagcatcagctattaaacagcaagacaaaaacaataatattgtataacaatttatttgttcttttatattttttcaaagccatgaagcataaaatattctctccaatccaaaaacaagattagtagcccaagaggaaagggtcttatgattaaatataaaaattgtcaggggcaacatattcttaaattaacctgtatatcataaaagtaccttgtaatattgtttattttccaaaaataagttccacaaaagatgaattaagttcatgaagaatcctaatagaatgttttatcattaaataattattagaaatgagattttcagtagcaagccaattttaacactgaatattgtgtacgtggagggtgaaggcatatgttggtaaagaggcaataaaaataaattgatataaaatatcaatcgattgcagtgcactaatatgaggtacccagagcagtcaaattcatagacagcagtgcaatgatggttgccagggatttaggggagggaggaatggagagttttagtttgggaacatgaaaaggttctggagatggatgggggtgacaaggtgcacaacaatgtgaatgtacttaatgccaccaaactgtacacaaagaagtggttaaaatggtaaattttatcttatgtatactttaacacaataaaaagaaaattctagctggcacagtggctcatgcctatacccccagcactttgggaggacgaggcaggtggatcgcttcagcccaggagttcaagaccagcttaggcaacacagcaaaaccccatctttacaaaaaatacacaaaaatgtagctgggtgtgatggtaggcgcctgtactcccagctactcaagaggctgaggtgtgaggatcgcttgccgtagtgagccgcgatcacaccactgctctcaagcctgggcaacagagtgacaccctgtatcaaaaaagaaagaaagaaagaaagaaattccacaacctaaaattaaattaaacactttgacttcaatgctttacagttgtaaaggcctacattttacaactgtaaaacagaatcatgggtttccttaatgcattcgacaaatacttattgagccacaaccctgtatcagtgaatagcacaacataaaacctctgttcacatggagtttgcaatcttgtggaggaggtagtgaataaatagatcaacacattaaaatagttttagatttgaggttgtaatttagttacaaatgaaacaagcatgctgctgtcatagagaataattgggtacacctgccttggtaaaagttatcagaaaagacttctttgaggaggtgacatttaaactgaggcctaaaggatgagcacaagccagctgtgcaacatctaagcgctttctaagtatgggagacagcaagaacagtggctctgggctggcagatagcctggcttctctaggattaaaagaaagccgctgtgaccagagctttgagtgcaaaggggaaggggcatgccatgaggttggatcctttggcaggggctggattatgcaggacatctcgggatatgatgaggagtctggatctggctcaaagctcaataaaaagccactgaaaataaaagccactgttatttgagaagtgtgctcctttaagggctcaggagttgaaatggaaagggtttcagggaggctactgaaggatttgaggtgaaagttggcgagagtggtggcatagaaagggtggaaggccagcaggtaggggacgtccttgggccaaagaaccaacagcacgtgtggatggatcagatgggaagcgtgagggaaaccggaaggctcccgggcttctggcttccatcactgaataaatggtcatttgctgaaacggggaaactagggaagattaggctgtaaatactaataatccgttaacaagttcttcccattctcacaataaggtacctggtgtagaacaggtaacttgaattagtgaggctgtccctaaataaaatcatattatctgtaaatcttaatgctatcaaaatgaacaaaaacaaaacctgtgtataatgtaattataccctgacttgtgtgtttttgcttttttataaatttcttttccttcccttcctttttgtgagcaagcatttactcctatcatattcagacatttatgtataaacattagggttgagattcttacttcaaacacacttggtgaattttcacagaaaaccaagtatgaagtacccacggcccagaccaacaatatgtgatggaatcctggcgtggtgggtgggatttcctccagaggaactccactgcccctttcgtaaatgacagggcatgggaatccaagaccactagctttagctgccagccctgagttcattctacaggaaatggagacacaccacattcacattccatgatagcatcaattctgagagatctggtggaaaacttaaagcagggacaaaagttcagccattattaaccacagctgagaaatgccttctataaatatgaactttctgtaatatcaagacagataaacggcagggagatggttttgatacattggttggcaaatgttatttctagaattggctttttatcaaatatccatgtgctaatagatatgtggtatataggttgtttgtatatcttctctctttcacacacacacacacacacacacacacacacacacacacacacacacacacacagtcacagaagcatgctaacatactatcaaggtggccctcctcttctcagaacttttctttggaagaaaatgtctgatgaatgaaaaattcctgagactgtttccagctcagagtctggcactgaactcagctgaagaaagacaagttggaagaaagtacaagcattactcagaacacgtgagtgaaccgtgcaaaagacaggcatgggagctgagggggtgggagaggcagcagcaccaaaacccgattatgtagatttaattcatcaacaagagaagattcctgacaaaaatcagtacgtgctcagatatcaaatacaacagatgatccatattcttagacaccaacaactaaggcagcagaccctagaactgagttttcactgttattttatggtcgtccatttttcagacctgctaagtggagtgagaacacatcactaatgggacaatcacatggggtctcttggcagctccactggaaacatacagatttcgatattctgggccactggtgagtgacaactgttttatggcacagactagcaattatgcaaatattcatcctgctctttggaattaatagttatttcccagacaccccaggtacacatgatgtgaagagttaaatcttaatactatcccatgggcagataggccactctagttctagctaagtgttgcccagtggagccagtggcagaatagtatatgccttagaaacttccattctatagaactagaaaaaagatttaaagttgctcctgagactataagtcctacaactactaaatcatgtactgtctgaacactgacagggcactgtgttactctgttccctcttaccacttactagagatttacatcagcttggccagacactggggtttcatctaaggcagctagttagatacgttcggaaagtgtatatggttagaaaataataagagacagcattaaaagtggtttaaaatgccccaagagggaagccaaacaccacaattttctccaactgtggaagaaaaaacaacttgagccagattttagctctctggatgtattaacaggtctatgttttattcccttggatatttatgaagcatgttaacaataattaaaatggaattttccaaacctttaagggtaaaagttaggaatagaatatcaatgaccttggaaagtgttataatttaaaatacatcatattcgccatcctgggatttcactactaatatttaaaattcacaactcctgcacaaagcaagtgttcttaggaactatgctcatgcaaatgctttctattcaaatgtattttcaaatttctgcagtagttgtacggctaaaagttagtgctgctggtctatgggcattcagatttctctagttatgggttcttaacttgaagaccacaattgggacttggtaggtctaaaggtgccctgaaactatacataaatcacatctgcaagttcgatgaatctgaacacaattaagtgagcaatcacatattctcttccagaaatctggaattgggattgacgagcactggtgttcacctctgcagctggctagacctcaggtgacttaccttgggagcagggaggcggcatgtacatgatgcacagagcagtccacctgcatggggcagggatagagaccagctggctccagaaagagttggagagagcatttggtttttgcttccagccctgggtaaagccctgctatagtacctgcccttgggtttcttataacctgggatttccttacagtaaatcccctcttctgcttaagctagttccattacttgcaaccaatgcacttggactcaatacagtgccttcatttattcctttttggaagaagaacgtgttctttcatcaaattcttaaaagtgtccatggctcagaaaaggtaataatcccctgcactatttaaaaagaagtaactaataagaatttggcattacttagataacttactctgatttactagagttttatatgttcattctcaaagaaaagaaaaaaaaaaactctcctagttagtgacacaagcacagacaaaaaaacgactccagttctccccttcctttacttgtaattccaaagggagccacatagaaacataaacctgcatgaaagtcatcactgccctctataaattgatagctaacttttagtaacacataccgtcctggttagttttccccaaacggcagcaggcatttgtggataatgttaccttgcccatttaggcagaacacagtgcagggctagaacctaaagacaataagcctaaaagtgaggaggcctgcacgccagtctcagctcagcaactaatttgctgttcgtctcgagttagacacatcactctctgatggcattcaagtggtcaaatcatgaaccattcagacgccctcgtggcctttcagctggcctgagccaggatggcttcagctaggttaggaagagaaggttgtttccatagtgcaggaagggcagagcgtgtagaaagatgtctgatagaagcttgttttgccattagacttgctcctcccacacttcttattttgggaaagggcatcaccacagcccacatcacagggccacagactcagggcagcggggattacagagtatccctcacacccccacctaatcacccgcaaactttgtcaaatttaccacctcaacagcttctttattgcccctcctctgaaattcaattgctactgctttagtgtagaccctcatttccctttgccctgctggagtgaacctaacttcagttagaccctaaaacgctctgtgaaatgctccctacttggcttcctctctggcctcttccctaaatgccttccccctccattgacactgagtgaactgcagttcctcaactcacggtgctgtttctcttccacacgtctttgcaaatgccatctcctctacctggaatgcctttcctctccctatttttccaccaaattcctccacttggaagtctcccctgacgacttactccttccctcctctgtggcactaaccaaactccatggtaaactctcacttatatgattgtctttcatcagattgtgagccttaaggatacatattttgtctctttaaactttgcatctccatggcctagaatatccccatgggcccataataagcactcaagtatttatgaatgaatgaatgaatgaatgaatgaatggaggatgcaaaatgacatatctttaagttagtctaaatccttaatcttttgaactattcattccctttgctcaagatgtaattaactacttataattccgtgaatctatcatgcttgatttgaattctggaatgctgattatcaatgtggcagtgaataaagttaccctttgagtcagttttctctgcttcctggggttgtatgagtagtaaataagtatacaaaatacctaccatagtccctggtccttctatttttcctctcctcccacacataccatgggtacacataaccaatacatcccgctattcttagaaacaaatgacgtcaatgacccacaatctgcaagacacaccttttaatccattctgaagagctaagagatttgttctaagttatctctactcccttgcctggccttttgttaaaaacaacagttgaatttgcaatatagagcaaagataaaggtgacatgcagatcaagtccaagcctggattcatgaagaccttgttcttttttttttttttttaacttttagtttaagttcaggggtacaagcgcaggtttgttacataggtaaacttgtgtcaagggggttcgttgtgcagattatttcatcacccaagtattaagcctagttcccattagttgttttccctaatcctctcccttctcccaccctccgccctccaaaaggcccagtgtgtgctattctcctctatgcgtccatctgttctcatcatttagttcccacttataagtaagaatatgtagtatttggtttctgttgctgtgttagtttgctaagtatagtggcctctagctctatccatgtccttgcaaagttcccttttatggctgtatagtattccatggtgtatatgtaccacattttctttttccggtctcattgatggacagttaggtggatttcatttctttgctattgtgaatagtgctgcaatgagcatacacatgcatgtgtctttataatataatgatttatgttcctttgggtatatacccggtagtggtattgctgggtcaaatggtatttctgtaattaggtctttgaggaatcaccacactgtcttccacaatggttgaactaattacacttccaacaacagtgtataagtgttcctttttctccacaacctctgcagcatctgttattttttgactttttaatagcagctttaataggtgttagatggtatctcattgtggttttataaagcacaaagaaagaagaacctcagtttcaatgactttttttttcttttttttttttttgagacagaatctcattgtgtcgccctagctagagttcagtggtgggatcacagctcactatatcctcaacctcctgggctcaagcaatcctcccacctcagcctcccaaatagctgagactacaggcacatgtcaccatgcctgcctatttttttattttttgtagagatggggtctccctatgttgcccaggctggtcttgaagtcctgggctcaagcgatcctcccacctcagcctcccaaagtgcagggattacaggcgtgagccactggctggcctgatgacatttttgagcagtggaatcaccaccagctaccatatacctccaaattcattcctgacataagaaaaattaacccctatttgtttaagtcactgtggttgggttttgcatcatttgcatccaaactcatttctaactgagacaccaagtccacaaattatgttgtcatttgacatatatatgagtgaataatccaagcataagatactacatttctggaatttttatgtagcttgtattttaaaaattaagagcaaagagattgagcaaagtaggtcaagtgcataaccaaattttacccaaatgcaaatgagaattccagatattccttcctaagctcatattccccaaatcaacttaatttttcttcctcgaaacctagtaagatatctaatgttgagacatgactcaactctgatcatctccgttaatccactgttctctgatgtacacatatttttccaattaaatcaaataaatggtcatatgcatcattaccatcataagattactgccagttctcacttgtaagatacgttctattttttaaataagctcactaatatctctgttagatgaccctctttctctattctattttttaaataattgagatattttgaatgtgatatgccctatatactaccgtcaattgaaagtaaagaccaccatcccctcccctcagttcccaaatgttacatatttgattgcttaccataacaatcataaaaatataaacagagtggacacatggaaataatggaattttggagttattcccaaacagtggccaatttcaaacaatacgtcaataagaatggattgaaaagaaagcaaagaactatgtaaatgcctaggtaggttcccgggagacagtaaaaggtaagtattgcattcacagtgacattcaacctttaaatagggtaacggtactgacactttatgcaaatgcagatggcttatgaaacaataaaaatgaagtcgcagctttatagtctattgttttggctcagggaacgggagaatcaagggtagtaaatgaacttatataatacttctcactcctttctctctactctgtgagtgtgagatgagccattttttttttccagatgttattgttaatttcaaaagattcatccagaccttggaaagtcttctaatgacaagtctgatttgagagaaatgttgagccctttaatacaggaaattccataattatgagctggttgtgcttcagtcgtttatgtataagatgagcactggaatctcctattttagaattggaaggaaacttatagaagaagaaaaagaaaatgagcatttatggagcatggtgctggctacaagggagacatgctgtctcacttaattctcacaacaattctctgaggaagacttttgcttcattttataaagaaggaaactgaggctcaaagtaaagttaagaaatttgcccaaggttctacaaacagtaagtggcagaatgagaattcagcttttggtgtttctgattctaaaagctgtgctttccccactactttgccttcctcaaaatgacggtacaatgtacacaagggtaaatcaaaacacagagcggcaaagttattttctcaatgtcacagaacaaattagtggcagatggaacgacaatctacatctttcaaatcccagatcaggccctgttggttacttcatgcctcccctttggcctcatttttgccctcttgctccccaggattaaatcacagcagtcgagattgaagcaacgttcaaatcagtttcaggaccttgttctcatactcctaaatcttgagctaacaaagccttcagtgcagtgttggagtgttgtttgcaagaaatgaaaattatcccaattttgtttttgtaaatatattcactgtaaaccatggtaacacagaagcaatgttggtgtcagctaaaaaaatatatgtaataaaatctatgatagaggttacctccctgtggagaagcaggaaagagatggtacggggaatcctaaatgggtatcagtcatattttactgcttaggttgggcagtattcatttttaaaataggtttgtaactaacacatacatgacatatactctgtaaatgtgtcatatagtgaattgaaaaagtatgacaaatagaaaaggtaagctacatacacacatacacattatatctgcaaactgaaatggaagtgtcttatatacctatgtgaccatgggcaaattatttactttctgatccacagttttcttaattataaatagggatgataatagggtgtttgtaaacactatacaagagaaatatttaagatatttaattttctgtctgattgtaactctttctattctatgacaatgatattttcaatagaaaaaacctttatacccaacatgcatcatttaattggtttcttcaacgtgagacagaataagccattatttgtacactatagaaatgtaagggcatgttaagatgttatgcagtatgttctatttaaacatggcatgcagtgatgatgtgtaaatctcacatactgttccttcacatcttgttcccttccttgtccctttcctgtgttttcttcttgatccaaggctaaactgtcccagccctgaaaatctgtgctcggttaaaaactgtcatgttaatcccagctgctcattatcgaggactgtgcacaaccccctttcgcccagcatgagcttctaacgctctgattcacctccgcagagtcaccccactccacgtctataaacagagcagaaatctgtggagactatttggcattgtctgtattacccaagaacatgtctggttgtctcgcccttgaccctgcctttaaaagccttcttatccttcaagaccaaacttaaacactgcattttgggaaaagcctgtccagcttcatatatcaaaatgaacatcttcatcttctgagctcctatggtgtattgctgtacattgactatttgccagtcataccatttggccatggtccaaagagaagcatataggttataacctaccaaatggtaggttccttaggaggagagagtcttgtttatctctgaactcttatcttctatccccaacttcctggaatagaagacactcaatatatctttcttaaaccaaactgttaactaggtataaaaattgctcttgcttcccctgggccacacaactacacacattccttagatgagctcatgtgaagttaattagacaagttaattaattctccaactcagcaggttatcagaactgaatgtacccaactcatctaaatgcaaagataataaataggcttttgccttctacatttctaatgggggtttctgaaagaaactttccactagctctataactctaatgtctcccaaatagaagactctatgctaaaaggcctttccaaagtagtaatatacctaacctccacaaataccttttatctcaaagacaatttttctctacaccatcccaggggaaaatgcaacatctatgattttaattttttaccctcatagatcacatccatgcacaattcaactacttaatggggtaaggctgtaggtgagtgcaacaaacctcacgaacctcaaaggttagtgactgtctataccactggaatcctggtaaagttttggaagagccttcatgactcaccttcaatttccatccactcccaggatgaaactaccacaaaatagttgttggaaagaaggatttaagaaccaagcttcaaccatggcagattcgaaatccagccaatgccagccaaatatgagctcgaaagcattcataagaagaggctaaggtttacaaaacaatcctttttgatgagttaagtacaagtgaatcagaaccacatgggttaaattccccttgaaatacccacggatttagaattaagtggaaaagtgcttggcacagcataaattccaggcatctgaaatgcagttagaaatcattttctttgaaacctaacaaaaagggttccctgagatctcctgcacaaaacgccaggtattcttacagcaatggcagctactcctcatagtgaacatagtgccagagttg

SEQ ID NO: 24 - DNA, 140858 bp, Artificial Sequence
  Synthetic BAC sequence
aattcaaacaaaaatataaacaagtattaaatactgagctgttgaataaatctcagccctcatttcgttctttcgatgaagaaaaagtcactcagcactgcagtaatttggaacaaaatctctttaaaatgcaggaactatgtggacaaagtgaaataccaaagtcatctttatttttttggctcaattctcccaaacaaatacctatagggatttaataaatacatctttgctgtttggtctttcctttctatttcaatattttattatgtattttaattcaaaattaagtaattactttagacaattgagaaaaggcagtagcatataaacaaatgtaattacacctaaagaaacccttgataacgtattgattatattatcgtacgtaagattttgtgtgtatgcatgtgtgtgttttatttttttaatcataaaataaggattatactaaaaatatacttttgaatcctgctggattttcttcacttaacattgccaaagctttttcccatgtaataaatgctattctacaatatgattttaattgctgcataattttccatcaagttataacagaatgtgttcagtaattttcttactgtctatcatttaaattgcctctaattcttcattattacacatagcattcagtgtacattacaatgaatccttttcaggataaaaacagtcatcaagatttttatgactatatatatcctacatctgagactagaaagatcacagcagtgtaatcttttatttaaaaaataaataaaactctccatgttaggtaacaagaaagagaatttaggcttgtttctttctgttaatttactgagacaagtgcaaatgctttaatcaaacagattcaggttagcttgccatattcaatcctttttaaaaagcataacgcaacatgaattttaatttataatcctctcttcaacactgttgggatttgtttttccacctcctcttgccaagatactctatggaattatcttatatatgaggattgccaaggttcaggatagatacaaatatggtgttttgtgagtgacaccagcaaaatccagacactctacaaaatgctaatacaaatctgattcagttctgtctgccactgattcataacttcacatgtgaatttctcattggaagatcttcattaaaaaaaaaaaccccttaagacttttccagggtcaataacgtattattcttatttcaatatgaaatacatagaatcgagatggtagttgttaattctgacaatctatattaggcatcccaacagtccacagggatccaatttattaagtatactatatatttggcgaatactttatgtagaatagaaactatggacttagtacatttctgtgctagatatttatcactatagacaaagttattttggaaacaaattcaaactggcttatttgacagtacagattagcaagtggatataaatgtatttgtagatccatattttaaacaaaaattgctgattgtagagggagaggcataatctggatgaaataaaattggatctaaaaatgtcttggaaggtaaatgctgtattaacatggttttcaaatgtcattccgatttggcggcatgtgcttttcgtcctgtacttcatttagattgccaaggttatgctgtttttagtccaatactccaaccgcagaaagaaatctgcccacactcccaattccttactaataatccaattatttacaattattcccatagcacttacatgatattaagctaaatttacatactcttttttttttttttttcagatagtctcagcattagacagggagtgtgcttaactcaaagcttgtgtaacgtctgactcattcctggcttcagtgtaaatcattattcctaatgcaactaaaatatagtattagaaatgctttctatttgcaaattgctctacaatcacttccttataagaccttcatgaactagggcaacaggccaagtctttccaaaattaaagtgcgactctaattgtttttaactggcttactccagtgtggctggttcatgggaaattctgcatctccatgttcccattctgagtggttagctcaaggattgctctccagtcccgttagatttggcctcaaggcttgggctctgaccaacatgtgtctgcagcctctgatcctcagctcatgcccagctctgcagctcagaatgctgtggtctacagcattatttcactttcatttgtaatcagacttcaccccgaagcaaatgcatcgtttacagggaaagaatattctgtggtacaatgaattctcgtccctcctgcccagtcactaaaccacaaactgcagggaaggcacaaggatataattttgggcactaggctccaattattttaaatccttcttttcataaaaatgacaaacaaaagaatgagatatcaatttatccatgacatagagggtcacagcacacttatttctcccaggtaggttggcctggggaacattaggctcctaatgtgtggaatttcaatacaactttctgaggaaggagttcagagaacttttagtctaaggaaaattaaagttaagaagttccattatcataatcagcctcctaactgctgttacttcttcttactgcaatcattcttaaccttaggacataatagaatcacttgggggagcttttgtaaaatgctgatgcctgggtcccaccctgtcctcccccagttttccccatggaacccgattcagtagatgtggcatggggcccaggcatatacgtcttgcaaaagctccccaagattatttctgccctctaggactctaagatgtgtgtgtgtgtgtgtgtgtgtgtgtgtgtgtgtgtgtgtgtgtgtgtattttttttccttctttctcttttcctttaatgaagagtactcgtgtgccatgattaattggagatctctgcaagataacaactacttatctgaaagtctaactttaggaacataagccagcccataaactggcatcactgccactcgacataacccagtatttctcaactaggactgacatcctaatcatggcaaaatactattcatttccacagtgctgcactgattatgaggcactttattatgttctttactaattatattatagttaattatactaactaccagctcatcaaagcaaacaacaaagtcaaaatttaggaaggttgatcatccactactgcagtgtcctaatagttagtagaattcccatttccagtctctttccttctagttttacaaagcacactgatatacatgatctcatgccgctgtcaggaactctcacatccaacccctacccactgctgcagcttgtatctgagtggaattccaggggcattctccaattggggcccaaatacaaggcctatttagcatcagtaacaccaaaagtcaactcttgattcattccagaattgcactatcacggagatcgtctgaaattcttccgggactcctgattttataaaatataaagtagtgcacattatctatgaagtttcttgtcaaaaagtgtcaaggcttaatctaatcaaacttccacaccaaacttctagctgaaagggaatatagggatagaggaacaaggtaaattacaccacaaggaaacaaccagaaaactcagaacatgtgatattttctaaggcaattgtctagaacttttccaaaagcaaattactttctcttcaccaaaagaagtacagagattattttagattaaaaatcataataatcaaaactcaactggatactgtttctaaaagagacaatttcagaaatcttatgtggactacatactacatgacactgcagaattgttgtttttctaggtgtgataacggtattgtggttacatacaagaatgtccttagtgcttagaggtgacgtctcatgatgtatgcaacttaactttcaaataattcagcaatgtaaataaataataaatacatattttaatatatattttacatattctatatacacatatatacatacatatgtgtacatacacatagagagctattatgtgtataaaagtgggaacaattattcaatataagtggaaagtatatgtgtatactttatattattccttcaactttaagtttgaaattttttataataaaatttcaggggaaagaaattcctttcaggcctacttttactatgcaatgttgcttctcccatcttatttaagctacatggcatttttaaaatgacacaataaggtttgaatatactttccaatccatgcatttatataaaatactgcacacaagattacctatttaacatggtctatacagtgttattaaaagaatacaaccttttggcaaaatttaccaaactgtattatgcaaaatgtttacctttaacaaactgcttctgaggtatggcttaattgtaactaaatgtttttaaaaagcactttagaaataaaccatataggaaaaaaacaaaaccatttctacattagtattttccctgattttattttctttattccataaatgaaaagtattaccactatgacttaaatgtaaatgtcattcaaaactgcagaaacaaggtgatttgttgtacaccttttaatctaacatgcagactaagcaattcaccaaaatccaggccatagttctgtgggacccaattatgtgtggcagcaattcaactgcagcaaattgttaccacattttattctgttccatgatgaagaaaacagttagaaatcttgttcagagtaaaagaatatctcattttgaaataatcatttacctgatattatttgttccttcactataaatcctacaagtcattactgactttcatcttcctgtaaagttatctctacttttactagaaaaaaaaagactgggagaatcggtaaagtcaaatcatagtttgggtgacatatttaccatcaagataataaaatcatacagaatactttcattcttaatggtctgcaaattccactttaaagaaccagttggctctgattcattcccttttaaaacagcttgtatgaaatgccacgttaaaccaaacactgaagtttgaccacagagcatcagctattaaacagcaagacaaaaacaataatattgtataacaatttatttgttcttttatattttttcaaagccatgaagcataaaatattctctccaatccaaaaacaagattagtagcccaagaggaaagggtcttatgattaaatataaaaattgtcaggggcaacatattcttaaattaacctgtatatcataaaagtaccttgtaatattgtttattttccaaaaataagttccacaaaagatgaattaagttcatgaagaatcctaatagaatgttttatcattaaataattattagaaatgagattttcagtagcaagccaattttaacactgaatattgtgtacgtggagggtgaaggcatatgttggtaaagaggcaataaaaataaattgatataaaatatcaatcgattgcagtgcactaatatgaggtacccagagcagtcaaattcatagacagcagtgcaatgatggttgccagggatttaggggagggaggaatggagagttttagtttgggaacatgaaaaggttctggagatggatgggggtgacaaggtgcacaacaatgtgaatgtacttaatgccaccaaactgtacacaaagaagtggttaaaatggtaaattttatcttatgtatactttaacacaataaaaagaaaattctagctggcacagtggctcatgcctatacccccagcactttgggaggacgaggcaggtggatcgcttcagcccaggagttcaagaccagcttaggcaacacagcaaaaccccatctttacaaaaaatacacaaaaatgtagctgggtgtgatggtaggcgcctgtactcccagctactcaagaggctgaggtgtgaggatcgcttgccgtagtgagccgcgatcacaccactgctctcaagcctgggcaacagagtgacaccctgtatcaaaaaagaaagaaagaaagaaagaaattccacaacctaaaattaaattaaacactttgacttcaatgctttacagttgtaaaggcctacattttacaactgtaaaacagaatcatgggtttccttaatgcattcgacaaatacttattgagccacaaccctgtatcagtgaatagcacaacataaaacctctgttcacatggagtttgcaatcttgtggaggaggtagtgaataaatagatcaacacattaaaatagttttagatttgaggttgtaatttagttacaaatgaaacaagcatgctgctgtcatagagaataattgggtacacctgccttggtaaaagttatcagaaaagacttctttgaggaggtgacatttaaactgaggcctaaaggatgagcacaagccagctgtgcaacatctaagcgctttctaagtatgggagacagcaagaacagtggctctgggctggcagatagcctggcttctctaggattaaaagaaagccgctgtgaccagagctttgagtgcaaaggggaaggggcatgccatgaggttggatcctttggcaggggctggattatgcaggacatctcgggatatgatgaggagtctggatctggctcaaagctcaataaaaagccactgaaaataaaagccactgttatttgagaagtgtgctcctttaagggctcaggagttgaaatggaaagggtttcagggaggctactgaaggatttgaggtgaaagttggcgagagtggtggcatagaaagggtggaaggccagcaggtaggggacgtccttgggccaaagaaccaacagcacgtgtggatggatcagatgggaagcgtgagggaaaccggaaggctcccgggcttctggcttccatcactgaataaatggtcatttgctgaaacggggaaactagggaagattaggctgtaaatactaataatccgttaacaagttcttcccattctcacaataaggtacctggtgtagaacaggtaacttgaattagtgaggctgtccctaaataaaatcatattatctgtaaatcttaatgctatcaaaatgaacaaaaacaaaacctgtgtataatgtaattataccctgacttgtgtgtttttgcttttttataaatttcttttccttcccttcctttttgtgagcaagcatttactcctatcatattcagacatttatgtataaacattagggttgagattcttacttcaaacacacttggtgaattttcacagaaaaccaagtatgaagtacccacggcccagaccaacaatatgtgatggaatcctggcgtggtgggtgggatttcctccagaggaactccactgcccctttcgtaaatgacagggcatgggaatccaagaccactagctttagctgccagccctgagttcattctacaggaaatggagacacaccacattcacattccatgatagcatcaattctgagagatctggtggaaaacttaaagcagggacaaaagttcagccattattaaccacagctgagaaatgccttctataaatatgaactttctgtaatatcaagacagataaacggcagggagatggttttgatacattggttggcaaatgttatttctagaattggctttttatcaaatatccatgtgctaatagatatgtggtatataggttgtttgtatatcttctctctttcacacacacacacacacacacacacacacacacacacacacacacacacacacagtcacagaagcatgctaacatactatcaaggtggccctcctcttctcagaacttttctttggaagaaaatgtctgatgaatgaaaaattcctgagactgtttccagctcagagtctggcactgaactcagctgaagaaagacaagttggaagaaagtacaagcattactcagaacacgtgagtgaaccgtgcaaaagacaggcatgggagctgagggggtgggagaggcagcagcaccaaaacccgattatgtagatttaattcatcaacaagagaagattcctgacaaaaatcagtacgtgctcagatatcaaatacaacagatgatccatattcttagacaccaacaactaaggcagcagaccctagaactgagttttcactgttattttatggtcgtccatttttcagacctgctaagtggagtgagaacacatcactaatgggacaatcacatggggtctcttggcagctccactggaaacatacagatttcgatattctgggccactggtgagtgacaactgttttatggcacagactagcaattatgcaaatattcatcctgctctttggaattaatagttatttcccagacaccccaggtacacatgatgtgaagagttaaatcttaatactatcccatgggcagataggccactctagttctagctaagtgttgcccagtggagccagtggcagaatagtatatgccttagaaacttccattctatagaactagaaaaaagatttaaagttgctcctgagactataagtcctacaactactaaatcatgtactgtctgaacactgacagggcactgtgttactctgttccctcttaccacttactagagatttacatcagcttggccagacactggggtttcatctaaggcagctagttagatacgttcggaaagtgtatatggttagaaaataataagagacagcattaaaagtggtttaaaatgccccaagagggaagccaaacaccacaattttctccaactgtggaagaaaaaacaacttgagccagattttagctctctggatgtattaacaggtctatgttttattcccttggatatttatgaagcatgttaacaataattaaaatggaattttccaaacctttaagggtaaaagttaggaatagaatatcaatgaccttggaaagtgttataatttaaaatacatcatattcgccatcctgggatttcactactaatatttaaaattcacaactcctgcacaaagcaagtgttcttaggaactatgctcatgcaaatgctttctattcaaatgtattttcaaatttctgcagtagttgtacggctaaaagttagtgctgctggtctatgggcattcagatttctctagttatgggttcttaacttgaagaccacaattgggacttggtaggtctaaaggtgccctgaaactatacataaatcacatctgcaagttcgatgaatctgaacacaattaagtgagcaatcacatattctcttccagaaatctggaattgggattgacgagcactggtgttcacctctgcagctggctagacctcaggtgacttaccttgggagcagggaggcggcatgtacatgatgcacagagcagtccacctgcatggggcagggatagagaccagctggctccagaaagagttggagagagcatttggtttttgcttccagccctgggtaaagccctgctatagtacctgcccttgggtttcttataacctgggatttccttacagtaaatcccctcttctgcttaagctagttccattacttgcaaccaatgcacttggactcaatacagtgccttcatttattcctttttggaagaagaacgtgttctttcatcaaattcttaaaagtgtccatggctcagaaaaggtaataatcccctgcactatttaaaaagaagtaactaataagaatttggcattacttagataacttactctgatttactagagttttatatgttcattctcaaagaaaagaaaaaaaaaaactctcctagttagtgacacaagcacagacaaaaaaacgactccagttctccccttcctttacttgtaattccaaagggagccacatagaaacataaacctgcatgaaagtcatcactgccctctataaattgatagctaacttttagtaacacataccgtcctggttagttttccccaaacggcagcaggcatttgtggataatgttaccttgcccatttaggcagaacacagtgcagggctagaacctaaagacaataagcctaaaagtgaggaggcctgcacgccagtctcagctcagcaactaatttgctgttcgtctcgagttagacacatcactctctgatggcattcaagtggtcaaatcatgaaccattcagacgccctcgtggcctttcagctggcctgagccaggatggcttcagctaggttaggaagagaaggttgtttccatagtgcaggaagggcagagcgtgtagaaagatgtctgatagaagcttgttttgccattagacttgctcctcccacacttcttattttgggaaagggcatcaccacagcccacatcacagggccacagactcagggcagcggggattacagagtatccctcacacccccacctaatcacccgcaaactttgtcaaatttaccacctcaacagcttctttattgcccctcctctgaaattcaattgctactgctttagtgtagaccctcatttccctttgccctgctggagtgaacctaacttcagttagaccctaaaacgctctgtgaaatgctccctacttggcttcctctctggcctcttccctaaatgccttccccctccattgacactgagtgaactgcagttcctcaactcacggtgctgtttctcttccacacgtctttgcaaatgccatctcctctacctggaatgcctttcctctccctatttttccaccaaattcctccacttggaagtctcccctgacgacttactccttccctcctctgtggcactaaccaaactccatggtaaactctcacttatatgattgtctttcatcagattgtgagccttaaggatacatattttgtctctttaaactttgcatctccatggcctagaatatccccatgggcccataataagcactcaagtatttatgaatgaatgaatgaatgaatgaatgaatggaggatgcaaaatgacatatctttaagttagtctaaatccttaatcttttgaactattcattccctttgctcaagatgtaattaactacttataattccgtgaatctatcatgcttgatttgaattctggaatgctgattatcaatgtggcagtgaataaagttaccctttgagtcagttttctctgcttcctggggttgtatgagtagtaaataagtatacaaaatacctaccatagtccctggtccttctatttttcctctcctcccacacataccatgggtacacataaccaatacatcccgctattcttagaaacaaatgacgtcaatgacccacaatctgcaagacacaccttttaatccattctgaagagctaagagatttgttctaagttatctctactcccttgcctggccttttgttaaaaacaacagttgaatttgcaatatagagcaaagataaaggtgacatgcagatcaagtccaagcctggattcatgaagaccttgttcttttttttttttttttaacttttagtttaagttcaggggtacaagcgcaggtttgttacataggtaaacttgtgtcaagggggttcgttgtgcagattatttcatcacccaagtattaagcctagttcccattagttgttttccctaatcctctcccttctcccaccctccgccctccaaaaggcccagtgtgtgctattctcctctatgcgtccatctgttctcatcatttagttcccacttataagtaagaatatgtagtatttggtttctgttgctgtgttagtttgctaagtatagtggcctctagctctatccatgtccttgcaaagttcccttttatggctgtatagtattccatggtgtatatgtaccacattttctttttccggtctcattgatggacagttaggtggatttcatttctttgctattgtgaatagtgctgcaatgagcatacacatgcatgtgtctttataatataatgatttatgttcctttgggtatatacccggtagtggtattgctgggtcaaatggtatttctgtaattaggtctttgaggaatcaccacactgtcttccacaatggttgaactaattacacttccaacaacagtgtataagtgttcctttttctccacaacctctgcagcatctgttattttttgactttttaatagcagctttaataggtgttagatggtatctcattgtggttttataaagcacaaagaaagaagaacctcagtttcaatgactttttttttcttttttttttttttgagacagaatctcattgtgtcgccctagctagagttcagtggtgggatcacagctcactatatcctcaacctcctgggctcaagcaatcctcccacctcagcctcccaaatagctgagactacaggcacatgtcaccatgcctgcctatttttttattttttgtagagatggggtctccctatgttgcccaggctggtcttgaagtcctgggctcaagcgatcctcccacctcagcctcccaaagtgcagggattacaggcgtgagccactggctggcctgatgacatttttgagcagtggaatcaccaccagctaccatatacctccaaattcattcctgacataagaaaaattaacccctatttgtttaagtcactgtggttgggttttgcatcatttgcatccaaactcatttctaactgagacaccaagtccacaaattatgttgtcatttgacatatatatgagtgaataatccaagcataagatactacatttctggaatttttatgtagcttgtattttaaaaattaagagcaaagagattgagcaaagtaggtcaagtgcataaccaaattttacccaaatgcaaatgagaattccagatattccttcctaagctcatattccccaaatcaacttaatttttcttcctcgaaacctagtaagatatctaatgttgagacatgactcaactctgatcatctccgttaatccactgttctctgatgtacacatatttttccaattaaatcaaataaatggtcatatgcatcattaccatcataagattactgccagttctcacttgtaagatacgttctattttttaaataagctcactaatatctctgttagatgaccctctttctctattctattttttaaataattgagatattttgaatgtgatatgccctatatactaccgtcaattgaaagtaaagaccaccatcccctcccctcagttcccaaatgttacatatttgattgcttaccataacaatcataaaaatataaacagagtggacacatggaaataatggaattttggagttattcccaaacagtggccaatttcaaacaatacgtcaataagaatggattgaaaagaaagcaaagaactatgtaaatgcctaggtaggttcccgggagacagtaaaaggtaagtattgcattcacagtgacattcaacctttaaatagggtaacggtactgacactttatgcaaatgcagatggcttatgaaacaataaaaatgaagtcgcagctttatagtctattgttttggctcagggaacgggagaatcaagggtagtaaatgaacttatataatacttctcactcctttctctctactctgtgagtgtgagatgagccattttttttttccagatgttattgttaatttcaaaagattcatccagaccttggaaagtcttctaatgacaagtctgatttgagagaaatgttgagccctttaatacaggaaattccataattatgagctggttgtgcttcagtcgtttatgtataagatgagcactggaatctcctattttagaattggaaggaaacttatagaagaagaaaaagaaaatgagcatttatggagcatggtgctggctacaagggagacatgctgtctcacttaattctcacaacaattctctgaggaagacttttgcttcattttataaagaaggaaactgaggctcaaagtaaagttaagaaatttgcccaaggttctacaaacagtaagtggcagaatgagaattcagcttttggtgtttctgattctaaaagctgtgctttccccactactttgccttcctcaaaatgacggtacaatgtacacaagggtaaatcaaaacacagagcggcaaagttattttctcaatgtcacagaacaaattagtggcagatggaacgacaatctacatctttcaaatcccagatcaggccctgttggttacttcatgcctcccctttggcctcatttttgccctcttgctccccaggattaaatcacagcagtcgagattgaagcaacgttcaaatcagtttcaggaccttgttctcatactcctaaatcttgagctaacaaagccttcagtgcagtgttggagtgttgtttgcaagaaatgaaaattatcccaattttgtttttgtaaatatattcactgtaaaccatggtaacacagaagcaatgttggtgtcagctaaaaaaatatatgtaataaaatctatgatagaggttacctccctgtggagaagcaggaaagagatggtacggggaatcctaaatgggtatcagtcatattttactgcttaggttgggcagtattcatttttaaaataggtttgtaactaacacatacatgacatatactctgtaaatgtgtcatatagtgaattgaaaaagtatgacaaatagaaaaggtaagctacatacacacatacacattatatctgcaaactgaaatggaagtgtcttatatacctatgtgaccatgggcaaattatttactttctgatccacagttttcttaattataaatagggatgataatagggtgtttgtaaacactatacaagagaaatatttaagatatttaattttctgtctgattgtaactctttctattctatgacaatgatattttcaatagaaaaaacctttatacccaacatgcatcatttaattggtttcttcaacgtgagacagaataagccattatttgtacactatagaaatgtaagggcatgttaagatgttatgcagtatgttctatttaaacatggcatgcagtgatgatgtgtaaatctcacatactgttccttcacatcttgttcccttccttgtccctttcctgtgttttcttcttgatccaaggctaaactgtcccagccctgaaaatctgtgctcggttaaaaactgtcatgttaatcccagctgctcattatcgaggactgtgcacaaccccctttcgcccagcatgagcttctaacgctctgattcacctccgcagagtcaccccactccacgtctataaacagagcagaaatctgtggagactatttggcattgtctgtattacccaagaacatgtctggttgtctcgcccttgaccctgcctttaaaagccttcttatccttcaagaccaaacttaaacactgcattttgggaaaagcctgtccagcttcatatatcaaaatgaacatcttcatcttctgagctcctatggtgtattgctgtacattgactatttgccagtcataccatttggccatggtccaaagagaagcatataggttataacctaccaaatggtaggttccttaggaggagagagtcttgtttatctctgaactcttatcttctatccccaacttcctggaatagaagacactcaatatatctttcttaaaccaaactgttaactaggtataaaaattgctcttgcttcccctgggccacacaactacacacattccttagatgagctcatgtgaagttaattagacaagttaattaattctccaactcagcaggttatcagaactgaatgtacccaactcatctaaatgcaaagataataaataggcttttgccttctacatttctaatgggggtttctgaaagaaactttccactagctctataactctaatgtctcccaaatagaagactctatgctaaaaggcctttccaaagtagtaatatacctaacctccacaaataccttttatctcaaagacaatttttctctacaccatcccaggggaaaatgcaacatctatgattttaattttttaccctcatagatcacatccatgcacaattcaactacttaatggggtaaggctgtaggtgagtgcaacaaacctcacgaacctcaaaggttagtgactgtctataccactggaatcctggtaaagttttggaagagccttcatgactcaccttcaatttccatccactcccaggatgaaactaccacaaaatagttgttggaaagaaggatttaagaaccaagcttcaaccatggcagattcgaaatccagccaatgccagccaaatatgagctcgaaagcattcataagaagaggctaaggtttacaaaacaatcctttttgatgagttaagtacaagtgaatcagaaccacatgggttaaattccccttgaaatacccacggatttagaattaagtggaaaagtgcttggcacagcataaattccaggcatctgaaatgcagttagaaatcattttctttgaaacctaacaaaaagggttccctgagatctcctgcacaaaacgccaggtattcttacagcaatggcagctactcctcatagtgaacatagtgccagagttgaattcaggctgtggacacagaaagttctgacctaaattccaaccctgcccattcttagccctgtgtcattgtttaatctcagtaagcctcaatcccctcacgtgtcaagcggagagaatttaaggttgttaagatttgggtgaaatattatatgtgaaatacctgtaattgtctcaagcacatattttttatcagtgatatttttaaaagcatcacccagtgagttgctaaaaatagagtgatttaattcaagaaaaagcttcttaaagtaacgcgaaacatcctgaatcacctggcccacttacagacttttcgaatgcccttctttgtagtgaactgtgcaggtgaaggaaggtctttttggtacctgaacccaagattgagaggggagttgagtgcacactacaaaacaatatagagatggcccctgttttgtgtaaaaaggcagtgcagtagatgaaaagaaaagcacttagaacccaaatctctattcattcaagaatttggtaacctatgtgaattcctgactttgaggatcagaaaggtttttagagaacagctcgtcacttcatagatgaaaaaaactgagattggggtggtgcaatgatttgcccaaggtcacacagccactgaaaagcaaaccagcactaggactcaagtttcctcctggtctagtactattttcactaaatcatgttactactctggatgccggcctgatacatcctggtgccaagtggcaactggtttcccctgcagaggagcaacagaaggggcagcagagtcctttttcaccttggaacacgctgaggatggcgtcaagaaagccaggtttaaaccaggtcagccagaagggtctgtctaaagcacagctgagcaagcgccattcaagccaggattctgtcagtacaacgggcgtgtcagcgacaaagttgagtgaatgaagttcatgccaagtattcattgagaaggctgggcaagataggtccaggttggggaagggaagagaaaacgatgagatgaaggttaaaggaaaggatgactgggtgttcctctagggcatcttttccacagtagggctctctgagcatacttagctgtttgtgcaggggccctaagacactggctatcagttgatatgcttgcatttgcaagattctcacttaaaaataaaaacttaacactcaccttgaatactatgcctgaaatataattaagccatcaccaggagatgaatttgccaggactaaggcttgaggtctgaataagtaggcttctcctatgtggctaagttaaaagttagagtggttcccccactcccattcacatgtggtttcctattttttaaaaactcttaaacaagctaggcataaataataatcagcactccaagtcctctcagccaggccaagttaccatccaactccatttcccctctccctatttgaggtctccttgttccatataaactgttaaatctttgatcctacaacacatttcatgtatttctctgcacacacctttgtttccttcagccatttcctatcccagaatatcttcttccagtttatctaaacaaaacagttcagcacataaaaaattataaacacttgggtatcattttgaaaaccatttcaacttcaacattattagcataaggtttagttttagaccttggtaattccaggagagagggtttaaattattagacctattccaagccaggatataaaaccctttctaaacaggtactcccccaagtatggtgaagggaagcataaattatctaagtcatcttacagcccagtcaagcaaagcatagttttttttgttaaagctgttttggctgttttggcacactaacaactagctttggaaattctatacctaagaagttaggcagaattatgaaaaagcaaagaaaaagcacacaaattagcaaaatatctggctacagcacatactaataaaacaacagaaatatatgaatagcagacagatcagattcagagagaaaatttagtaggaatggatatcaaatgtgttcaaagacgcaaagcctgcaaaatgagataactaggtctgtttttctgacaatcaatgtttataattccatgaaaatttttgaagtatcgtgggagtacctataggtgctgtatagctctgacttgctggttaaagcttagtcagtgagctatggagcactgtacatgcattcagatctgcatctgcatccctgtagagaaatcccacttacctgatttcccacaaagaaagctgtttcagctctttggattcacactgggaacaagaagtgccgattatctgaaagttcagactaggaagcaggtgaataaaaaggtattccctcactcaacacatgccccaagagttttggtcaatgcaaagagcagaagccagaagtcttcttagaaatcagctgctactaaaagttagtgtaaatactgaatacagagcactagaaaagggagtgagagcgttgtgtgctgcaaaccattctctctatcttaggtatgtgctcctttgacaatttattggctagtacagcctgtttcctttcttaacaaattgtagccacaaatatattatgtctaaagaattttgagaccccttcgaaagggagcttgatccaatcctcaaggctccaggcactttcagcatcagcagagagctctccaggaagtctggcgggtggaggctggattcccccagactgaaacccaagaactctctcattagaggagtctgactcaagtaaaaggcctgcggaggacacagaccaaggacaagcaggcagacctctgtgaggagccagggtccggagcaaagcacagtttttacaatcctcaagaacctctgccaacccagccaggctacttacctcgcctgtgtctatgtgaactaaggaaacagtgtaaattcccctctcttcccagaatgactgagtaaatgctaaggcttgttaacaactgccaagaggtttctacagtattcaagggcagactggattcactctggcatcggaaaagaggttgaaagagatgatggcatatcagaagattaggacgatagaggaaagttttcatatctaagcagcagcaaaacaatgaacaaaatatattgaagtgaaagacgaagtattttaccaacaaaatcctatggagacaaagcctgttttgtgtgcccatcatctgttttcagtcatctattatctgcaagagttaagtttgtctatttctacttagtacatgtggaaggcaaaacgaagtaacagatgctacacaggagaagccaggctcacataataaagagttttgaggcaagaaggcagaattcatgggcctcctttactcatgggcccactaaaggcgactcaaattgctactgcatgaaatcaggctcaccctgggtattggcagaggtacgttaagttttctcttcaacatacccttatctgaaaccacgctacgtgtactcttagacaagaagacgagccaggcatgagacaaagcgcacacaccttaaatcaataaaggatcctaactttcctgtaggagatagcaataaaaataacaataataataaggaccctggttggtgatgggctttaccacctacaagccttattcaaatcacttaatctctaagtcttgtttccttatcctataaaattgggataataatacctgcctcagaggatgtggtaaggattaaatgtgataatacgtaacaaatgcttgccttactgggtgctcaaagagcagttgctagtatcatttaggagaggatgagagagtcaaatgttattctctgaggtttgggattccccatccccttggtagttaggtgcagagtttgtgctatgtgatatgagatctggtatatttgtaatttgcataacttggtatgtgttggctttgtaagtattcctcggttgtcttcgtatgagcacattttgatactctaattacaatgcgagcttctaaaattgcaaacccatggcttcaatttcctttggatttttccaaaagacttcaacaaatgttgacggagccccaaatagctcatatactcaaggacttggatgccagaagaggccctggaaattgcctaatccacgtcccctgcatgccacagtggaaagagcccagtactggaagttagatgtcccacccctgtgtgaccctctctaaaccatataacctctctgggtcataatttcctcatctgaacaatagggatcatgccatactacccaacccccagagttgttgtgaaaactaagtaatgtattcagaaatcgtcagccaactgaaatacagggagttttcatcagtattattacagactagaaaacaaagtctcaagagggttgagtgatttgcccaaggtcacccaaaaccccagtgatgagtggtctgtcagggaggggctttaaaataatgagtataagtgctaaaacaaaatgacttgtcttttcaagccaattagtgatttccttaaaactagctgaatgtgcagtctttcccttcctggctctgccctttggaaatgttcattaccttctgctacagggacacctagattctagagtatgtgtttttgtagcctgggcagagtcagagcaatcacctactaaggccctacaatgaatgttaatgctttaaacatttatattatttaaaaatttgtgaataggcaatatattcaaagggttcaaaaatcaagaagcatagaaaatattcactgaaaagtcttcccataacttccctctgcccagttcctatggccaaacaggtaacaaatttattggcaccctgaatattcatccagcaaggtttttatgaaaacacaagtaaatagaacatactaaatatcaattcaagctccattacactcaattcaaaattttaaagaatcatatttaccttttttagactttatcaacaatttttgattcatccactgaataaacaaccttcagatgaaaattttcctactctcagactatggaaaaagtatctctaaattaaagatttcagctcctaatttagcgtatgtttttactcatccttaaagctcatcttgaaatggtttatactgtcaatatacacagcagagcaaatatgaaggcaagtcattctcttgggcaagcattctggaagaactatttagcacatagctttccctggaaatggggtcttaaggcttattggtaaaaagcccaaattttagtgtccataagaaccactgaggaacttattgaaacgcaaatccctggactgaaccctcaataattttgattctgctgggggccaggaatcatttttgctgagtaaccctgccaatcatgacgtaagttgtcagtagatcacattttgggcaacactggactggatgttagaagaatggaatcaagcctggactcccatcaattagctctgtgacccctggttagtaagctcagttcaccgaaactcctcagaaccctctacaaaaagcagagattgggccagaatgctataaagttcctctccacaggtccgtgctgtgatgctgggacatcttcagtaattttggcagaccgtaggccacaaagaggccatggattactgtgatatatctacttcagggaaactttacaattctgaaagagcatgtaacacagtaacccacagtttttctttgctttaataaagttattttgttgcccaatggtggccatgttgtgtattacaaatagggaattgagtcaatgtaagagaactccaaatggaatacccttttgtgcatgggcatgaacgttttaggtgtcgccatcagcaaagggaaatgtgagtgcctttaaattaactcaagtcttggattcattaaaaacagaaacatatttttaaaaccaaagtattttcattttcaaggacaaagattgctattttttagagattgcactaggtggtgatgccaactaatggactgccactcaaacaccagcatgccaacttgctcgctggcaggaaagctctgcctgcccatggtttgaggaaagcatcttccctacagctggggtcttccagtctaaaccaggcaaggagaacagcccacacaagctttctgatttaatttaaactggaagggaaacatttatgtattgttttaatcaatagtttggaggactctaaaatttgtaatgaaacattctaaatctaattttcattagtcttttatttaaatgaagagattgtaccaaaagaagatgtttttatctatttgtaaagtcctttagaggaggattatatgcccagtacctagtactacagtccttagcacagactatgtcttcaatagatacatgagagacagtgaatgaatgaacagatgaacaatcaaatgaaccaagatgttttactcatagtcctgtctagaacttcttcatgaactaagttttatcatcaatattcattgagtacctactgtctgccagacactattctaggcactgaagatatgggtgaaaacaggcggccagctctccttttctgaagctaacttgagagagagaaagagacttttaggtaaatatttttaatggtaatgtgataaagagaaactaaggaagcaacactggagaggaaggtgagagaaaatgaaggggttaggtaaataaattaattaatgagtatcatatgaaggagattgcctcttgtaaatcagctgtcctgcagggagcaggcagggaggagggaaaaaaaccctatctattaaatctgttttgaacaaacagattgagaagccatatttcaccaggtgaaccactgcaaagctaccaagtagcctaagttccaaatatatacatttataaaacaaaatattttaaaaatttccaagcaattaagccttcaagtgtaagttatgtgtatttagccaactctcctgtgccattctgcaaacgggcgctccccatgtatttggtactctttcctcgtgggtatcactctgttatttgacactctctactctctcctctattccccacatcctgtctagctttagagctccacgtgtgtgcacatcctacaacgatttgtttccccctgttttctggggaatactgaagaaaggtgcagagccgtagaggcacagtcacccctgaatccagaacaattttaaaaatgcagattttttgtgatacattttaatcttgatatatttcaaaaaatgctctgaaaatgagacttggagatgaagtttgatctctttagtgagccagctatgtaaaaacagtgctcaaaatctagaagggccaacgagcaggtatcacgcatgctctgcacttcaccctttctctttccaagcatctggatccttttatatactatattgttccagtgggtggtctggaagttttaggggaaggctgtaatgtttggtatgggaggcaggcatgcagaaagctcaagagtgacgctgtggctgcctcaccatagaacaataaccctgtgattagctgaactttgctcacccatcaccttcatcatcacacagacaccaacaccaccctgactattcaacagtcacttgagaaggctttttattgtataggattatttgttggacagcaccccttgcaaccagatcaataaaacaaacttattagaatcaactgctgggacaggaaagcatttctgtgatacaaagccaatgcggttttgtgtgtgctttgttgtggggtcacagaaaagacactttggggagaattaagttgaagtttctggactcaatgtctctgtctaaactgctttcagtgattcaggactttttttttttgtctaggtatatctttgccttctcaaatgcttattgtctattaatataaaattaatttaattaattaaaaagcaaaaatcccaggtggccctcacatatcgatgaaataaatatttatagttgcacaactacataataaatcctagtttctcactatccttcatgataaaactagaactgcattctcagagaaaggtcccaacagaaacttggcttggaaggaattaagttaataaaccaaacttttagtggttggtatttaaaaggatgccacgtggaagaataactgcagaaatgggggaggtatctcagagatgaatgtcacctgggtatctggtctcacctttcccccaggctatctaaacagaccggcctaactccagaggtaatgagttcatcaccatgaatgtgcaaagcacagtaatcatgattactttcctatgtaccaagtattagaccaagtgccttacatatagaatctcaattcatcctctttaaattccaggcgagaagcataaaatgattaccactttacgatggtaataattcattgggggatatcatttattgctccccacccaccataccttggtcagataaagatctagaactgagcttaagggaaacagctgtctctcacctcccctattcctccccagacccagcaaagtgcatggtgtatagtaagtgcatcatacatattaaatagatacatgaaaagttccctttctccagagagaaataaagctagaaattctaagcttttattaattttatacttgtggtcttttctaattcaaaaaaattatgtggcctttgtagaacattcaaaagacacaaaaaattagaaatcagaaaatgaaattcaactataatcccaccacccagagtgaaccactgtaaacattttcatctgtgtttttcctaacattaatgaacatatcttaacacataacacaatcatgtgttagttaattaaaaacaaaaggcctgccaagctgaccccattattactaaatgaataaaaggaaacccaccaagtaaaatattgtgccaaaaataacagaaatacagtaagtatattatttaaatgatgttcaatgtgataaaaaaaaaaaaagaaaaagaaaatgctaactttccactaatctcagcaaataaaaactcctatatattttgtagacttcaaatgtctgtacccagggaaaccattactcaacagtgtataaaacgaaaaagctgttttgaagaatgagggtactacaaactcacaaaactgatactctttatcttcaagattctaaactattttaataaattcctggggcaagagtctgttcttaaattgaattgaataatggcatctaatgcatgatttgcatttgagcctgaggaattaaaaatttaatagagcagctgagtattttaaatcttttggaagaattgaaaaagaaatatgaactcttacacaccctgtaaaccagaatttttttcttaccctaagaatatgttattcatgtactctgtacattaggtcaaatattagtcactttctttggaggctgaccaaatgcctccacccttcattgcagagtttgctgtaatcatctgtagtaagaatagcagaatcacactaatatgtgctgaaggctgaggatacagcccctggaggttttgacaacacatttccaccacagatttaccacccttttcatttgcttttaagcaacaggggaaaaagtttcaagtatctcagtaaataaaatgaaatataaaggacaatgacatcatttcaacttggctgaaattgaagcctttcagctattttgtgtcaacttgaatttcataatataaacacctattttacttgtgtctccacactttaagcaagccagttatttttttaattggatttccaactataaagttaaacaagacccccaccctttctcttcaagacttcaacatggaaaaacctttgaatgttgacactaatcttcctgaatcatccaaaatttagtaaagcatgtttactgttactttttaacattatgttaagaactgttgtagcataaaactttgggttcatgttttattaggtttatacaaaaagaaaatgcaaatgaaaccataattctcctttgacatggatgcttaaaatcatagactgtgagatctggaaaggacttcagagatcttctagttcaaccccttggatttatagaggaacagctggagacccagaaaggtcacaggccaagaaaaacaactgatatctagagaatcctgacagctgagtaacaatccaacaatcttggaaaatccaaaatatgtcccaaagcaatttatgacagggttatttaaaaatcacatttacgttgctgtctgcattgtttttcatagccttggcactcaaagtgtgacctgtggcccagcagcagccgcatcaccatcacccgggagtttgatggaaatgcagagactcaggccctgcccccaacctgccaaatcggaatctgctcttgaacaggatccccaggtgatttctatgaacattaaagtttgagaagcatgggtttacaccagtgctttacaccagactaaaagctggttcacagatttgtgagaactgttttgtgtccagtctgtgatgaggtaaacacagaaattaagagtaaacctttaggaacgtttttatcaatttcatggagtaatttaatataggctgaatataattcatcagtggggcttttatttgtatatttttgtatgacttttctagtaattcagttttattatatttttaaagtatcaattcacaagataagaaatgatttttaaatgaaatttcatcatagatagagaaacactgttgtgtaccatccttccttccccctaactgagaccagtttaaaaaaaataaattggctcacttctcaacttttctgtgagccaggattaccctgataccaaagccagacgaagacatgaaaagaaaactacagaccaatattcccaatgaacagagacagaaaaaccctcaacacagaactatcacaccaaatccaacaatatataaaaagaagtattcaccatgaccaaatggaatttgtcctaggaatgcaaggtcagtttaacatctgaaaatcaattaatgtaatacaccatattaatagaataacagacaaaaaccacatgatcatctcaatagatatagaccaagcatttgacgaaatccaatgtctattcatgataaaactctcaacaaaacataaacagaaagaaactacctcaacctgttgaagggtacctacgaaaaacctacagctaacatgatacataatggcgaaataacaaatgctttctttctaatatcaggagcaagataaggatatcagttcttgttacttctattgaacattgttcttggggttctaaccagtgcaatgatgcaaagaaaagaaattaaagtatacagataagaaagaaagaaagaaagaaagaaagaaagaaagaaagaaagaaagaaagaagaaagaaagaaagaaagaaagaaagaaagaaagactatctttattccaagacaatataatcctgtataagaaaatcctaaggaatctaccaaaaaaaaaaaaaaaaagtccagaaaagtcacagaatacaacatcagtatacaaagagcagtcatagttttatatactaacaatgaacaatcagaaaattaaattacaaagcaattcaattcacaattacatcaaaaggaataagatttatagtaataaatctaatgacaaaagtgcataatttgtgcactgaacaaaacattgccaagataagtcgaaaaatctttaaataagtggagaggcattccatgttcacagaatggaaaaatcaatactgttaacatttcttcacaaattgacctgtagattaaaggtaatctttatcaaaatctcaatgcaatgttttgtggaaactgacaagttgaaggtaaaatttatatggaaatgcaaaggacccagagtagccaaaacaatttagaagaagaagaataaagttggaggacttcaaaacttactacaaagcaacagtaatcaagagactatggtactagagtaagaacagagattagatcaatgaaacagaatagaaaggccagaaataaacccttctggttacggctaactgattttcagcaaaagtgtcaaggaaattcaatgagaaaagatggtcttttcaacaaatagtactagtaacattggatatggatatgtacatgcaaaacagttgaccctcacctcacaccatatacaaaaattaattcaaaatggatcacagacttaaatataagagctaaaactatgcaacttctagaagaaaacatgagaaaaattttaagatcttgggtaggcaaagagttcttagataaaatatcagaagcacaattcataaaagaaaaagactgataatttagacatcatcaaaattaaaaatgtttatacttcaaaaggcgccattacgaaaattaaaaagacaagtcacaggctggaagaaaatatttccaatatctgataaagaacttgcattaaaaactacaaggaactcttacaactcaataagaagataacccaattttaaaagccggcaagacattagagtaaacatgttaccaaagaagatacatgaataggcacatgaaaagatgttcaacaccactaatcattaggaaaataaaaatgaaaaccacaggacatcatttcacatccactagaatggttataatgaaaaagaaagacagtaaaatagttgtgagaatatggagaaactagaaccctcactcattgtttaatgggaatgtaaaatggtacagctaccttggaaaataattaggcagtttcttaaaaagttaaatataaacttggcatataatccagcaattctacacctaaatatccacccaagagaagaaatacatatggtcagacaaagacttgtatgtgaatgttaatagcaatattattcataatagccccatactggaaacaatcaaaatgtccatcagctggtgaatgtatgaacaaaatatgatatatccttacaatggaatattactccacaataaaaaggaataaactacatgctacaacattatgccaagtgaaaaaagccaaatataaaataatatgtgttataagattctatttatttgaaaggtccagaaaaggcatatctatagagacagaaagtgtattagtggttgcccagggctctgggagagagcaaggattttttgccaacaggtgtaagaaatcttttgggggatgaccgaaatgttctgaaactagattgtggtaatggttgcataactctaaatttactaaaatttgaattaaattgaattgaattatacacttaagatgggtgaattttatggtatgtaaattacacctccatgatgcttttttgaaaaaaaaaatcaattcacaaaccaattcttatatttacctaaaaagatgcacacgttgtcaactaatacaacctacaagtctgtggtcagatattctacttctatctcaactgtatggacttaatactctttctgtttgttttggttttggtttcttacactcactggataagtaagctttatatatctaaccacctggggcagatactaaacctgttttccaatcatatttttcctgttttttagaagccattttttccaaactaatcctaggacttaacacagttggcttatctaaggatcaaacctgcggttatgacctcattaacatcacgttctagcaaataagattctttacataaatctatatcacattccttaccttttcatgaagagatcaataaaaggatgtatacacatacataaatacacatgcaaaaaatttgttttgtgcctctgctactgtaaatgttgggaaaactttgaaaaaaaaaaaagggaggtgtgaaatgagatactcacgtaacttcagaaccttagggtgagaagattatggagacagtcatcctcatgaaattcatgactcccctatctaacatttcttaaaatgttttcctgaatctgttgaacactctaggtgatagggtgctcactacatttaaactggaaaagtcaattcttgctcagttattgattgaatcacttgccccatactcatttatttaaaacaaaagagcaatgttattgctcttatttattctgcagtcatggagctaaaaaagaaagcctttcagtcagctaaggagagagagctggtgtgaatgtgctgaccagcccaggcaaactggcatctgctggccaggctgcaggggatgggtgggcagatccaagaggaaaggtgattggaagggattctgcctgtggatgaaggagcttgtgttataggccttccagggcctaaggaaaatggtctgttgactaatagtgagggtacattgtttgctggaaagcagagttcacaagccccagagaaaggccaaagatctagtataaactagctggaggctattcagaaaccaagggcaatgcacgttcagggacaaatgctagattcccactgagccacaggtcagcatgggtatgagaagtccaaggctggtccaacattttagcaacacccatcagcctgatttaaataacactcctacaaagagtcaggtacaaaatgtgaaatgaatcttggaattcatccatccaccactgatagcatttatcactggtttaaactaggtatagcagaacaatggcaccctggtagatctgtcttaggcctacaacaaatccaaattagattaaagcatcaaatatatttaaaaatcgaaccacaaaaaactggaagaacatgaataaaaatatttattgaatctttgaaagcacaaagactttctaatcttaaaagccatagataaatcacgaggaaaaggaccacatgtaaaatgaaaataaaaatatatgtacactaatacaaatttaaatacctgcaaaaatatttaaagtaaagaagattaaaaaaagatttaagaacctatttcaataaagagtaaatgtctattgttgggaataagcaaggatttttctttcttttttattatttaaaaaatccctatgatggcaagaatgaggtgaaaccaaaacttagacatgcaggtgcacacgtgaccacattcataataggtagtaagggctttaaagtgcctgtagccatcctccaacaatttcactccattctaaatacaaaaaacactctgtgttcaaagatgttacacataacgaaataacagaaaaaaattaaagctaagggtagagcccaaatgcttaaaaaatgaaaacacagggttatatagtattttaaaatgtgtatgtgtggaaaacatataatacaaactgaatttatgttgtgattgcaaagaaatttactatgtaaagaaaaatagaaactagaaggaaatatagtcaggcaaatattaactgtgattatattagtatggtaggtagtttcttcgctacttcccaaactttcttaaatgagcatattaaacattaatagcagtcactcagggacctatgagtattttctccaatttctctgcacttttctaaattaaaaaaaatacttttcacattatctattatgaatatggattactttgatatcaggatttcttaagtaaaggatcgaaatgttaaaaggtctttgagaaaaattctgaacattataaatgaaggattctcaatgctgaaactaccaagctaataaataagtaatgtgctttctgtaaaaagaaatcatgtattattaaatctctacctttgtaggggcaagaggaggtcagaaaaagaaaaggccaaccaagttttcaataaaggggagaattaaaattagattttccaagactgtcacaaaatcactgaagaagctccagaccagaaacagtaaaaaaatttttaagaaataagcaacaatttaattagtttgttaaaaaaaaaaacaaagacccctcaaagaataggaagcaaagagcccccaaggatcagtactggggattgtctaaaacggcatttttaaaaaaatcttggagagaaagtgtacaagtaaaatctacacagttacaaatggccacgaaatcatacacatagtaaattgacaagattaaaaactctagcacaaattcatgatggcagtcacctctggagagaggaatggcaaaggaactagggagaaaaagagggacataagctttatctgagatgctctggttcgttcatttaaaattcatgaaatgttgacatttgttaataccaggtagacagtttaaatatggttgtcttattagtcactgcactgttttgcatttaaatttttttaaaaaacaagaggcgaagggctccaaacagagacaagtagactagttgcgaacatctgttaagtgtgaaaagggggaacaatgggaggatgtgggcatggttctgcagataaatgaagggcacctgctggggatgagccagcgaggtgggaaagaccagctcatgggaggctttgtctggtccactaaggagtttgagcattatccgaaaacaggaggctaagaaagcgtttcaactaagaaagaaatctttctttgagatctatcttttgggattgtctcaaattgtttttgcaagtttgtgtttttccatatatttatatatacatatgctgagttatgtgatgattatggcccagaatacacaacacagctcaaattatacattggaacttcatatctataactcatatcatgatgcccattaatcttaaaatggtgcataaagtgatagctatcacattgttgtactaaccatcactatgatctcatatcacaacagaatataataaattgtaaattaaacaatatggcttatagtgttataaaaataaaaaaggacaatggctaaattttaaaataacaataataattaagattattccaaaacaggtcttacaaggctaagtgaatggagagttaaagactaaataagcttcagcacatgtaaaatcatggtcataagaaagaaaatatatattaccctcctaaggcatagctctcaattaatgatttgtggccagcaaggagatcttggattctcatcagtcccttgaagtctgtcatgttccctttaaccagattcttggcaaacaattaaaggaaccatcagaaccagactgaggctttgactgagcctgctcccccaggaaaacctctgctatcaagagaccctgggcagtaccatcaaagaactcttctctgatgagggtaggctgtgcagacaggccaggacgccatggatttttagaagccagtgatggtcactcctctactgactgtggatgaatgaggggtcccagattaaacccagccttggtgcagccttgcagagccctggctgagggttaggcctctttagccttgtcccgaccgcacgggtcctgttctcatggtgtggagcagagaccatgaagctgtgtgatactcaggctgtggcactggcctaattaccttgttaattaattcagagcacattcctgagtccttgcaatggtcagtggtacaatattagaccctaaagatacaaatgtaagtaagacagagcctctgtcttgagtgtacaacctagatggggagataagtatagacagtgaaatgaaccagtgtgattatcctggaagtacaaacaatgttttggaaatagagaagtgattcttctgtgaatggctaatggaagctttctcatctgacaaatcagtaagaatgtcaaatggaaggagcagcatggatgaagcatggcactgcaaacatatactgtagattgtggattgttgtttgtgacagcaagagataaggctgaaaaggtctgctgcttccaggttgtaaatggcctggtggctctggcaaaggagtctggactttttcctaaaggcagtaggaagtggttaatgatccaatgcatgttttaaaaatataactcttacttgcccattcaaaaaaaaaaaaacatattaagcacctactttgtacaggcaccacgtacagataacatctatatcctaaacagctctcaatcttcttatcactataaaaccagccaatataaatgcaataagctagaaaagattccaagaaatgttaataaaatgattagaaacatagaaaagatcaagagtatgcagtggcttccatgtgacatcagatcaggacaatcaggaggcttccatttggaaactcaagcctgacacaaaatagcatccaattttatgaatatcactgttgttttgttcatttaattttgaatgttaatttaaaagaacaaatattgatgatgactgcatcacatataaagatattaatactaaaatctactaaaattctgaggttatgttagatgaaaataacacaaaagcaccattttactcaacagttaggcattcctataggttaaacataaaaacgggttccagaagggaacatttgcagattagagacgggaaatagttcacgtgtgacacgaagtataaactcaagtaaataccatgaaagacaggagtattctttcagagatggcccctgcccacaatcacagataacaaaatgaggatgaaagagcaattgctctagcatggactttagagtcttgcaactcgtattaaatgttaaagtctccacactccaaataatgctctggcaaggaaatggtaaaccagctttagagctccgctcaattctttatgtatttacatatgtatgtatgtatgtatgtatgtatgtatgtatgtatgtatgtatttagggggtacaagcgcaggtttcttacatgcacatattgcataatggcaaactctggcttttactgtacccattatctgaattgtgagcattgtacccaataggtaatttttcaactttcaccctcctcctaccttctcacctttggtagtctccaatgtccatcattccactctctctgtccaagtgtacccactgtttagctcacacttataagtgaaaacatgtaatatttggctctgtccaacctctgcggaaaacagtatggacatttctcaaagaactaatccaacaatatctacccaaaggaagagaaatcattatattaaaaagacgcctgtactcatatttttatcacagcactattcccaaagcaaagatatagaatcaacataaggattcatcaatggagggctggataaagaaaatgtgagatacacacacacacacacacacacacacacacacacacacacaccatggaatactactctgccataaaaaagaataaaatcatgttttttgcagcatcatggttagaactggaaagcattatcctaagtaaaagaatagaaacagaaagtccacttacttcttagcctgacatatcaagctgggaaggggcacatagtaaactgggaaacagaagagcaagaggaccaaaactcacatggagtggtctcacctacttgtctgaagtattatgaagtctcagtattgttgactctcaatgaacacaacaaaacaccttggaaaaccaatgattttgaaatgactctccatttaacttacctccaaactccatctgctcccatcatctccctcccttcatggtgaactacctgccgtttccctgacaacgttgtcttcttcttccaggtcgtatcctttcttgcaagtcatttcatttttcatcaactcttacatattcttttaggctctacaaatccttaattttccaatccttaattctctggaaaaaaattgtccttgacctctcagcctgattaaatgtttttttccccctctactctgatctccctttgtgcacatgtctaatatagcattatcactctgtactggactccttcatttacccatgggttgatcccaacagaccataagctggagggcaggaaccttgttttattggtctttgtgccttagcacatccagtgcctgctggaggaatgaagggaaggtgggagggagggagagatagatgcagggaagagagggactaaaatgaatttctggcttaaaaatgacaccattgatgcactcgttcattcattcattcattcaacaatttttatcaagagcctactaagtgtcacacaccactcttgtagctaaggatacaacaaagtgtgggggatggtgggagcagtggcaaacaaaatgtctgccctcatggagtttaataatgtcatggaagaactaggtcagacagaaaatatactatatgttagatggaggatgtgttgtggagaactgtacagcagagaaggtagataagggatcttggaggaggggtctctgtgaaaaataagctactgtgtttcccattcaatgcctcagcaccaaattttattatttttattgccctcatataaggaattcatgctttcctgcattagcatcccttccaatagcaattcttttagaactcataattctcaggtcattttttttaacctcagcctttttttctgatgcccaacatcaattggactataaatctgtcatatactactactcgtttaggtctctccaagttataacccatgtggtccagccaagatacagagattcccaaaaatgctttcatcacatcccagctggaatctcttaattcattattttcaggtctagccagtacctcctgtgagcacttgctgtacagaaataactaggtcacaatagtgttctcaagattctgaatccctaattacaattcccccatgataaaggcatgagggtacatatttacatgaaccaaagtttttcctttctcaagccaagtaacattttctcttgtataatttgagtcagaaactcagttctcaaaattaaaaagtatttcaggtttataaaccactgattaattccaagggggggcattcaaacatctaccaccactctttcctggcctacttaaatcgccctttttttcctctcattttatccattgtaatatgctctggcattttcacaataagaatgcaatcagaaaacagacagactggcctcttaaataaacaaagcctgttatttcttgaattaagtggttcaaagaatgctcattgccccgccttccctgaagtttctttagtcaatggcttgtgattactcagcagtgccatttctactttttgtttcatgtgttggtgacgttccataatgcacgaattaatgtaagttaggaagtgagccagctaatagggcatgatcgtcctttttgcaacgccttcctacaaggtctcaggtgccatatgccgctaagattaatatatttgtaacatatgtcttgttgtaaaagcagtcttcagctggcaccacatgattgatttgtgcagcctaacaattcaaaaagaaattaagctgttactatgtgcttgttactaaagtaatatttatctttatacaaaccaaccatcgtttacatgcaatctacaaaaaaaaaattgaagattggcatatgtatttttggacagagaatgggagtagggaattgaaagtgatgctactggttcgtgtatttgagaagaaaatatattttaaaatcaaaccttctaaggttggcaagtagttcaaattcatttttagttcattcattaaaagggagaaagtggaaagaaaaatcaaatctgcatgggaagaagcacaaagcagctacatccacatggctgttcccaagcctgtccacagggataatgactgaatgttagggatgatagttttgctggtactaatgttattttttcaggctgtgtggcaatactgtgaactggatccactagaagtgtctgtggtttgacgtatcctttgttaatgttccactcctaggcgtgtgctctccaaagcgcatcctataatttatttttaagtgaaaaatgtcagctgtagaaatgcatctccaagtcttttgggtatatacccagtaatgggatggctgggtcaaatggtacttctagttctagatccctgaggaatcgccacattgacttccacaatggcaaatgtccaacaatgatagactgaattaagaaaatgtggcacatatacaccatggaatactatgcagccataaaaaatgatgcattcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacgtatgtaactaacctgcacaatgtgcacatgtaccctaaaacttaaagtataataataaaaataaaaataaaaaaggggaaaaaaaaaaaaaaagaaatgcatctccaacttgttaaagctcgcagacactttcagtgaccttataccaaagtggtaagcacagctttgaaaggagggcaggcagggcaaatgcaatttgaggcacagagatttcaccacgagcactgaatcttgcttgtatgtcataacaaatatctggatgtagcaattagagcagagaataagaagtttttccttgcatgcttacaacagaacatttcttgaccccccaaaaaataaattcttaaaaattccatatcagctgaatttaggaacaattctatctatgaagcaaaacagttatataattcctgtttggcctactgctgaattttaataatggccattatttttcttcttatattacaatttcatctacatacagttgaatatatagctctactaccatctcaaaaaagcagggaaggaagaaggttgacattttcatcttttagaaagtctcaactccccagaagctacctttctgaaacctatggacatctggaatagctcaggtctctgaagaataatgaggagaacatttctggaaatcttttgactgagacgtggacttctttcactaatctataaatcttatctcagtccacatcactctggaaaagaacactttatgtcccatcccttcacaaagtgaaaaagctactaagttataaatcaggctcttccaagctcatatgtcctaagaagggctcttaataataaatccctatttaatcaaactcatgcacacttagattcaattaatctaaactgtggtatgtggtagggtccacagctttttagcaacccaatacgactaaaagaattgccactagtattaacttcctgaagttaacaaaggagtctattaaataaataatgaataaaccagagtcagtggagagctacaaaatatgttttgaaattgaagggacacagtcagacatttctgtttcattctctttctttctctcttacagttactgaagttaaaaaaagcttgaaatttccacccttcttggtatttctcaatccagcctcttagtttcattttcttttccttccttgtccagtttttccaattgcttctaagccaacagatcctcatacctacccacaccatggcgctatcaaagaagaatatacagtcatcatgcatgcactaggaccattcatccctgacagtcagacaagcgtgacatttgtatttcttggggcaactgaagaacacctttttaaagtttgccatttcctagcactatgaaacacgtggtagagcccctgccctttggagatcaagcaatcgatcaatcagtctctttctccacctctccttagaaactctacgttatatccctctgacataagctttttaggctttctaggatgcttcagccaagtattatcttctgctccaagtgcactcggtaactggcttctccatatgacttggcaagataatgctcagtctacgaatggcagataaccctacagtcaaaagaccgggttgttctgagcacccacaggaaggcatgggaaaaaaagaaacatctactttaggccattccagtgatgctagactatgccaaaagccacacacccaaatctgaatttcttctgaaagccaaacttccttgtgaccaaatgtttctcagggggaaaaaactgatagtacattaatccatgtcacttcaggctacccagagtgatccattttaattattttcattcttatctccctattttcagccacagattagctacagttactattctatcctaaagagataaacgaaagccaattataatttcataatcaagtatagcgagccagaggggtaggaaactacccaccaaaacagagactaaaactgcatgcacttgtatagtggggcagacaagagccaaacaccaactctgacatgacttgaacttgctgtcattgagtaactgaggctgggtgagctcagaacatcatcacagcaatgcaccaacaaatcatgcactacaccatcaacccatgtcctattgcaaaaagtgatcagctgtatatatgccagatccattctttaattcaacaaatatgtattgaccatctactctgtgttagacattttctagccactgtaattagacagtcaaaactccctgttctcaaggggctcatgctctcagaggagataattctaaatttccagtagtttttatatgacagaaactgcaaatctcctgatacgtgcagcaagaaaacaaagaggtcataaaagaaaaccaattctcaactcttcctggaatacacactccaatatgcaatatgcctggtctactttcacagaaattccaacagaaggatgtcccgggcagcgtgacacagcagcagttcattcattcacacatccggattatccatgcctgtgtgttctcagactccttcaggaccagattgtcttctgattctatgcacagctcaatttcagctaagccaagtgttttcaccacataatatccacttacaattaaagacaagctctccttgacaaaattaattctaaatattgcctagttccctcaaatttgaaattttaaaaatggacatagtgtctaagagacacagagaacagaaatagcaaagtgtcagcagtctgactgaaaatcaaaaaggtgtgaaaaatgagaggaaagaacaaagatagagctaaaattaaaagatagttaataataacaaaaggtaatgctagcgaccacagtgagctctaaaagcaagcaaatacatgttggagaatatagatgccccatagtctgggctgactgagaagacataagtctcattcctagacacctgccttagaattccgagtcacagaggttccccttcaatctcactctttgctataaaatatgaagggttgccccaaggactgactaaggtggtatatgttcataagtgctgcataaatggaagggatgacataaatgtggcatctctgaggtattaacacttcacagaatacacttggctctacctgacactgttgtgttcatggttttaaaaagtcgagggaaaaaactatcggctaaaaagtacagatggtagatcagtcatttcttttttgaattacaggaaattcaagaaataaactatgcctgaaaactactcatttgttcatttttccagtcaacaaatacttgctgggctactgcgtgtcaggcattagacctaaaatgttgaacagaacagaaatagtctctcccgtgtggagtataaaattactaataaactagcaaagacccatgtttcattcttacaacatgcagtgtgatttcacctattgtgcacagtaggcctccaacaatatttgctgtttaattttcaagaccttttagatgcagtaagaatttattcttctaaagcccacaaaaccacatgtggtattagaaaaaaatgacatgaccaaacagtgtgttgctaggtggttgttgttattgttcacgtaaaccattacaaatgtatctagtgactgacgtggtggccacgacttgtccaaacagcaaatgatttactgaagccaggattgcatgacatccaaaggcgttccccagggacaagactgcaggcatccattcaaaagtatgcattatctcaaaatgtttgacgcctaaacaaaccatttttgtggtgtacttgcatttttttggacacttgagttccagttcattaacgtttctgggggaaagctagggatcagagtccctgtgggagcacaaggattagaggaaaagcaatctaagcagcaaaagactcaagatccctctgactttgaagggcattggaaacctataagaagagctctctcatcttaacaaagttggtattccagaggctcctctgggaagagtctcatggtcagccggagccatcaaacttctaatgtgctatagaaaaatgtacagagctcctattcccagcgtgggagtcacagcaccactgcacacctctcaatgtgtggccagccttcctacacatgcccttctaagcactgcttccatctctccacaggaatgtgactccagaaggcgggatgcgtgtgtttcattcattattatacatctccagtcattagcatagtgcctgagaaatactcatgcatgatagataaactcacacctcctctcttcgtcttagaacaatttcttttcagcataacatcacacctttttatggatagacttaacaaaactgaacactaacaagggcagcttgaaatttgtgggtttaaaataaccaaatgttttgatttttctaactttagtcctctgggactaacacttttagtcctttgcaacaaaagaagaatggcacatggttccatgagtaaaagcatcccccactcccatccaacctgaccaggccgtatttgtagacttaaggtcttacagccacctggaaactgtatactttacagagatgttcagtttattttactgatgggtaagtgtctattacctctcattgattttagaatgccgcatttctaaaatagctaagtacctcttatatttcgttattggccttttctgaatagacaagttcattttcccttctgtacctgtatgtcagtaaaagtaagcaaatctttcaggaatttttggttagctattgggagaacaaatgcttcccagacacagtcaccattacattttatggaaatagttttccccttaccccttcattttctctttctttattactatttgcactattgtagttttagccttcattacaactgcaacagttgaatgtgtactaaagaaaagcacacggttgatgtgcttctttcttgatgttgacctttctatatccagctcaagaatgttgggtttcatctgaataggggatccaaaaaatacgctgttcaagtaaaataacaaaacttctaagtggaaaaaatggtcaaaatgaggcctttaagtttaggtgtaatttcagggatatgtgaacatttcatgatactgttaatgaaatgatacttgtcaaccaagattaccctcattttcatgtgaatttaaaatagttaacatttcttatacatgtattatgtgccagatcctgtgctaagtactttgtggatgatctcacttaatcttcctgacaatcttactagataaatactataattaccctcattgtatagattaggaaactgtgcctgagagacatgcagtaacttgctcaaggccaccaatccagcaagtagcaagatttatcctcagagcgtgagttcgtgatcagttttctaggaatggctaggcaattagaaaaacacaactcctcctaattagatattttaaatgaaaacattaaaatgattgtcatgtgatactgacaagttggaatgaagactcctttgagatatgatttagttctgaaaataatttcactatcattttgtctcattcataaaaagtaaagaataacaaccccaggagccatgagaacaggaaagtcctgggtacactcccagttggctccgtcaagggatgggatgccttctaggcactgccttttgtttagttttgtgatagcttattctgcttggcaatgtggagaacactgtagaaagaaatgaggcctaaataaggtctgaaaagaaatagcccaatcccactccaaattatgccgtctgaaaaaataaataaataaagaattttcgatggtgatttagggttgttttcctccaaggacaatctgaattctattacatacttctttccaaagccagttttatatcattaagatactgtggatgcttctgcttttatcttctccatagtagaacaagaaagttccaaaattttctccagttttcaagtgaagttttcaaatgattatataaagaatgagtcaaaatttacttctggcttcgcttttgccttttaacgttcacgagtcttagtttaaagaatatatcattggaatccctaacagaatatgatcatttccattgggacttcaggaaacaaatggttcatgaagagctaatgtatgtttataaaaacattttcaatttggataaaagttgcctccatcctgtaaggcttctctttcagcgtggttcagtgcctacaatggtaaaggtcaacaatgcctcctaggagagggcaggcaacaagataagggctctctaaggacagagatagaaatggatctatcttataaactcaaccattagaacattctttatttcctgagaaaacaaatatcccaatctattgtttacttataaagctcttctcaaacagttcagagacaaaagattatcaccgagggaatatggcaggaaagttggagaacattttttttcatgcgttcacttcctacaatatttcagttataaataactacactaatatttccatataacatacacatagatttataaatattgttgtccagaatgtcttttcttagaatgttggattaaacagatgtatttaacatttaaacactccctctcatcgacttcaagagcccacagttaaattatgtaaatcaacaaatatttaatagatacctactctcttcacagctctaagcttggtagtgaaataggaagaagtatcagatctaatttctagtctttgacctatggggagtaccatagtctgactgaaagactatacataaacctctattttagtagtcccaaaagcagattagccaattgtgtaattcccagatgatgggactcataaaccaaattgactttttaaagaaaatactgaaataatacctatataattatttcatattttaaaattaatagatgatttatgtttcacttagtaaagaaaatatttttaaggaaacttaaatattgcaatttgctgataaggcttcctgaagccatgaaacagaattctagatggttttatgctgatagaagtatttcaacacaaaaatcaataaatgcacatggaaaaaaagttttttgacaaggtgaatatgctcattctttacctcttagtaaatatttaaaaatcatgagtacatatccccagagacaagcactgggtcagttaatcagtttaaaatgtaataaaatgcaagaaaaacaagaattcattggaggaataaaaatgctaaaatgtctgatgtaatccttaaagtgaatggcaaaaaccaaaaatttaatagattcactgagcaactgaaatgtgggtggggtccgggaggccagaggtggccatgtcagcaaagttgcatagaaactgatggggctggttggggtgggggtttgggggctggcctcctacagtcaggaagtgactggggagagaatgagacttaaacttgaccttgaaagaaaaggatctaaccagtatagaaaagggagctctagctctaagaatatctcatactcctagttctagaagtagtacccccagtggctgataagaaccagaaccaggatggcatgcacactgaccacatcaagccattaaaaactaggaagttatcggtatttaatgggatagtccagctctcctatatgattctttaaagtatttgagaaccaaaccccaaaggatgagtgtctcatgctgtgtttaaatttatggtcaaatgaatcctcttaggaacccaaaaggtgaatgattaaataatgaagatcttcctccaaaaacctctagacatttaggcaaatatttatctttaaaatgaggatcatacatggattcaaaacatctatctagaatatgaaaatgttgtcatgcagatgtcaagtgactttcaaaatgactgtcaaaataataagaatccagatctccaagatgaagacattaaaggtgttaagggaaaacaaattggaaagaagaaattctaaaattcatgggcttggagatgtgagttaaactaagtaaaaacagtttccttcctgcaggactcccaagagctaacaaacccgatgcctccccaagaagacatgggatggagtttccaaaaatgatattatatccatggcaacttaatttcatggaacccctcatgggactgatgttctacaaaaagtactttggcacatcgtcgggaccatgaagccccatgtatttgtccaacatatgttcataaaccaaaaacagcatagactctctagagaccataactactgggaacataaacattaagtgttctgaagtactctcagttgggcatataaaattggtaaggatttcctgaatgccgtctataagaaagtgaaaacagtttcagaaatagaccagtcttcccactaatttatacatacaaaggggcattttttaatcccaatatcctgcttcagacagaaattgtacagaagcacagttcaatagaatggaagggcatcgtggagaagcttgcaataggccctcccttctttggagttatgtgagttgacgttgtgcctttgcctcttctcccacagaagggctccagtaccatgaaagctgacacagcagggtcctcccttttccccaggtcaatacaagcctctaaatctgtactaactcttccctttacctgtagtactttcctttatctcctctgcctagctaaatcctggccctgcttggttacttaactgtttccaatatagtatgcatgtctgtctttccaaaaattattttaaggccctcatgacaagagccatacactcctctcatgattctatcatcatgcctagcttagtgccaaggctttattaaatatatgctgtagttgttatatctaattgacatgatataacatgagattgagctttatcacttatatttgatcaaacttctactaagacagagaacctgagaaattaggctcagctctgaggccccagttcttttttttaatggtttacttttcaaatatcaatgcagcctctctttgattttctaagatgctgctttctgaagagctggagaagcagcagaaggaaggaaaagaaagaaaactggaaatctagtagatactttgggtaaagtttggatatgtattactggaagttctagagttgtgctgtccaagatgatagccacatgtggatattagctggtccaaactgagatgtggtataatatatgcattggatttcaacgacttagaatggaaaagagaatacaatatatctcatagataatttttaatactgagtatctattgacataaaactttcagatatattgggttaaataaaatatattattaaaattaatttcacctgtttccttttactttttcatgtggctacaagaaaagttaaaattatatatgtggctcacattatatttctattgttcagtactgttctactgtttgaacatctaagatcgaaaagtggttcaaatattaaatgtggggctaacgacatataaaaattagttttatctttttaataagttcataagagctaaaaaaaaatgaagttaaaaaaactgtttttgaagatgaaaccatgacactaaatttaacagttgtactaaatgattagctttgataacacaagagaatgttagaatcaaaatttcaattgaaccaccaagggaacagatgccacattctaagtcaagtgtgatattttgatgcataatttgcaaagtgggtgatgatgacctcttaaacctttatgcatatcaagagtattcaaatgtccaaagtagcaagtgatgggaagcgggttactctggagagagctgggctgttactagcccttcctgggaaactggtgaagggccacattatgatgccaagtcatgagagaggcttcagggagactcctcagattgcatgatacctatccccagaagtctggaggacactgtggactagggactgtcaaatgcctggaaactgtctggccagatgcttggacaatggttccaatgagcatttgctaacgtgtcaatagtttgcactccagcaatttatcgtggcagaaaaaatgcatgaatgttttctgccaacaagctaggggccgccaaaaagaaagctgatgtggactgagcctagctcctttcccagatggctccttggagcagcaaagagaactcaagaggctggaagtaccactggatgcccagcgactgaggaagaaaatgtcagcaacagtcagaacacagatgcctctgcccccattaaaggaactataggggagaaagtccaaaacagaccagatgatttcatctaccagcaggagaagaagtagcctacaaagtgggccgagagggacagtgagtgggagacaaaaatcaagcttctttctggttgcatcccatccccactgcttgttcataccacatatgtgcagcctgcgagacagaggagcatgtgtgccctcagtgtatacagttacccagccacaaaaaaacgagtgtgtgtgtcaaaagatgcaattcctggaactattctaggaaaatctagtttattcagtgatccaccagctgccacaaatgttgcaataccactgtagacgcacagtaacatttagggcattgtgcccctgctatctacacattgttactttcttttttttttttttttttttttgagatggcgtctcgctctgtcgcccaggctggagtgcagtggcgtgatctcggctcactgcaagctccacctcctgggttcacgccattctcccgcttcagcctcccgagtaactgggactataggtgcccaccaccacgcccggctaattttgtttttctatttgtagtagagacagggtttcacagtagagccaggatggtctcgatctcctgacctcgtgattcgcctgccccggcctcccaaagtgctgggattacaggcgtgagccaccacgccctgccacattgttactttccattgaaactaaataccaaaagagaggttcatagaggccttcagtgtagtttagtaatgacagtttactgccttttgcttttggaaagaagaaaatatacatagttcacagagctctgccttccaaaggcacatggagaatgggagttagcctgtggcattaccttgggaactttagtgatagccacctacaatttaaaattatgtaaaattcgtgtcagaaatgcagctctgtaaaacttacttctacatagagaaaaaataataatgaatctgtattttattaataccttcctgaaaaacaccaggagaaaaaaagcacaggaaaatcagctcctgattccatgaagctctctaaacaggtcttgagataaggtaaagtttttactttctttttcgaagcaggtgtttccaaaatggactatctgattattatatatttggataattacatgttagtcctttccattcactagacacagtatagatgctgcctttttggatttatataatatgtgtttatcaactgcttaatgtagtatttttgaaagtcattcaataaaatcattagaaagatatctgtgcaaaatcatttttacatcatcagagaaacaaggtgtgaggacaagtttctcaaacgtcaactgcacatataagaaggaggtggaattacaatcaacctagctgttgtttgttctattctgtttcattgttgtgctaacaaatacaaaaaccttttcagcttcattaagactgtaatttcctaggaagcaagtacctgcatgaagagctagttcactttcaactgttctgcttctctaatgaactaaggattatttcaatcctctcatttttattctactccactttggccccaattgttccttttccttaaggctatcagttcaacaatgctttcccctatactttatctactgatagccagcataacagccaacagactttcttaagttggcagaaatccaagtattgtcttcacagtttagacttgggtaggaatttaacacagaacaaatgcaccaggatttagaagagtccacgtgcatgctaatattctgaggatacatgatgagcagcttcagatggagaaatgagagaaaacttcttgctatttgcatttatgcttccaaaaggcttcatcctctggctcacataaagtttgacattaaaacattaaaccaattccatgtgctttatgaaccacatgagaaaattatttttagtattttttaaatctaagtctgcttttgatcccaaacagctaaaatgtgtgattacccactgtagtcactagaattaacagtaaattactgtaggctgtttctgaaaactcaaatgcctcctcaaaagggaaaaaaaaaaatcacacactgatttgaatgtattgctgattctgtaaaggcacctccaaaaaagagttccaaacacattttgagctgttgtaatattacaagaaaatgatataactttccatgataactgcactaaatgacaatattcattccatatgtctacttccaggcatgttagttcagtcctttggagcacatttatatgtcctgtaaacacacaggaatctctctctttccaagagcagattcgtacgttgaaatcaatcaaatagaggaatattccaaaaccctacatttgaaacatccaagaatatgcaagaatcctttcttttgccttttcatcttgacttccattctaagattcatagttctaggtttcttcttaccgttcctcagaaaagtctttagagttatgagtggcccctttccagtgaggtcttcagagttacgagtggcccctttccagtgaggtctttagagttatgagtggcccctttccagtgaggtctttagagttacgagtggcccctttccagtgaagtccaagtactacacagtggctatgtgcacaggcttaggagccagaatgtctaggttcaggcctctattttaccacttataagctgtcccttcttggacaaggcacttgatctctctttgcctctgcttattcctccataagatgggacttattacaggacttttctcataaggttgttgcaaatcatcaaagtgaagtgcttagcacaccccctggcacactgcaagtactcagtacatgtcagctgttcttacgtccaatggccgctttatgattctcattctcagaccttcgatgagtctaacaattgccaagttatttcttgaactcctttttgtttgtttggttcaatgctctcctggttctcttgctgtatctctttgtttctcttcttccctaagcctattcatcatcacaccccacccccatctccaagttcaggtctatctccatcattcttttctcttttgacatgaccctgaaaagtctcatccactcatatgattcactgtgtttaatacaaaggcatttaacaagattttaaatgtgcattctgaggcaagatggcaagagaaagggattccacacagtttttttgttagcagtaactatggcaatatacgactagcttgtattgtcattgccaaaacaggcactgacctcacttcaataatctgataacaaatgctaacatactgtaccactgagctaagaagtgattaagttctactagttgctcaaggcccaagcaaagagaaggcaaagggtcggagtaggaggcaacaagaaaaccacaaatgtgaacttaccaaaaaaaagtgacaggaagaaaaattaaagaaacttgtggttaaaaaaaataaagacacaatctttgacagagaaagcagcaggaggtggcaaacttgaatgctcacaagggctaatacctaagctaaatgaatgaacttgagcaagatgtgacaataggtagtggtggggactatgacaaactagaagatgtatttaaaggtattcctattcagcttttaaaaagtagacatcacaggccaaataagccacaggtctctattttttatcctctgggtgtagagaaacaatggtagtggcaatggtaaaatatatcattgctacctgcccactggggatgaggctggccagccaagaatgtttttaaacaaacttatcttaatgacaaaaagctgcaagtaagactaattgctttataatcttattacactgttatatgactattatgattcataattcaagcatgagatctgctgcttctctccatcacaaaaccaaaatactatgttcatggatgattaagattgacttattggcttaatgtgatacaaatcctgccagtatgacccccaaaggcgtatttcacactcatagtgggtctctgaggtagttattaatgtataaaagttccaaggtctcccagggacatagatctttatcctgagaagtacttgtaactgacattctaaatgttcccttacatgtgtattatatcatgataagaggtttttgcttttgtttttattgccacttagttttgatcaaaacattcctcctttttgcatccctgttaactgaaaaatgacagtcttgtggacctgaaagatcattcttctgaaagatgggaccaaattcaattagatatcaacattgtaatcagctctgtttagcatgaaaccaatgaaatcaatatccaggactgttggcaaacagcaattatttccaggagatacttgttcatatccgatcattatatctccagattttttgatgctattaaatgaatccagttcatcatctatgggtcgtgtactgtgcatcacacagtaaggctagaattaagaagatgaagaaactatagttgctcctgaaaacttatgctctagtgagggagattggaaacttgctgttttgatgcaatgcagtaaatgctataaaaagagatgtggagagagtactaagggaaaatgtagatgaagggagaaaggaaagtagtaaaggcctcccggatctgcactttaaaaaataaacatcacatcccagttaaaacagaatacaaccaacctaggtacttatccagtaataagcaccacaataagtataccaacccaccatcggaagtcaccctgaatacttccccacacttcaggatggatctgtcctgactcggtatcagatttttattcatcactcttgaaatcacgaacatacatctaagtaagagaatctactgcctctaattcttcaaagaggtaagcaggtgactttcataagagcagcaaacagtgaagactctacaaatggaaatagaattctggaatcaaaaagactcctctctcccatgtggtgtgggaaatgacacccatgtttttcttctcccattgaaggtctgggactgtacccgtgggtaaaacaggcagtgggtagatggcactacccttctgctactaacgggcaagcctgccttctgctctccagtctccactaccacaaatgcctgaaaatctgccacttggggatgaatttgattttgaaaatcaccactgggaaaattctatggagtcaacagatatttacaccttagtgcagatttcaggatagccctttttcctgaaggggagcagttgaagacacccccaaacttggagaaacctctgagtaacatgccagttttgattagtagcttagtaatttaacccattcaggacatttcttaatcttggacaaagatcaaatctttgaagaaatcactgtggaatggttcaatatcatgccctttattttagactgtgttatcatcaatatcaactatgagcatcaatagtctttgcagcaaatctttaaccactttgttaaaatggttacaggtaaaatgttacaggtaaaatgccctgtaacttcatcttattagtgatttttctaaaacaaattatgcccagcattatcatctgagaaattattttcacacaccactcctcaagctacacattaacaattttaatctcctacaacttccctgattaagtaataaggccacagaatgatattgcctagaagaaatagtttttagtactctggaccattataattattagcgaataaaaacacatctgtgcaagttgtaaagagaagcagtttaaggagggactcctaaaggatatcaacatgcaatgtaaaggtctattatgcattacacatcaataccatgcagtggtcccattaatagagatacaatgtaatttacctagtaatcaaagtaatcgacctggaatttcttgctcaaataggtattactgcattattagcaaataactgaatttagataaattataaacacagacagaaaataatttctcacaaaccactctctgctctttgttttcctctattacatgttttaaatgacatattcaacatctgctactgaatctttactttccatcttagaataagatgtctatacaactttggctaaaagtgattactgcagtttaaaagttcatgcaaattttcaattacagttttgtgtaacataaaacttctaaactttcattataaaactagggatgatgagaaaaaaatctataaatgtagagacaagattattagtaagaccaaagttcagggaaaaaaacttaagaatattgcatatccacacatatctcaatatcatacttgtatttttaggtaggcaaatcaggtagaatgtttcttttaattaagagcagcagtaaacattagacttgaagagacaaaacacacattcaaattaaaggtttcttatgtatgtggccttggggacatccctggacctctttgtgccttcatcttctcatatgcaaaattaaggataattctacacactctagcaggctgcgatgagtactgaataaaccatctacacaaagtagcttctcagcagacactcaatatatctatggtgagtgttgaatgctgagcttgtacacctctacagcccccaacaggtccaacagatctttaggtgtgcttttcatactgaaattctccctttccatacatatgttttgttcaagaccacttaattcactggcataataaagagcttaatccttacccttacagaagaaagttctcccctttttatcctgatgccaactggtaattatgtatacactcataactgagtaccaccaaattagcaaataactgaatttaggtaaacttggactgacaaacattgccgaatatcatgcatagattcagggccgctgtcttgtcatcctagggaccttcccaatgacaaatgagaaatcccctcaaagctcagcaacattcaggaagtagccatgcagacccaatgtctgtgcaaattagtaacagctttaggtaccagcatgtctttacgtaaatgattttaaaaaccattacctctttcacactggggtccagtaaatccgtaagtgcatgcacatcgatttggggccacacaccttcctccattgagacagccactttcacaaacagctgtaaaataaggagagagctgagacgctttacctgaaaataaatgctaatgaagtaacacttgtggtcctctggaaggacaacaataaaatgtctaaagtcaccctggtgtttgttttggacggtcactctacagttacacatactcagatattcctcagtccactcttaggtaaagctgcctggaatagatgagtttgtatctatgttaatgctgatggtctcattccgtgaagcatctgagcaatgctttcagtttaacctcgaaaacagtggtttctaagagatgtcactgaatgggaactgtgtgttagcaaagactcttttgcttatgatttacgtttaattgcaacagggctcccatgaggggaaatatcagcccctctgatgtcaccattacagaaatgtagcaagttcaattgcacaattaactgcaaacaacaaaatactactaatgatcttcagtaatttaagtaccataatgaaaatccaattgagagttataacagaacttacggaaactattggtgcagtaaatctagagatgcttcagggcaggatattttgcttgttagaaatgacattaaaataagaattgaaagttcatgtgctgaacaactcctctttgtacaagttcctgtaactcgtgcatgcatgggctctttctaggcatcttcgtcatgcgtggcaggctcttctctgccaaatatgtcagttccacccactcttcaaagcccagctgaaatcttactgctccatgaggctcccccaaaacctccattcaaattccttgctccttatatattttctatacatttttccatacattaccctatagcagccatgaagttgagccactcatactttccctcaagagaatctcctgcaagtttagctggcagaccacttccagctgctgtaccttcagatctgctgcaatgttcatgtcaagggcaggctcacagccaatgactaaacacagcattaggatactaaagcctggctatttccacccatcatggaactctttgatgggcactttttgccctgggttctccatcaacctggctatggctttttggagctgcactacaggctgaagttccttctatgcaattgtccttccttccctccctccttgcacaggatcagacaggcatcatggtctgaagaccattccctcctacttctgcttcctctttcctttattcttcacgggtcttttccccaataaattctcttttatgtctaattctgtcttgatattttcttggcataagaggacctgaactgacacaaccctttttaaccaaaaattatggcaggaggccattactcatcatataaccagagaggtttatgtaaattaattgtcttctttgcctcttgatttatagtcagggagaatgaagagcttctaaacagaaaagaaattttgagcttgcctaagccaaccctcccagattacagatgaggaagctgaagtttaggaaaagttttctaattctgccagtgttaattaagcacttgtgtgttgggcattgggctaaactccctcagggagcaccaaggggagcagaagagatgcccagcagcccctcctgattctcctggaatgccttgggatccagccccatctcgccatctccacagccatagccttagttaggacttgtcttcctgctcctgttttgtcctcctccagttgcgcttccacactgtgatctttctcactgtaaaccttcgtaagtgaagggtaataaggttggtatttcacaagagtaaacacatgggctatggagtcagactgcttgggttccaaccccaactctgccgattaccatctatatacccttagaggaactactgaggtccctgtgttccagttccctcatctgccagagggtaacatttatgtcctctaatacaaagagttgttgtcatattaaatgagttaacacacatagagttctaaaatgtgcctagcacacagtaagcacagagtaactgaaaagatgtaggttattgatgttgttagtgttgtttattgttgtggtctcactcttctttcctagccctactttggaagaaaacatagtatgtataaaggcatcaaaacctggcccatgacatcctatctgaccttacttcctttcccctcactctcctctgcatttaagctctagcaacaccaaagcacttgctatgtcccacatcccttgctgtgtcttgtgctggtgctttggtcatgctctaccatctgcccaaaaaggtccattccccatcacctgacaggtaagctcctacccatccctcaagactcagcccaaggatcacccacactgcggaggctgcctctcctctctccaggctgggctacacaaaactcaaccaatattcttctcccactgcagtgtgtggatggtgatacagtttggctgtgtcaccacccaaatctcatcttgaattctcatatgttgtgggaggtgggaagtaattgaatcatgggggcaggtctctttcccatgctgttcccataacagtaagtctcacaagatctgatggttatcataagggggagttttcctgcacaagctctttctgcctgctgccatccatgtaagacgtgacttgttgctccctgccttccaccatgattatgaagcctccccagccatgtggaactgtaagtccaataaacctctttcttttataaattggccagtcttgggtatgtctttatcagcagcatgaaaacagactaacacagatggtcactagggcattctctacatttttgtttatttataataacattattaatcctaataaatatatacacaaaagcaaaaattagaaacgccctgaataacgcccaccattgaggattcattaaataaacagtcaaacatccaggtaatagagtactaggcaaccattaaaatgtattttaaaatgtgtaatgagcatactttgaataaagtattaagtgaaaaagtggtacaaaaactatatatacagtaagaactcatgtaccaaatatgcattacaagtctagaagatactatctggaatgatgaaatcacgaataattttactttttgtatttttaaacttttccaaattttctgtagggtatatatgctcatcttaaagtaacaaaaaaaaaaaacaaggtttttaaaaagaatgttcgtcttctgcaaagcacagggactggtagaaagtagatacaataaatggtgtgtgcaaatgaaccttcaaactgaacaccatgtgataagtacttcggtagcagaatctagattaggaaatgagagggatgcagataccaccaatcaagataaaggacatgtttagagagaatgatgaggctgagttttgaaatactttatttgagatgcttcctgaaaatccaagtgttgaagttcagcaagtgggtggaaggtatgtgtctggaatgaacaagaattctgctcctttggtggtgactagaaatcaaggagatcaggcaagcaaggtggtgaaggtaaatgagaggaaaatgaatcaaacaacctgtaaccaatcaaggttccaattggaaatttggtgttaagttttttgagtaagtgatttgttcatctgtaaaggtcactggacacttgtaaacatgctgtgtcccaggtaatcgaagaaaatccatcagcacttatctctttattctacttgtctacaaacaggttaacatctagaatacttataactacagtgtacttacgttgtccacagtgagtccctatgtatcctttctggcatagacagtgatcgtcactgcagctacctccattcatacagcgaatattgcagtgttgtacttgaaaaaaaagaagaagaattcacttttgcaacttaaatgcatagattgcaacagctcacaggagttgatttgtagttatttgaagagaaaatcaaatagcttatcaggattcatctatttttacctgataatgacctaattgagaatgctaaacatattatttgtgtgtgtaaaatcatttaccggctaggcgcagtggctcatgcctgtaatcccaacactttgggaggccaaggtaggcggatcacctgaggtcaggagtttgagaccagcctggccaacatggtggaaccccgtccctactaaaaatacaaaaattagccaggcgtaatggcgcatgcctgtaatcccagccactccggaggctgaggcaagagaatcgcttgaacctgggggggcagaggttgtagtgagcggagatcgcaccactgtactccagcctgagtgacagagcgagcgaaagaaagaaaaaaaaatcatttaccatgcaatgcaattgtttctctggcattcactttaatagtgctaaatgacttctttaatttaacagaaattacaactcaatgtcatttctgtaatttataccaacaagaaagtattgccttgagtaaccatatgagacaagattatgatggcaataattttcccgtgaaaagatttagaatcccaggtagatggcacaggggaacagttaagagtagcaaattccaaagaattttgttaaaagaaattttagaggcagaatagagaaaaaagaaaatacctacaaagacatttaataacaacactgcctgacgacagggacagctggatttgcctgagaaagagctgcttgtttaaactgtaacctcaaactaaataagatcctcattttcacctacagaagtgttcatttcggggcccagggtagaaagaccatgggctgacagccttagaccccagacaatgagacactcagagaagctggagtaaaagacagccacgggctcatagtgagcaatgacaacagcgcaggcaagtgctctcatttctccagtgttcaggctatctctaggtcagtaatttaggaatgctaatagcactttcaaaatcctaggctatttcctagtccaaagcttgattgaattaaccactaatccttgttgatacctgcctacacatggaggccaggattgggctttggaggtttggcttattctgtctggtcctccaagttgtggaagtaaattctcagagaagaaggttcgataattttagctaaggagaagagaatatcttctttctacacaaaagcagaaatctgctgtttatgctcactcttcctgaagcacaggggccaaatcttctcttcagagcaaatagaagattcctcccaacagccaccctgtccattaccccttgttaggaatcctcagccacggtattgaaaagtggctacttgacttcaggagaaagggacaatttttataaggagctacacaaatctcagcctgccaacagggaaggaaagtgcagaacccactatcttctatacccttccttttacagcacaaagaagttaggttgagttgaaagttaaatgccttttcaacaacatgccacacactgaaacaccatcaaaggcctgtttctactgaactagagccacctccatctctccacattcacggtcccctcagcatggccccaggtatctttcgaggctccttggcacatgcccactatgtcctatgactccatcccctgatctacttatcagtcattcattcactcaatgaacatttctgagtgcctactatgtgccatgcaaaacacccggcactttccttgtcctagtccctctgtagaaccctctctcttacctgcctctttgtctccttgcccctaactcctaaaccccaacacaacacacacacagttctcccccaaacctgaaatcctatctatctccaaaacccatttcaaatattgcttccttccgctaatcttttctgatatctcccaaaccaaatgtgagccctctctcctttccaattacttcatatttctcttttgaagcatatattatataatccagcctatttttacttattttgccccatctcatttgtttaaaaacttcttcagagtggggagtgggagagcattaattatgcaatacctcttaagtgcctagagtagcaccttgctttatatgtaagtgctgtataaaactgtgctaaattaatttttatttacttaactcatgctgcctgatgatgacatcaaaagccatgcccaaagaccaaactgagacttagaagttgtccattgtgtccgaggcacttatacagccctactaagtaggttgctattaaaaatatttttatctttgtttccccatgtatgaatgcagaaataactcctttgttggagtaatgaaatcaagcaaccccggaaactgattgcagttattttaggctcttatgattccgttaaaacatctcagccaagatgcttttttaactaaaaatctgtctatacgtatacaaagaaaaaaaatgatttagtgaaaactttgaataatattctaagtaggtcatgaaaaggtgtatagttgctttaaatttgaagttaaacttagcttcatcctatcttagaaaaacagtgaggattgggaaaagcacaggaaatgatgtcatctgtcaagcagcataggaactcagccttcaaactgatttcaattaaagcagttcatgccaagagctaatttccattcccacatgagcaacaaagccatttaactactttgagataaaaaagctaacagtagtttagtgactttacattatttgttcaagttgaaaatcagaatgaattcttctttctggcaagaatggtaagtttacaattaaatgcaatataataaaaaatctccctgatatatattttttaccctgtctttcaggcaaaccttttccagcataaaatattctttctttaaaaaataaaagcactcattcagacttgtgaaacaagaagacatcaaggaaccatatgcatgaatccttgggggaagccaggaggaggcaggctcagcacaggtaataggctctgaatcacttgctttgccaccgtgttaaccatgggaaactgtattcgttgtgagtcttagatctttagtggggaataaagcattccgataaaggtgggagcagtcgctcaggatttctgtggggaagtgaaagaactagatacgtagtttcactgtacacgcaggaaatagtttacagagaatatataccgaaattggttttattttggattcagtcctgccattgatgcatattctaaatttatactgatttgaacaagaattctagatgtatcataattaggagaccaagttctacgtctcttaaaaaagccaactgaaacctaggggttcctcctacacccataatgatgctgtattctttactggatgcactaagtaccccaagtcagaagatattcctaaactcaatctgtgttaagattttactagaaattgaaaacactaggggaatcaaagtgcacagatccagccatatgcagtgaaccctgagtgtcctagggtcccagtgaggacctgcccttgaagacgagcagacagccgtaaagggtttcatgtaaggctcaataacccagagctaacagaaaatgttgccatctccccatatccataaaagatcccaaattaattttgtgttcatatcagatgtcagtcagtcatttcagtcattcaacagtgacttactgaacgtctttcatttggcagcattggccagaaagagcagaagaaattttctttagattacagcccagcacagattagttcttaaatgattcatcagaaaagaacaatgtgagcacgctatgggaatgagagagaggcagggctggcacctggatctcaatacctcaggtaatgattttctttgggatgcattaggtttggaatgattctaaagacctgccatcatcttggcaggcacaactggcaggaagaacactgggagcaatttgcacataagcatttgtatgacgaacatgtgattttaatttaggtactaggaaaagcacagacagacaaattaaacagctagactaacttctggactctacacctgagacaagagtccacagggacaatcagagtcactgcaggataaaaacaattttcatttagagggataacagcaatggcatttcccttaagtgaacagatgtctggggatgcctaaagacacacagcttggaagagaaacttcactaaaattctcaaacaaacaaataaacaaacaaaatctagccaagctggaaaagctgtagagaaggacaagttaaatgacagtagtgataaaggtgcttccataaagggtggagtagaaagcaaagagttcaaccatttctaaggacaagtctgagtagattccatgcatgcttctcctcccagtccatataaatcccacacttccctgaaaagctttttcaaggaggacttcttccagactggctaaagcaccaccttcccttcctctgaatgtccccacactttcaggatggttgcaccatactccctcaaacttgctaacacactggtctagaattgttctgctggccttcttacacccttagagctcagatttgcattgggagtacaaatgccccaaactcttgctcccagctgattaaagccccttcctaaaaccggtgtccgagaggttttgtctgcgactggtcctgctgacactctcattgaattgaagtaaattaaatgagaaaatgtgatcaaactataaggggtttgaaaagtgtaaagggccccaaattgatatacaggtttgatgcaattcctatcaaaatcctaaaaggttttgtaaatatagacaagattaatctacagtttttacagaaaagaactagaatagctaaaacaaaaaaaggataaagtggggaagatctgcctacccatctgggtggcagagcaagaccctgtctcaaagaataagtaaataaaaataaaactatgaaaccatcagaaaaaagttggagaaaatcttcagaatctaggagtagacaaagcattcctagacttgacaatgaaagcatgatccagtaaagggaaaactgataagttagacttactcaaatttgaaaacatttgctctatgaaagatcccattaaaaatattaaaaagcaagctacagagtgtgataaaatgcctgcaaataacatatctgataaacagctagtatttagagtatacaaagaattctcaaaactcaacaatgaaataacaaacaattcaattagcatctgggcaaaagaggccaggcacagtggctcatgcctgtaatcccaacactttgggagcccaaggcatgcagattgcttgagctcaggagttcaagaccagcctgggcagcatggcaaaaccctgtctctaccaaaaatacaaaaaacttagtggggcatggtggtgtgcccctgtagtcccagctactcaagaggctgaggtgggaggataacttgagcctgggagacggaggttgcagtgagctgagatcgcaccactgtactccaacctgggtgacagagtaagaccccgtctaaaaaaattattttaatgaaaaataagaatctggacaaaagatataaagagacctttcactgaaaaagatatacaggtggcaataagcacataaaaagatgtttgacatcactatccaatagggaaatgcaaattgaaaccacagtaagagatgactacacagcaatcagaatagctaaaataaaaaataaagacaacaccaaaagctggtaaggatgcagagaaactgggtcattcatacactgctggtgagaatgcaaaatggtacatacggcgactccaaaaacagtttgacagttcttaaaatgctaaacatgaaactatcatacaacttagaaattgcatttctgtgtatttatcccagagaacataagatttgtgttcacaccacaaacttgtacacaaatgttcatagcagcttagttcaaataataaagaaaaaaaaactgatgacaactcagatgcccttcaataggtgaatggccaaacaaacttgtggtacatccatagcatgtactactactcagcaataaaagataacaagctgttcatactgcaacaacctagatgactctccagagaattctgatgagtgaaaaaagccacttccaaaaggttacatattctgtgattccatttatataacatttgtgaaatgaaaaaattatagaaatgtagaacagattagtggttgtcagaattaaagagagaattatgtcgggaagaaaatgacaataaaagggtaacatcagcgctctttgtggtgatggaaatgttctgcatcttaactgtattgattttgtgatatcctggttctgctcttgtactatagtcttgcaagatgtcacaatggggaaaactaaataaagaatacccaggatatttctgatttcttacaactgccatggttggaatgttccttccaaaactcatgttgaaatttaattatcattgtgatggtattaagaggtggaacctttaagacgtgataaggtcatgagggctttgccctcataaatggatttatgccattatctcaggagtgggttggtcatctcgggagttcagccccattttctgtctgtctctcatacttgctccccatgtgatgccttccaccatgggatggccctctatagacattggtgccatgctctggacttcccagcctccagaaccacgagccaaataaacttttgttgtttataagttatccagtctgtggtatactgttatagcagcagaaaacagactaaggcaactgtttgtaaatctacaattatctcagaatatgaagtttaatttttagcattcttaaagtgtaaagagtaaaacagaatgagaagatttcaaaattacaaaatataaactgtaggaattacaaaatagaaaatacaaaattacaaaatataaactataggaaacaacttttatcatgtatcatatataattatatatataattagacaattatatatatacacatacatatacatatatatatatatatatattattgtctaaatgtttgtgtccccacaaaattcatatgttgaaacttagtccctaatgggagagtatggagcagtggggcctttggggaggtgattaagttatgcaggcagagccctcatgaaaggattagtatccttataaaaaaaaaaggcctgggagacctgtttgtcccttctgccatgtgaggacacacagaaagcaccatctaggaggagaaggccttcaccagacatgtaatctgctggcctcttgatcttggacttcccagcctctagaactgtaaaaaaatacatttttattgtttataaatgacccagtctacagtattttgttatagaagcccaaactgacaaatatatatgtaaagttatagagtttattaatcccagtgttacaagctaatatatatttgaatgtgtgtatacacatattagaacaatgagtaaattcatacatcagtaaaccatgataggtctttatgacaattaggattgctcaaaatccatctgtaccctcagagactgacatagcaaagaacagtcctaaagagggctggaattaaagtctagaaaaactactgttttgacgctgtctagccaatcattctttttgccctggtgctgaatgacgagtgtcgagagttccaccagcaccaagggaagccacaacttcctgttgtccaagagaatcactggctggtactttgaaccttctggaaatgcaatctctcattcaggtcactaagagatcattttctattctcagagtcacaggacactcaagtcaaaaaccacctgaaagaacaacacttcttccattctgttcatattcaagtgggaaaactaagcctctctgaggtcccacgacttgcctagacctccttgatccctatcatataaaaagtataaaatttttcagaggaaaaattcgttcagtgatctaaattgatcctttttagtagaaccacatgtagtgaatgcaaacatttcactgagtagaattgtccttctattagcaggaaagttagcaaagtgatcaggatgttctgtggaatggcacagctgttccctagaacatcactccaaaagatgagaaatgaattctgatcatccccagctatccttaatttaaaatattttgccatctttaattttgcaagccatttagacaatattagtgcagagagaatcaaagccaacaattttaaagatttcaagtaaccccaaagatcctgatgaaaccagaacctcctccttacactactctcatccacaagctacttggggactttgtctaacgtccaggtaccatagatatgactcagacttcctcagaaagcaccacccacagtcttggattttagtctctagactaaatctggccccaggaccttactactatactcgtcacaccccacagttaacttggattctaccaggaccatggcttttccctctggtcttgttaacatcctgtctccacatctcatgatttctactcgatagagaagtcattatcagttcacattatcattgaagaccttcccaacttaatacccagttttgccatctggctatatttcttcccccagaggagtgcaatgttgttagttggttcagggaccaatctgagagatggggtctattcccaactttataactgcacttcttttccaaccctgagatgcttatgcttcagcggcagcctggaagtcacccttatagagacggagatgtcccgcatgttcccagatgtgctgccagctggcttctctgcctcgttctattcctccagttcaggggctcttgctacgtagaatgaacctgctattactcggaagatgcatgtctgacaccaagctgagatcaaggaaaactatgctacacattcagtgcaataagcaagagtcccagcccatagggcaatttctatcccaattgtaactggctgtatttagtaaaaggtggctgttactgtgtgggctccaccagaagcagattctgagacaataatttaaatggaagtagtttgttctgaaagtaattctaggaaacactcataggagagtgggaaagtgagacaaaaagagaaggaagctaataaagtacattatcaaatctattatcactgtgaacagcgagggctcggtcccactggggaacttcaggagacagtgcagagtgaacctcatggttatccaaactgagaggcaaggaagctgaggcacttatccaaccactctccatctgttgttggttaaaagtctgcttccaggtccactaacccccagcacttccagcttgccctgcatgcagacctggcatgctctctggccagaaaagtatacaaagctctcaggaagagtcccccgtgttcatccatgaagccaagggaggcaagagggcaccaggagtgctacacaggacaatttgccctaacctgttaattggcttgtgagagacacactcaaatgttcagactcttaacaggtaatgagccttgacacagtgaagtctctacttgcagtaaacaaaagagaatgcacttattccacaatgtttttctttaaaactttgtcaaaataggacacacaataaggggggtgcattttcttacaggacaaaaagaaacggaaaagggacctacgttttttgccatggggacggtcaaagttttgaggggctgtttatacaaacaagaacttcagctttttaaacaaccaattatgactcacttgcccaaacccccaaaagaaaaacaacagaacaagcaagaaaaggttctgaagaatgaactgtggatattcatctggcatcacagaaagtggcaacattctgaaaggaaaaatatgtttatgcttcattataaatcacccccagaaacttccataatgacttcttacattttcttcttgtaaagcaggggtcttgagtcttaaataagtttttaatcagattcatatttcagtaccacaaggaagcatgcctagatttcttgagccaaaaatgtccattaaacaaccatttcattgagcaccttttatggtgtttacactggagatacaaagatgaataaggcgatacctacataaaaggccataagctttatactattcatagtaactatgccccataggtaattttcctataaagagtaaagaagggaaatgagaggccagatgaaggaaagcctttccaagtattttgggcagaacagagaaggcagatgttctagtgaaaaaatgtattgcaggaaagaggaaagccaaaatcaaatttaggagaaaatggggtataaccacataaaataatattatatataatgacatgttagacttactggatctggagccacaggaaggagctatctgaccagatgggcaagtgcacatatttggcctcgaacaaaatccatccccacaggaatgccggcaaatggctgtgaataaaccagaggtctgttagcacatggatttggaacacgatttgttataggggaccaatcctcaaatgaggaaacctgggttctcaggtccctcacaaactttgctatcatgacttatatgaccttaagcctcaggtgtactcattttcaaaacaagtctattgaactaaataaactctggctttaaaatccacaactcctttatccagtcacggtggttctcaacctctctttgcttagtccacagcactcaatccatcagaagcccaggacaggctatgaagagaaaaccaaacaaacaaattaaatcctgcatctaaacatatttatatgatcacaagaaatatattattatattaactctaagatttaatgatataaaaattacattattactcttgggagccaattttattgtaaatttattttgttttgctttgttttttgagatggagtctcgctctgtcacccaggctggagtgcagtggcgcaatctctgctcactgcaagctccgtctcccaggttcatgccattctcctgcctcagcctcccgagtagctgggactacaggcatgtgccaccatgcccagctaattttttgtatttttagtagagacagggtttcactgtgttagccaggacagtctcaatctcctgaccttgtgatccgcctgcctcggcctctcaaagtgctgggattacaggcgtaaaccaccgcgtccagcctattgtaaatgtttaatgtttaatttttatcctgttctgaattccatcaacagtctgagagaagaatgctggaatctactgctagagtactgattctacagtcaggaagccattcatcctttagagaaatactaacatttgcataccacccagagactaatatcatgctggtaccaaatgctctgctagtggtcacaacagtaagtttaaatggcatatgatttatatttatcggcagactagcacttggtcactacttttcgtcatgacaggcatgatcttttcctcaagctcctgcacaatcttgcaagtgcaaacatgatatgcaaggctaaaagagtacacttgatagaaagtgcattcaaacatccaaagagtttaggatggaaactggaaacgactaagaaacaaactgtcaaagatccagtaaacatttatttaaatatctggagacatcatttctcagagaactctacagaaggctaagaaagggttctattataaagttcattgagaaaaatccaaataccattatatttctcttttagtgatccaattttggtcttagaccataatgtgccaaataaaggagatgctttctggtcaaaatcaagaattgagaaacagttaaactttttcaggtcatgaagcaaatattggccaatatagtctattgaatactccattgaccactgtcagccaagtgagaaggtgaactaagtgattcttaatgtcccttcagctctaaatttccccattatactactggagttttctgaaaactggacattatttcataggtacaacaactgtaaaagctcatgaagggcaggcatcatgactaaatttgactttggtgtctccattaaagaacaccttgtctggcatgcgatttgtcactcaacatttgtgggatattggggaaatctggaagtttgccttgccagcagaaatcaatagaggaacctctgttatcatttgagatctttcttagtctttccactgatcttcgtctggtgatctatctccttcctttcccctctgtctaagagtcaggtctgctcttggtccctcaatcacccaaattcaatgtacagggtttggtaaggcccgtgagtggccaacaaagttagaaattacaataagaaaagcagcaataataccctttcattcaaactcccatcaaagtaattagatagtctgtgtagccaggcacaacatatgtaaatgacacaacctcaagcaaagtatccccgtgactaaactttgacagggtttgaccaagttgatgtatttcccaaactggaaaggtagaaaagtcttaaagctggaaggctgtactatcaacagattaatagtacagttacaaaaggccacattctaaggctccccatgcaaccaacacaacaaaagaaggacatgcagaatgacaagttttctatttacttacggacaatacactgatttccgccaggtaaggttttccatccagggcaacagtaagcattataacgtgatccacagacattgggtctaaaacaaaaacagaagaattccatactttaaaaaaaagaagaagaggaagagatggccaaataaaaggaaaaaaaattcctgagttataaaagcaagatgaatcctggcagacagataaagcaaactcatgagactcaatgctgggttggtagcttgggacactaacatagtgatatcaacagggacatcccttaatatcacctatgcatatggcccatcagggaaataaaaaccagagatacaaaatgtagcacattctgtcacaattcatgaagccatacaagtcttaaattagacaataaacttaaacaataaatttcttaccaatatggttaagaaagtttgtaataaaatctaatgcacataagacttcacatttctacactttgaagccatatatatatatatattttcctacggcccatctcacctctataattttacatattctccctttcactaaaattacaggaacgcaaactctgacatgagtcagaaaaaaataaaggccaaaacatgtaaatatttctttagcaaaagtttggaaacaggccaggcgcggtggctcacgcctgtaatcccagcactttgggaagccgaggtgggcaggtcacttgaggtaatgaattcaagaccagcctggccaacatggtgaaaccccatctctaccaaaaatacaaaaattagcttggcatggtggcacgcacctgtagtcccagctacttggggggctgaggcacgagaatcgcttgaatctgggaggcagaggctgcagtgagctgacatcgcaccactgcactccagcctgggcgacagagtgagactctgtctccaaaaacaaaaagtttggaaacacacttgataacagcagttacaagaaaataaaatcagtgtcactctgggtttcttgtttacagacagttcatcacatgtcttggagtagaaactccattcagaatccagatgatccacatttaacaatttcagggagcaactaagtaaggatccaatgacttctacactggaaactaggacagagactataatacacagagacctagaagcaaccattagttttactttgccgtatcctgagggcctaagcattgatgctagctgctagcgatcaggggctaataaggaaggtcaaatgttttgcaatcaatttcacaaactaggagcaattccaaagcttactggtataaacactgtaaacccaaaagcataaacctttaaaaacaactgtatagctaaaatgtattttcagttagggtgcactcccacattctctttgtatatgtagaccacgtgaaacagtacagagtcctcccacatttcctctgaactcactacttcaacatcatgcaggtttgggaaccaacataaggtctttgctatgtcctttaccccttttgttgctccagaaaatctggaacaccctgcagggcaccacacatgcttcacactgacagatgctgaggtcagaaagggatttaggaagaaagctggaggagccaaggaaagggccctaactccatacccagcagcccaggccttctctaaggatagagaggaaatgattggatagaggtgaaatatgtgcatgatgttagagcctgtgtgagctcagtatatttctgtgtacaatggcacaatgaaatgtctcccttgtgtgtatatatgtcaaataatggacatgaaagcttcatatatgaaaaagatgatgaaaatgcaatgcagcattatcatcctgatggaatcatcttctgacccaggttactcagccagtggaaacacaaggaataaaggaagaaagatgttatggagaattttaagtcaaaggctctcaaccctttgtccctccatgacaaagtaatgcctgaaacttcagagtgtccagaagttcctggggaaattcaaattctcggaaaggaaaatgagagaggaagtgagggtagacagctggggtagaggggaacgcacaaaccttccaaacttttattataaaagttctctcaatttgaaatgacaatccaggccaaagtcaaccacctcaaaccttctccagcaacagcccattagaacagctccgctggagatagtccaatccctaccaaatcctggaatagtgtcagagcactcctgagcctttgcagggtgccctgtggttgacataacaaggttttattttttttttttactacaatcatacattgtctgacataatatgtcacagtcatagtgtctgacaaaaatatgtatgtcataacacatacacaagatgaagaagctcagaaacaaaggatccagaataacaatttcagtcctacaaagcaaaatattctaaagattttccaaggaatttgaaaaagcatggtaatataaacattctttttttaatgtttagaatcaatctacagccaaaacatggaagattttacaatttactatagttacaaaagaaaatgtaaatgttgtaaaccttcacaagagtaaaagtaatgggacagatgacataactcgggaaacaatttgggaggaaaggtgtggcagtcaataaagcagctgatcctagaaacagagtcttatatatattacactgtgttttaaaataaccaatacataaaagttatactaaaactatattttaaagttgtgaagaagaagagagaaagagggtacagatactttagtgagctaagtccccatctttcaaagcaagaaaccagtgggtactgtttaaatctagatacagaggtacaaacatggtagatggtgttacatgagaagaacaaaaaacagaaatgtttcaacctagttaccttaagagatgagaacccggggaagcagagagagagttctcttgctttcttatctaatattcatccacaactgttcattttaaaatatacgctcttctatttccatcgtctttcacttaaagcaataactagactttcgaagtatgaacgtcttatctttgaaacagaatacttcttgttttattcattcaccattccctttcattagtgcatcacattttcatttcactgtatttcttaaggttctttataattttgggttggacttattttatttgcatcctctgactttctatgagttttaaaactttatcattaacaagtaacatgttatttaatttcagctgtttcaaccaataccttcaaatgacaatgattgttttaattgtgttgccattcattcttaaatcattctaaatgctatgtggtatggctcaacgcaaagtatttgaaacatgtaagatttctcctctgctgcttttggtcttgagaaactgcaaactattagaactcgttcaaacaagctgcatgacatttgttttacttatacacagaaaaaaaacagctctaattctggaaataaatgaatgtcttattgaagctggaaagaaccaaaatatgtaaactctaaatgagacatgctggattatttccataataaaagatttagttataaggtttcaatacaaaatgcttgtacaaggaaggtaaatctttaataaagttactctttcgggtcaatgaaagtatagcatccatacctctttctcttttcacttcatgagccatccccatcaacccccatcactccaacacacacacacaaagtcggatttaaagctctgtgcaagtagcaataacattcaacaaattttaaaaaattaaaattcaaaggggaaataactttttgctaagtgctaaagatatattattttatttcatcctaataacaactctttgaggtaatttttattgttataatgtttaacactaaaaaaaaaactatggcttaagaaggtcaaacaacctggccaaggtcacatagcttagacgtgtctaatggagatttgaactcaagaagcctcctgattctagagtacgctctcctaaccttatgttaagtcaaaagtgtacttagaggacaagatgatatttcatccagtagtattcatggtgacataagtaacacaaatcacagaatgtccatcaatagaccaaggataaagcacagcataaactgttttgggggtttttttttgcttttttgttttttttgagatggagtctcgctctgtcgcccaggctggagtgcaacagtgcgatctcggctcacctcaacctccgcctcccgggttcgatagatttttctgcctcagcctcctgagtagctggggctacaggcacacaccactacacccagctaatttttgtatttttagtagagacggggtttcaccatattggccaggctggtctcgaactcctgacctcgtgatccgcccgcctctgcctcccaaagtgctgggattaaaggtgtgagccaccgtgcccagccagcataaactgtttttacctgtattccaatagtttataggggaaagagggaaaatacatttatattccacttcaccactgtatgttacatttttttaaaatagctaagtctttatctgtaacttctcttaccagttactttcaatattgtgctctgtaagaacccaactccaaacaccctgggggatgagtgagtctcagcaggtttgatacttggattcagttaaacatagccctcagagagcctgtggactggcaaaagcctctctcaacggagcaaacagctggcctctaccacgtctgaccacatcattgcaagacttggcctctgtgcaagatgtctgcagtgtgtccacattccttagccaaagcccacttctgcaatttggcctcttacagcaagatagcctttctgtttcctatgcaaagtgcaaactccttttcagaaaaggttaaggtaataaaaacaaggtcaggaggctcttatttcatatatgttagtttctcaacatatttgttagtgattaaactcttgggcaaggagaacaagtactaggtaagggctaatgagactgaccctgctccattaactgcttttttttttaacctttaaggaaaaaaactatgatttagccccttaagtataaatctggaggggatcaaaaggtacatgccctcacacaacaaaggacacccaacttcccatgtaatgtgtcccatgttaatatcttaacatcctactgttccaaggttaaaataacttccactataaaaaatgtgatagatcatgaaacaattacaatacataaatgagctgcctgtattgtgaactacacatcatgattttatttgctctttgacaattttcttatcaagataaaaaaagaaaaaacatcatgagtactgtctgatgaaggggcccatactattctaacgaacctttcaaatattccccctctttattttagtgcctttattctggccctcttcactgaagtcagaggtcaagtctcccagtagtgatgtgaatacctcatgtgactgttacagtccatctgccagtcacaatgcaacctgggtaacaaaacttcaaaccctggtaatgagaacagcttccatgacctccctaagcttcagcttgactctctagactggggtccccaacccctgggccacagaccagtaacggtccatgtcctgttaggaactgggccacacagcagggggtaagtggcaggcaagcaagtgaagcttcctctgtatttacagctgctcccatcactctcattaccacctgaactccacctcctgtcagatcagggacagcattagattctcatagaagcacaaacctgattgtgaactgcgtgtgggagggatctaggttgcccactccttatgagaatctaatgactgatgatctgtcactgtctcctatcaccaccagatgggatcctctagtcgcaggaaaacaagctcaaggctcccactgattctacattacggtgagttgtataattatctcataatatattacaatgtaataataatagaaataaagtgcacaataaatgtaatgagcttgaatcatcctgaaaccatccccccatcccccagcacccttggtccgtggaaaagttatgttccacgaaaccagtccctgataccgaaaaggttggagaccactgctgtagacccaaagactcttttctggattgtctgagttgacactgcttgggacacgggcaattctggcttcctcctttgaggatgcaagccagccaaccactctaacttactttgtgcagtttgggatttttttttattttttagatgaaagtaatctgaaaaggaacagaatgaataatagatttattctggttttcaagagctttatccccttcttgccttctccatcaccagtagattggtgactctattacgttttcctcccaagccatggtccatctgtttctctctccctccttctctccctcccttcctcatctcccctttcctatctgcctttcttccactctgtctcttttcttctctcttcagttcctgttttcagggcatttagaattaaatgttttgttaccatctcaaactcaatttatccaagatcaatagctcctcttcctgtgtagccagtaagttcactgccaggtccacaaccggatacatcaggactattcaccttgcccacaagcacaaagctgttcaacaattttttttttttaccaacccaaaggttttttttaagtttcttgtttttttgtgactatggaaataaaatatgattaagaaacaaactgaaataatttgtacctcaaacaatcatgacacgagtttacctgtataacaaacctgcacatgtacccctgaacctaaaataaaagttaaaaaaaaaaaaacaggagaagaactaacatttattgaagtctggatactctacatgcttcgacctatatgaatgccaaatcaacatgttttaaaaattaaattaacctattgagatacatttggttgtgcgctgaagggctcatgagagggactcaagctgcccctttcctgagagccatggtcgggggactggaggagcatgtatgtacaaagggtagtgatgaaccccagacaacataaaaacattgctgagcaatcatttcaaataggaagcactatgggaattcttaggaagggagagtgagactatcatggctggaatgatccagctccagatattccttacagaagactgggaagagagatgaagagatgacgatgtatgtaatgttacacatcattgagggtttgggaaacaaagacaaaacaccatagttccatcagcctcacaataatcactatattaatcatatctattgagtgcttatcctatttcagtcacagcactcatttacctccccacaatacttctatgaaataagttattacttttatcattactgttgcattataattaatgtgaggaagctgggccatagagattaatccatctaaattcatatgttaataaactggggagccaaaattcaaatctagctccccatgttagcattttttgcacgagtctctgcttgttttgcatgagtgttattacaatcttcattttttgttactttttcacttatgttattgtataaatctaatgatcatttttgatagatacataatattttattgagtcatttgtaccatcagttactcaacattccattactgctggctgttcagcaatatttaatgagagcctattatgtgctaggcactgtgttagataagaaataaaactgaccaagaagagcacacctaatgcctagatcttggttgctaatactattattcaataaaaggaatcagggctcctgggagatgattctagggctgggcaggaaatagacaagctgaatctgtagcatcttgcagtgacagaaagtataaggaagtgctaaacaaacatccacactgaggggagcatggcaagggacacagaagccaaatgaaggaagtgtaaatggccaaagctagaacccttttggagcaacaaaataacaaaagcagcattggattacaataccaagtaaaaaataaatatccataagtccatactgataaataaatgattgaagaaataaatgggagagaaaagacaaatctcttgtgcttccgactttcaaataattttgtagatgctctgccttcaaaaagatgaagcataactccccactccttacatgtgagctacacatactgactgtcttccaaagagtacagtataaagggagggggaggaagtggaaaatcctgacaaatcctatctcagccaggcaatgaagggttacagcaacaatggaaaatcatgttgatactataaacccttaatattatgtgataaaaatggaactttacctctgtggtctttttcccaaaaacccataatttcaatgtaatcatgacaaaaacatcaaataattccactaagggccattctacaaaatatctgaccagcccttctaaaaactgtcaaggtcattaaaacaaggaaagtctgagaactgtgacagctaagtcaagtctaagaaaacatgactactaaatgcagtgtggtatcctagatgggattctgaacataaaaaggacattaagtaaaaactcagaacatttgaataaggaatagactttaatcactaactacatatcaatattggttcattggttgggcacgatggctcacgcctgtaatcccagtactttcggaggctgaggcaggcggatcacaaggtcaggagatcgagaccatcctgcctaacacagtgaaaccccgtctctactaaaaatacaaaaaaaaaaaaaaaattagccgggcgtggtggcgggcgcctgtagtcccagctactcgggaggctgaggcaggagaatggtgtgaacctgggaggcggagcttgcagtgagccgagattgtgccactgcacttcagcctgggtgacagagcgagactctgtctcaaaaaaaaaaaaaagaaaaaaattggttcattaattacaaaaaatataccacgctagtatgagatgctaacaacagagtaaagtgtccagagtatatggcaactctctcaatttttctgtgactctaaaaccgttctaaagtgaaaagtttattttaaggtaaaataataataatcctgtcccaatgcaattataaataaaacagctatatttaaaaagtgactaagacacacagtctttgctcttgaggatcttacagtctaggaacacaggcacatacacaaagattatctacacaacagacaaagcactaacatcaaggtctgcctggggaactcagggaggccagaacaaaggcctttagccacagcatgcatggtaagctcagaagaggactatctgagctatgacttgatgtttcccggttgctaaggggagtcactagttttatttcatcccactgatgaaattccccttaaattctccaactccattagcaaatcccttgtccaaatcctggtgatttcattgttggaccaatatcatgttcttttttcctggcttcctagtttctctctactccattaggacaatatgggtaagtatcttttcatattcaccgtgcttatttctattcccctacagcccaaagatggaccttcactctctataatgttaaacatctcattattaggttcagatatctaccaggtaggcctaatctacctgtcaactcttatctttacctataccttcaacttccaccctcctactcagctcctcttcttcaccgtctcagccctcactcatgcacgcactgctatctctgacacacactaaaaccagacacttcctccatttttatatcagctcttccatctttccatttcaatatgtagttccatctcccttagtgttccctgatgaatccatccatctttcacactacaaacacaattccagacatatcttcaaaaacctacataggctatactgtagttatatatttaaaacaattatatgtctagatctcatccctgaagcccaacccaccaccccctttactcccagagtaataaattgttcttcaggcacagaaacaatgtctattatgcctagactatcctggagtctatttagaagcacacaagataatattgactaaaggcaatagtgagtacgaagtacaattagcaaagattaatatcatctcctcagtgccaaaagtaagccagatggaatatgccaccgacattaaaatctgtgcgatagaattatttcttataaatttatctatttaaaagaagactatttaacacgtctttgaaaggctacataggcagttaaacagaaatgtatggtggttttgtgccttgattatttcactgacatgcctgtcattaacttattctgatcagtgaagttacccatgtttataactcagaaatcaatattttcctttgagaaaatacaaaatcaatgtagacaaataacacacatatgtaaacatttgattctatttatttctttggcaaaagaagaaaaaaaatcccacaagcaactaagtgaaggttttcagctcacaagttggcatgcattttattatggcagattgctgcaactgatcaaggccatagatggagccagcctcatgcggccaattcctacagacaatcatgacaaaattcatagagtgaccttgataggtctctttggatgtgctgcttggatgaaggcttttcccactgctgagtggagtaactcacagcacaagcagcacaaaggtgttgcatcaacagtttcattcactgtgtaccctcaacttttcatggagattttgtgttgatcaaaagcaatagcccaagaacttatggtccaaaaatgtcgtcccccttcaagggcatgtacacatgcaccctcctccccaacacacacattctctctctcacatacacacacacaaagacacaaacacacacacacacacacacacacacacgcacagcctaagaaaattaggaaatagaaagctgaaaaggcagttcctcggatctgggacatcatttttagactgacagccaatttaaatcctattggaatcttttataggtggagtgtatatatttaaaaaaaaagaatttgaagctcaaaaagccatgggatgcactctacaggaaactagacaattgaaccatgaagaccagaggcacagatgtttaaagtacatcatgtgtgcagcaagtcagcactcttcacttcatgcttctggaactctggattaagcagcactaagaacactaagtctgcttgtctgcttagaaaattacaccaccagaatggactcctcaaagttctgaaggcaatgatttgaataacttgctgtcctagtgtgtactggatcacttctccaagggagggcatctgtatctggcctactggcgtcacatgtctggttggttgggtaaaagttgctcccatacatgggaagaggtgaatttcttcatgaagtttcaactatttgaccatctaaggatgaggaagcattgcttccaaacagaaaatccagcttatctcaaatgtttgcttctggagcatctgagaggatatggccaatgacacgatgagaacatgttgcctgtgtaaagaactgcttcccagcactctgaaacccctggacttcaccagtgagctcagggtctatcaagagcttttctttgactgggatattcattccatttattcaagttgaagccacactgtacttttccaaagggtgaacgaaatcatagaaatgattgaaaacacaaaacaagtggtgaggggattctgagcctgcacagagagaggccggccagaggcggagccgggggtggagcttgtggaattcctttaccacccacagaaggaactggggactaaaaccatgattcttgccacttcccagaaattctcaaaccaagagctctgtccagggagataatatcttctgaatgtactggcagccccaggaagagacaggaaaatcagccaatggggtcagacttaggagaaagaaagaatgaggtctttcaggaacctagagtgcagggtgatttgatacttgagttccgaatgctgtcagcccccaattgacaaacaggtagagctccaaaatttcatttctatattagtatttagaacttggaatggcctgtccaatagaaacaatgttaataggtggtggtttggtctccagaccagtcaaatagcagtctctcagctgcattatcagctgaataggctattgtgggctggtctgggaacctgaccacaacttaaaatgttgtttctatgggaaaacacattccacggcaggcaaccagaggaaaacttggccactcaaacccaccatgtctcagcttagtaagctgcccagtgatctgtgagaaatgaacaccttaaactcaggcaactccacacagtcctgagagggcagccagagtcagagccgtcccagcccaggcttgacacccttctggaccccctgcatgagaccatcagggccaatacaggacatccacaggtccatgaatcagagacttaaaacctggagagttctcatcctcgatgcacctgatttattttaaaggccagaagatcccgccccattagcaactataacataaaatcagtatcctggactggctcacagatagacttcagtgagctatttctagcacgagtggcttacacgtgaagcaaggaagcaagtccgttttgaatcctatttggtgactttagtctcataccaaaattattcaagaatttcacctctcctaaaactggaaattaccagcgttttttttgtgtgtgtatgcaagttccttaaatatagcaagttcagatttatctttacaatcccagcacctaacacaatacttgaatcttaagtggtaaatgagagtttagagtttcatttaccactaagacaacataagttaatgagaagtctatcagagtagtgagtatttaatttatttaaaaaggtggatatgtttataagaaacttttaaaaaaagatccagcctgggcaacatagcgagaatctatatcttcaaaaaaatttttaaattagccaagatggtggcatgcacctgtagcttcccagctacttggaaggctgagtgggaggatcacttgagcccaggaggttgaggctagagtgagccgcaatcacgccactgcactccagcctgggtgacagagcaagaccctgtctcaaaaaaaaaaaaaaaatgaaaagtataattactagtaagaaatcagtatcatttcatctacttttttaaattttagaaaattaaaaggaaaaaatctaacacataacaacaattacccataagtggaatacatggagtacgagagtgaaattcttccatgtttcagttgcatcatttagaaacatttatagctacaaaagcttcagagatcttgtagctcaaaccatatttcatagcagtcaacaggccatggatctttaaaacatttctctatctagccctcccatcaaaacagggacaatattgttgctcaggaacaaaaataaataaataaatcactaacagattttaagtttctataaagtcagaggaagttaggtaaaagcatgcagtttgctgagattatttcattgaaattaacacttcacaatattagcagtcaaaaacttaagttttttttttaattttgaaattgaaacaaagttgtaagcatttattttttaaacatttagatatgtggaaaacttttaataaaaatagtctaatttaaatttaagggaatttaaccaaatcagtactttagtccacatgaagtcattcagtggaataaaaataataattagcaactattagagagctttaatttataaaatttactcttcccccaaaccctatcaagaaaatgtattggtgtgctcattctcagatgaggaaactgaaaatgtgagaagtgaagtaatttttcaaaggctacacaatggaaacgtcataaatccctaattaaaaaccaaaagactttattaataacattccaaggttagtgttaaagatttttagattagagattagaaagatgtttccataaatactccaaagagaatgtattctcttttttgtataaactaatttgtacatcattttttgtgctctgatttttttactaggtttgcaaaataaataaataagacagtgttttggaagtgtattagcaaaggaaaacaatgtaaagagaacacattttaggaacattcactcctatagattggcacttctgtttctgaaatagtttctgcatttcccaacagagaatgagtattctgtcctgcaccctccggtaaaaacattagtcagctcttaacatgctcaacgtttgagggagtggatgtgtagagagcacaagaaagattcaacatgtggataattcaaaacctactcagagctggcattggaatgtgttagtacacacacttcaacatgggtgtggcttgtcttttgaaaagtagctcaaagcaaaaccatcaggacacgcaggcaactgtctgacccggcttaggaagacaatgagctgctcgaaggcctgggtgatccagatgatcttctaaaaaaaaccctccaatttcacgtctctgtgacttaattcagaggctgctgggatattgtccattacacagagaaagtggtgactgtcctcattccaatggccagcacagctcttccctgaaatccaacccgaaagatttccctctcagtgtgagtgatgccagcactgtcctctcagcacccttccagctccagggaagatgtcacagtatttgtgtttcaagctataattaagcagagcaggtgctaaatgccagcacaaagtttcaacatgacaacttctgaagtggtgatgatgatgtcaaaacagacagaaatacatccacctcgcatacctaaagggcttccaaatctctgtagcagcacccactgacgaaaaagcagttccaaaagcctgtcatttcacccaggagttttctatcaagtaagaatacatgaggccttagagaatgacggacatgtttcactgacatgaaacacacgggtgatgtgcctggcacacatgcacatgcgcacgtatcatcccctacaaacagtcggggaggtgctcctggggcagctcttgtccctaccttcctttccccaaaggggactgggtgtaccagtaattttcagaatctttcatttgaatcactaaggttgtacttgttccaatttcttgaagaaaaaaaaaaaaaagagcattcctgagagagcaatgccgaaatgaaggtacaaaaattcacttctgaatattaaaatctctgcagatatcttctttattaccctcatagtccaaaatcttaccaacttttcataaggttcttgcctgaaatcccttactttaaaataaaaacacattgagtgcttccaccttgacactcacaaaagatcatgggataaatggacctttgcagaattattttcttccctttcaaatgccaggctccttctgtgtgaattttccacaatttcatagctcataatagcctatccttactgttagatattaaataatttttctacaacaaagtcgcagataagaaaaatcagacccagcatattgcaaacattactggctgtgaagcattgagcctaagttcaaaactaggagtaaaactttacagcattagtaagtcaataggaaatgacagaatttgaatatccccattctgccaccctaatagatctagaaaacgattatcaatgaatgctaataacacaaaaagagagactagtagtaatgatgtccctcctaatggaaggacacataccacttataaagtcttcttgaaaaaaaagttaattgagttgaatcaagcatctagctctaactagcaattcacaacaaatacaggggactgagaaacatggtaggaccataccactggaatgcagtcatcactggactgcaagaaactctccagtggtgaaagccatgtgtggtccaaggactggccagtgctgttctacaaactagacgttactagtctatattgagataaggagtttaagctagaatctaaaccatctcactgcttccttcatcgagaaagtctccctagaaataaaatatcagctgaactaaatagtgtgcttagtgacatattttggatttacaccctggcttctcatctcatcatggaccagtaacaggagtttgtggactggcatcttaagaagcactggtgtagaggacaggaaccaatttcttcaatacataaattacaaggaaaaactgacagggggacaatctacatattcaaaaatatttaagacagatcaaccaattgcaaaatatggacttttttggatcctgatttgaataaactgcaaaaaaacaaataaaatttatgactcaattaggaaattttaaatattcactgaatatttgataatattagaaaattagtgttaatggtaaacagaataatgttattgtgtttatgtttcttaaagggcccttatcttttaggacacacattgaaatatttaaaagtaaaatgatttttcaaggatttacttcaaaataaatgcaatgagggagagaagaagtagataaaacaagattgaccattaattgataaatgctgaagctggatcatcattgtatccttcttgctagttttgaaattatccacatctgtgttaaataaaattctttttaaaaaacacaaatttgcagcagcacctggcctagtccatcctgatatccacagtctcctacatgccatcatgccacacttttgttttctgttttcgttcacttgaagaaccacctttatctgttacgcagctcaacattcctgagagggaggggacccccattaagagacaacagtccaatcccaacatgtgtaccatgttaaatcagtggcaagaactaaccaaagtgttcctactaagtatccagctactaaataaggttacagttcactagatgaagaatccaagaacaaatgacttcactacacctgtgcaaacaattaacatgtcggtccaggggatggatccccttgggcatcacaggtcctttttgacatgattcattttcataaagacattttatctttctttatgacaaacataaacccatcagttaacaaaagatgtgttttgggggaaggggtttttgtgtatcaggtccataaaaaggttaaatttgggtttttctgtgcataagtggaagaattcttatggacatgggaaatatgaaatggagggaggaaatcatttagcaaagaatcctggtatgtcttctgacctttcaatgtgtgagaatgtgtgtcaaacaacctattttcaaggaaggtcccaaatgcaaatgagcagatgagtcagtctgcagtcaaattagaccctgctgtcttctgtcaaagttcaataatgtctggattaagttagaactgcttacaagcaaaaggagaaaaagtggtttgcctatctttgtaaaatacctgaaaggttttcaaaactttaaaaggaaaagtttattttatttgaggtttatttttttcccaggaagtcggtagagcacagaaaatacccggtatttgcagtgagccgagattgtgccactgcactccagcctggatgacagagtgagactccatctcaaaaaaaaaaaaaaaaaaagaaaagaaaagaaaagaaagtacctggtattcatttgtttgattttatattcttacttttttacaaactttctgttggtgatggtgtgatttaccccacggggatgagagacattaagtaatttgaacattttcaatggcaaatagaaaagtaactattatctgttcaaatcgttccttatttaaaacactctactcttatttttataggctgtgaatgaatatgaagcaaccgcaacttcttagagtttactgccaatcagttaaccagagctggcatgtagggtgcagcgtataggaactctacgaaagctatgcctaaattaagataatgtatgttttgttccactctcacggatgttcaatagtttaagacctctccgaaagtcaactctcattaaaatcaaaatggaaatcattaagagaaaatttaaaaataaaaagattttcaatttctcaagagaaagaggacacagaagaagaagaacaaataagaatctctttgtagtaaatgagcattatgttgctgcatggcatgaagccaaaggaagggaacgctcaactagaaagtggctcttctcaggggctgccaatctgagtcagcctgtccccaatcacgcaagcaaggcctgcccacaaagcacctagagaggacagtgataacagagtgggtggagggaatactgacgctatggaaaagggagctttctccctgtgagtgcagatgtgttgtgtttgcccatccagtatcccttccccttctctgctaaccaaactcttcgtttcctaagcccattccacatggttcaggcaggactaacacatggctcagtcctgaccagctggagtgtcctatttctttggcgacagtgaagggcgtgtgactggggcagtgctggagttctccgcgagatctgacatgagcaatctggaaaagagggcttatctctttacctctgagattatgtgttgaaaggcagtgtggctaagaattgtaggtggtcatctgggctacccaattataaccaaatccttactccaacagaggcaattaaagcacatttcaagaatagcgcaccaccttgccatgaaacaattctaactcccagggtatctctgcactgctgccaaagagaatggttttcaacccagtctttccatttactaaaatttaaattcttttcacaaagtatctttttaaaaaatgtgctaatcaggaaagaggcaaggcctatttgacagatctgccagttaaaaaatgcaaacttttttggaagagttgagggggtgcatattaataaggaataatatttagtaagtttgtttcccaatgaagacaacacaatttagggaaagagaaaatttaaaaataaaaacttatccccaaactgcctttaagtataaccagatctccacagatatagtaagtccattaaaattacacttttgaacattttaaaattcaggtttgcctcctgtttcttaatataatcatttctatgatgagaaagtggagactgtggtatccagataggtatgattatctagatttttgctttagccataaaaaacagcctctttggatgactctctgcctcattttccttatctgtaacagcattataatcattctcatcatcatagctaaacatgtcaggcatagtactaagaacttgaaatgtaccatcccattaaatcttaggacaacacagaaagatgagtaatttaatcgcatttacaagtgaagaaactgaggcccagagaggtcaaatcactcgtctgaggtttcctcctagaaggtggtggagccagggtttgacccaaagcatgtctatttccacacttccaaacctccctgaaagtgtggccaaaggttattagtgatcattgaaaatgactccttggtcctttaaaatatggtcccacaatcaataccagtataccccactacccacagccaggctcaaataggaaatagtgtgaggtaattataacatataccccagccactagctctgggtttttatgaccaaactgccaaacattcctagccaactcttcaggaaatgttcaggcactttctcagattccagctaaaacaccgactatgtgaccctggggagcacagagctcacagggtggtaatgggatataaaatttgcaaacttgaggtcagtggcctcaactctggggtgtgaagcaccagcagtccatgaaagattaaaaaactatttgtctacttaaaggctgcacatcaagtccttcactgaaaagcatttgcctacatctcctcagacattaaccccatcagaaagggagagaaagatattccaaatggcagttctgcctagaatcattggaaaaaaagataataatatcaacaagcccaagacagggtgttcattctgaaaatgaagcattgggtcctattcaaacgcagctaatgctcataacatagttgtcacttggagtaggcagatgttttacagtattactaggtgagatgatatggaggaaaacacaagaatttaagaatttttttctttctttagcatgtttattacataaactcttaatgtatagtttggataactgagccagcaagttacacaacaagaaaccaagcttaatcacagacccagaactgccttagttgatcccaggtcatttgactctttgactgccaattagaagtgtgagtatgtgtgtggtggagggttgcggggaggagtcatgcttccgattcccggagaagactatttctctttttccaaccacctgactgataccctcattgacaactacctccctcaaaaagtcccatcccacccaatcctttctaatgtggaggttcccactgagagcagggtagtactgaggatctaaaactctgctacagtatcaccccttcagggctgaccgctgagagagtaatcacactgcctaagatcaaataaatgagagaaagaaaacacccatgcccacaggattgataaggtttggttatttcaagtatagcagagaacttgcagataccagtccacctcttgagggtgtgaacacaaagaggcccaatctattacccaacaacgcgcctcttaggtcagctctcgctaccacgtgactcagcttccacacctacgaaccggagaggaaaataagcaccttgagcacttgttcctggaccttctctgggcctcagtttcagtatttatacatttctaaaatctgtcctactataactaatttataatatgaatttttctaaagatggatggtctggctatggaagaagatataagccataatttcaatggcaaaaataaaagcatttaaaaataagaaggtcctttaaaagttattcatcaaaggcccaaacctattagggtctgattacacaatcttacaaattagcactgaatgaacaggggaaatgatacacaataaaccattagttacaagaagcaggatgcatcaaactttacatagtaccatatacacaggtgcataccagacaatggattaacctgcttttccactgcattcctctaaatgttttcatacgaatcttttctggcatccaagtgtctttcttttatgtcctgactctcctccataagctctctgtcccctaaaagaggctgattaaggccacaggtcgcctggtcccaatgctgccgggagtgaaggggttgtcatcaatctctttcaaaacccagcatctgctctgtccagcctaggtccactggctggcaagactttcactccagaaccttctcccagctctctcctcctgcttccctcaggctttctccttccttcccctaacaaaaaccttaaccctgttttgctttttgaacaccccaatgttcccaggtaaaaattttgtattttacttagaccttgtttacttttcttaaggttttaactctcatttgatattcctatcctccctattttatttgcagcacagcttatgaaattacttacaaaaagaagatgaaacaatgatgatgaagaaaaagaagaaaaggaaaagatggcaacaaagaaggagaaacagaaccggaaaaggaagaagaagaaaccaaaaaaaaaaaaaaaaaaccacacacacacacacacacacacacacacacacacacacacacacaaaatgaaaccctgcctctggaatacattgtctttattaataaagatattaccatacttcagttcaaaaccatgaaacttgacagcagacaatgtgtctttagggcagacataaatcctgtctcccaacaccaacatcataaaatggttgtactatatttggacttagatgtgtttggatacttatatttgaatgtaagtatgactgatggtctaggaattcataatccttcaaaatgttgaactaaaccacttgtttaatggagcagttctcccactctgagcctgcttgctgtctggaatacatctccggctgggaatggtggagatagggatttttgctttctctcttccgctctgagggagctgaataaatagagtcagtgataacttcaaccaaaaaaaagtcacttaagttgaaaaagtggtagtcacaagaaatttaaatctaggatttgatatagtataagacacccacaatgcaaacttgactatattcctaatccaattttattctattgataatgtggctactccatttataagaaaaatagtacagttcagctcattacaacaccaattctattagcaactgcaacctatttttacttattagtataacccctaatttaaaaaattgaggtggattacaccaacagatacatacatttgaggctataaatagaaattgaaaataaaattccatacagaagaaagttaaaacataccaaagttaataaattagagtgattgcccattaaatttatttcatgtataatcttaaaagctgattttcttaaaagcaaatggaaaatggttagatgttttgaaattctcatatttgaataaaacaaaacatactgcttcattaggaactttcattttattcctgacagttgtgagttctttaaatgcagaactgtggacaaactaagatcaatgccctaacatgaatctaacagaacatgcaaacacaatatttatggagctttttcattctgaagttacagcagcaaaatacaatgaggcatcctcagtagagaactaagccaactgaacttgatcaagttagaattaaaacttaaagtatctgattagccttctcaaagatctattgcctcacagtggtagctggtctccaaagatggctccactttctcccctcccagcagacacatgatgctcctcacatccaaaggtaggtcttaatagtccatgcccttcaatctggatgaggcctatgacttggatggaattccaggtcatgcgattccaggctaagtttgaagaaagtctggtagttcccacttttgtgctcttgagagatcctgaactgccatggaaaaagtctggctatgctgctctaaagaccatgtagagaggccacgtatagaaaggggacaacctgagactatataaaggagaatcaaggaagccaggcaatgtcgaggacatatgagtccatgtgaccccagccagccagcccccagcccttcgagttagcctacggtcaatatgtgggattaacacatgtgaccagggtcaggaggctgttgttcaagatccagccccaacagacactcactctgagcaaggcctagtcgctgcatctggggctcagtctccccatttgaaaaaaaacacattcaatggctccatcccgggggcaggttcaggcaggagactgcatgagagacagctttaaaacttggaaggcccccagcagagccagacaagtggctctttgcttcctttattcccctcctcagtgggtccatttagataaaccacacccaagtaaacagggctgcaggcgccagtgcctggtcacagaaccagatgcatatgtgaagaagtcatactgcctgttccagcccaactgacattgtggggcgcagagacaagattccccactgtgtcctgtctaaattcctgagccacagaatcatgagaaagaataaaattgttgttttaagccacgaagtctggggcaatttgttacgtagcaataaaataactcaaacactcacaaatgaaaatactttgtttcatggtagtagagggcctaggcctgatctcgtttccctttattttctctttatggtgctacaatgacttcgtgtatggtaagtttgaatatatatggaggtgggagcattctaggtcctcctcgcctttgtctttcacaaccaactagtcaagtactgtctgcattaactctggaaccacctgagtctcttctttcttcacccctttcactgaatttgctcagaccatcgtggactctcactgtgactcctatattagcctcctaaatccaaatctccctgtctttagtctctcttctctctaatcatctacccttcacacctctacccagtggcaaagatctgatcatgttcctatcttagaatcctttactagctccccgtccttgcctttcacaacatcagtgacatttatatttccactagtccctctcctttccctaacaacattgccacctatgtacgggctcacaagattgctcaaggttgcaaactgcacagctccagagggcactcgtttcatagactgcactacaaaccatgtcacttggaaccatgccgtgccaaccctgcccaactgcagtcaatgtcctaagacctcagacacttcatatccctttcccttgatgtatttttcactcatctttcctttatttctcagctatacttactccaagctctagtctatataattaaccatacccagttaatcagctcatcaaaattgctcagagttcaactatcaaaaactattctattgaacatgtgccgcatacccagttcctagatgttcctagagataaataaaacaagcaagatctctgccttcaaggagttctcactcctagtagacagtcactttttatcacgtagatcagaggttgttaaactttttctgtaaaggaccaaagagcaaatgtttcagttttatgggccatactgtctctgttgcaactactccactctgctgctgtagggagaaagcagccatacataataagtaaataaacaggcatggatttgtttcaataaaactctattttcaaaaaaagtgagcttggtcttcagtttgttgaccactgataaactttttttttttttttaagacaggatcttgttctgtcgcccaggctagagtgcagtggcatgatcatagctcactgcagcctcaaccctctgggctcaagtgatcctcctgcctcagcctcccaaagcactgggattacaggaatgagccaccatgcccagccctaatagactttcactgtaaagtcacttctgatcaatcccattcccacaatgatgcttcccttggcttgtaacagcatctgccatcaataaatgttgagtctttccacatagcaatggtgggagaagattcttgggaaacgaaggtataaaaggtatgaaagaaaaaaatttaccagctacaagatttattataactgtaaagcagtaaaatattaagattaagagctccagctatgaagctagattttccaactctaccacttactagtttatgtccctggagtaattactgaaactctgcatcccttgtttcttcatttgttaaatgaataaataagcttaattttcctcataaaggatttatgttttaaaggaattagtatttgcaaagtacaatcataagtgatacatcagagctttttttttttttttttaccattatggctgcaatttaatgtaaaaaattgggctgagtttacaggcaaccaaggttaaaaaatgaaaaagaaataattaaataactcatatgactggtcgtgatttaagacacataccaatttccactggaaagagaaatacttcttgcaaccctattcagagagatttctcacaggggacatgacagcaagagggttctgaacaacataaacagcaatgcctccagctcagaagcccacacaacgcccagcaggctgcctgcaatggttacctaccaccctcacacaagtcaaggtctaatattaaaatataatacgctgtccaaagtcccactggctctaacatcctatgattctttctgttttattaatgtctttgcagaaagtttcttgttggactaaataatactgtgtgattaaccatacttaggatttgtgaactagcatgaaagaatattaggaattttaagtggaattttaccaatgtcttgggcctgcatttttgtctggtggaatgaaaaaccaaaaccataactaaaattaatggagaaagaaaagttaacgttaagttttgtctttagaacttaacctctgcatacctcggctctcacatctgtgaagggaagcttatgaaagcacccagcttgtagagtggctatgaggattcaatgaattatcatatgcaaaacagtaagaacagtgcttagcaacatatagtgcttagtaacatatagatgttacctaaatgttacctaccatggctgcaattgttattatgtatttgtttagacttaataccagaccccctttccagggacgctgtccttctgtgcactcacggttcctgaagtacccccagggttatggggtatatgtctctggccttccacagaactaaactcaagctagcattcaatcaagacttcctgaattaatgaactttctgaaaccccacttaatgatgagttagtggtaaaatgcttataataggattcttgtcttcaatgatttaactatctaatgagaaaatcgacttgaacaatcatgaaacgctaaactatcatgtgcctgagttaggccacataactcaggcctgatatattattgatgtcggtttcttcaaagaatctcatgggaaaaaattctaagttgcttaagcaggcccatttgctgggttcatgtttaaaaacaaagaaattgttaaaagaatgtatttctctttcaagaaaacatttgtaaaatcttattttcacattgaaaataaagctaaaactcccaaagtggttaggctgattggcttactggaagaaaaagccaacaaactggtacatgaatactctaataattttttagtattttgcttgattagagtcatcagtataatactataatttttaaagtatatgctacacaagacgataaaggaacattttaatattctttaaaattccaaataaggttgaagggaagtctgtactccatttccatcagctctcatctcatttcaccataggctgatgtatgttttaattaatttgtattaccaacttacacatttttataaacaacctctatgtcttcaatgttacaaaatgagtcacataaataaatattttgtctctaccttcttgtttcatgtgtggaattgctgaaatcttctatttaagaacactatatccttttttaaaaaaaaattgtgtcccaatattttagcttaatcttttcaataaatgtaaaccatacccctgcaggagtctttccccatatttaattattagcccatctgacttcaggtgaagtcttaaagtcccctttataaagtaaaatggactttataaagtctacagaactttttctgtattccctattacagttctttattttaataacagacttctacataactaatcccttggagtttgccatcacataatctaccatgggtatgaactgttccatgtgtatttttctggcaacaagacctctggaaaaaaataaacaaataaacaaagaccaaaaggaatcacacacaaggggacaaattgtgtcaaatacaactggtctcatgtacctataaaccacacaacaagggcagaagtctcaatccatcttctccaaggtttgggaaaggagatctcactgtgaagaacttttccccctttgacaggaaacagtaatatttccttacttgggagctaaagcaataaggcaatcataaataaatggtgcataactattgctattcaagtacagttgagttttttttttttggactgtctcccacactttttgcctaatcaccatttagagtttagctgagaaaaattcccatgaattgaaagtcaaacaaatagcgttatgattttattatttttcataaacccatttcacatatcaagcaatgcccaaggaaaagaaaactactatacatttattatttcacgtggttttgaaacttgaacaaatctcatttgaaaatagagaaaaatgcaatttttgcagagtagatggggaccacactgattccatttttaaaaaaggatttcctgtaaaaacagaaattggcaatttactctaagaaaacacagcagaagctgggaagaaacttgaggatgcctaaatttccactgtggaacaacttttgctgcccagtggggagagaataaaaaaaaaaaagaacacctgcaacagggggggaggagaggaagacaagctgggactgcacatccagtgagcagaaaatgaggcagttttctaatctaggaagagagggagctgacaagaaaggaatatatatgcatttgaagaataccaaggcggattttgtagtcacctgccacatcagagaaaaacaagaaggcagtatttgctggggagaaggaaccagtgcacagcagatactgatgagtttaaggtaccttttaactagaggaaagattagtgaggtgctgaaagttgctgccaccaactgggcatcaggcagactcgggggttacaaatcactttcacttcataaactgtgcatctccaatcagaatggtaaacaggtttcactgtagtcaaagaggtgagttttgaagccggtaatattttaacagacaaaaacagaaattttaagcaataactggaaaaatgtagtacataactgctttttctgatgatttatacagcagggcaccgttaaaggatttattcatatgagactgtaacggcaataagcagagggaataaatttaaaatgttattcaaatttaacataagaattggggtttgcttaaaatctatgggaaagactttgatccagcaattctatttttactaatttataccacatataaacacgtgtatgtaaacacaggtatgcagaagaaagttggtaatagcaaaagactcaatgtaatctaaagagccatcactagggaactgttccagtgacataatgaggttctatacaacaagaaaatggggtagggcgcagtggctcaagcctgtaatttggagaggcagaggtgggtggatcgcttgaggccaagagtttgagaccatcctggccaacatggcgaaaccccatctctactaaaaatacaaaaaattagccgggcttggtggcacccacctgtaatcccagctactctggaggctgaggcaggagaatcgcttgagccgggaaggtggaggcagtaagccaagattgcaccactacactccagcctgggcaacagagcaagactgtgtctcaaaaaaaaagaaagaaaatgaatgaggtagatccatatgagttaatagatggatgcattaaagatacataaaaagtaagtaaagttcagaatattgcatgtacaatacattccatgtattaaaaaggatacacacacacatgtgtatgtatacatatatatttgtgtttatttgtacatgtatacatatgcctaaaagatttatagaaaaatacacaagaaaatggtctctgaaaggtggcagggaaatacttttaattgtatatatttttaaattattattttcacccccgtgtatgtgtgtgtgtgtgtgtgtgtgtatatatatatatcacttattataaaatcttataattaacatgagaattaggaacacacataattacaattctattaataccctgtttttaggaaggctttataaatagtttacaataggataaggtctgtgttaatgatcaaatactgtgaggagcacagagaggtatctctctataatcacaaacaaatttaaaaccagagagaaaaagcacaagtgtgagtaaaagtgtggcatcctgttaagcaacaaagtaaagcttagtttcttttttcacattcccaagggaacacactagttggtgacagcccagagaaatgagacaaatgtctgaccaggcctcacacctctctgcagatcttcagccacagaattaaatccccacgtcctttatatacaggagcaatcctatcagaatagatattaagatattattatgtaggagaaatgtatttttgaaggaaaaatactggactaaatgaggtcctcttgagaacatatgaaaatcagagcctcagtctacttattgaacttgccatgtgccttgcacacagggcaataaacatctgctgtctgatcaaggtcaggtttaccatgataagcaaacttccttccaacattatcggaattctgggtttattttccacgaaggccaagatggaaccgaattaatcataactattttctgtgctattttatcacagcctaagtgcttggctcatacaatcatcttgtccttactccagactaggagtcaaaaactggtctggtgagtttactttttcttctcatatctgggccatacaaacacaaattttactacatatacatgactataacacctcataacaaaaaaagagtaagtgaaatgaacagccacatatccaagtggataccatcacttggtgacccagagctatataataaagctacagaaccactcaggaaaagagcatcagcgagaatggtaagaatttaatacaaaatctccctatatatactgtctgaatttatttaacaggctcctccaagaagataaaaggggtcactgacagtccatcctgttgtttccatggaggctttaacttaaacaactgcagacaaatttctcttaaaggaaatgtattcccactgtccttcaatacaggaaaatgacaacccttagtcaagtctaattaaaatttttccggctgaaacatctgtaacagcggcatgggaagccagtgaaatggtcagttgcatgtacacaacacaaacaccactagttaaaaatactcccttaaggccggccacagcagccttactgctgcagtgaaacggagagccccacacaactcaaaaaaccagttctcagaaccacttgccctgttctgcttccaatgtagacatctaaaggaagcattgcccagaaaacccaatccgtaattttaataagcataatttacggaagagtcaactactgtgtgatttctcctctgactgtcatgggaatcccttcctttccttgccccctttcaaatacagcatctaccaagatgaccccaaggaaagtactttcctctagaaacaaccagaattgatattgcagggaaaggaacgggcttctcctcttatcccactcgcaactcctccccttcttccccaaggaactcttctcgcctcccaaaatctgcctcaacaatggcccaagattccatttaaccacgtcctctcctttggggcagaaatctctgggagtaggggcaaggtagtttaaccacgaacggggtggggactaaacaaccctagcacctctaaggtgcccccaggaggtcttgccaaggagtcttccacagggagagtcatcctgcccgttgttctggatcttgaaacttgggagacccacaccaaaggagggaaccggttcctttaccctttaagcgcgtcgtgtcctccaccgcctcttctcttggcccgactggctctggtttccttcacgttcccagcctccaaattggcgtccgccccatggctcgtgtaggacgctaaaagcacggtaaatcccagggcgatctccagcagacgccctcgacgcatgatgccgagccgccaccggctcccgccgcctcttgccgcgcccggggctcggtctgcggccgccgctgcgccctgaagcgcaccgcgccgccggggtcccgctatcccgccgcccgtcccccgggccgggctcctcccgccttctccaggcgctgctcccacttcaggcggcccctgccagctgcaacacagagacaaatccccgaggcggggagactttcagggcatcgggatgctgaagcctcgcggtccccattcccaagcccaacccgtgcgccgcctgcgcgtggcgcagttaatttgggtaagggaagaccgtttggtccacagctggctggaaagcccaggcccccggcggcagcagccccggccgatccctcggcctcccgggccccgccagaagagcgcggcgcaaagtacccatatccccagcggtcctaagccccgggcgagctctctgggtttattttttttagcggcacgaattgcgcgcgatgcgcgctctgaacgccccactcctcagcctgccctctccgccaggctggaagccagccgcgccgtccccgccgactccgggcgatgccaccgccccccgaacatctgacgcggagcccggcaccaagagccccgggccaggaagctgtcaggcaggggagggccagcgccagctgtggacgttccgggacagcccctcaccccagtccctgtccctgccctcggcgcggcgcaaacgcaaaagcctccgtggccgcagctccagccccggtggccgcccgacccccgtcgggaccccggctgcacccactggagaagcggcggctccgactcccgaggaggcggcggcggctgctcccagtcgtggccgctacagccactgctcggctccgctcgcagctgtcccagctgtggctcctgtccgcttgtggcacccacagtctctgccgcggctcccgcagccccctcctttccccacctcttcaagtatcgtccgcgcagcggtttctcgcgagagaaatactttttttaaaaaaagaaagaaaaagaaaatgacaccccctccttcgtcgccctcatcaccaccccaccccccggccccatccatcctccctttccactcccctttgccagcctccgcctcggtgcggggcctctcgctcgcaggattagcgcagtgggaggaggcagaggtgatcaggtcctgcccggcctgggactttttgtcttgaggtggggaggggagaaatgggaagaggtggagtagcggttttagcccgctctgcggctgcgaggtttagatccgagattaacctctcccgcgataggtgaagccctaccggagcagaaagctgttccacctgcaccaagaatgcgcgctggagacggttgccccggaggccctggcccgagagaaaaccagtccccgctgcccgcgcctcccggtagcgcgctccctgcgcctctcccgccggacactcagcagacgccggaggccgggaggctaagactgggcgcgtcgcaggccgggaccgcggcagaggctgctgtgccgaccgaggagagggctctgccgcccccacttgccctgggtgtcgagagcccactccagacgcggctcttctgaggctcaattcaagccacccaggcctgaatccagggtgctctctctaagtcggtgtccaacccaggggcctgtaaatgttggaacctaggatgtaggatgggagcggtgaagggatggtcctcttgcccagcccagattaagactggggttcatctggaggactctacttacaccctcccggtcccctcgccctcccccacacacagctgcctctccccaggatatgcgcggcacagtgaatttagtggctttgaaaggtatagtatttgtggcatccttatatggataatgcccaatgatgcctgcaccctgtaacagtttaggaaggcctgaagtcgcacactgggtcctggctgctgtaactggagacccccagaagatcccctgcaagcagccaccagcctgctgtcaagccaataataaaagctcagcacaaacaggtaccctgggaatgtatcttgttgaaagggattttccttatttgtaaccgtttgtaaaggggcccagacagtagggtagagagacctgggcaagttattcaacttctttccaaatacaagatgggacttgtagtgtccaccacacagggttgtaatggtgatgatggacatgctgaactgctgtgatacatgaagatgaaacagaaaaactgtgggaactatgagctgatctaaagccatagtcctgtaagtatgtatgtggtgtactttaaggtctcacctgcaaaaggtctcttagcagattcatgaatgagagccttggtcacacactcctggctgagtaaaggagatcattcattcaagatgtttttactgagcacgaactgtgtactacttagtgcattgttgaactagacttcaacaattttaacaaggcaggttcaacaatttgaacacgactgacttcaacaatttagtgaaaagggcagaaatgtgtctcccctcacacagcaggtagtcaacaaggaaaggcagacttgaaacaaataatggaccaattgttaagcgccaaacaggataagtactgggtgcttgcttggaggatatataacaaggggacttgacctaggctagggctgatcaggaaagggatccctgaggaagtgatatttaacttaagtctaaaacataactagactctacttaggatagcagttctcaaccctggctatgcagtaaaataataagaggctttaaaaaaattctgacaccaggatgggcatggtggctcatgcctgggcctgtaatcccagcactttgggagaccaaggcgggtggatcactttagaccagtagttcaatagcagcccgaccaacattgtgaaaccctgtctctactaaaaatacaaaaattagccaggtgtggtggtgcatgcctgtaaatcttgctactcaggaggctgaggcactagaatcgcttgaacctgagaggtagagattgcagtgagaggagattgtgccactgcactacagcctgggcagaacagagtgaaactctgcctcaaaaaaaaaaaaaaaaaaaaaaaatctgacactgacaccaggccccaacacccagagtttctgatttgagtagtctgtagtggattcttcacatggatattttttaaagctccctgggtagggaggggtaaggaggtaattcacactgggaaaaggatctgagcagagggaccatggattaggagaaagcagggctgttggacatccagaaaggccttgtcctgcccaccagttttctgggctgctctgcacccacaggggactctggaaactgcatgctttccttgtactccagcagcatgcaagacatgctgtgccctttctctcagaatcttacactcagtgacatgttggtcagcagcaaccaaacacaagccttttctaaggcttctgcccaggaagtaaaggccaaatcctggtgccctgcaagtcccctcttccaacatttctggacatttctattatttctaactcaaactgccttccagggtttcacctccaagggagggatttggattaaacgtttttacctggcctttgctttccccggcaacctcctctttattcattggcctctttctccaataaaggaaagattcttccttcatattgggtggcagctccaagccatatactcccctctttgagcaataagtctcatgttctgaccacaatggtggaagattacaggggaaggggaagcagggggaacttgattacttaaaagtaaatacattttaaatatacaagaactattcccgctatctaggcaatcaacatgtattagagtagcatgctacttatgacaaaattcagtaacgaataataaaaatctgtgtctttgcaataagattttcttgatgccagatgattgaggacccaactctccttaaacctatcacagactttttttttttttttcgtaataggttgttttgcactgtttgcaaattaagtccatgggctagaattccttgcttccatctccttatttcaaagaattctattcaccctaagaaaccttgctcagattccttcttgttcgtaggtgttttagctcatgcccatctctcttgttctaacatcattgcacttattaactgaatcattcacttaatagttaatacataattatagtatgcctactatatgccaagtgccatgtcaggcactggacattagggatatttcttctgttgctatagtgaactattaggttggcacaaaagtaattgcagtttttgccatttaaaagtactagcaaaaccgcaattactttggcgtcaacctaaatatatattttttttctgtagccattgtacttactccccctagctgtatgatagatccttaaagacaaggtggcattccttattcaaggaaacttgctagtgtcctgaaaactatgacaaaacacaaatactttgtttgttgttggatcaattgaaatctttcttttttttttttttttttttgagacagtgtctcgctttgtcacccaggctggagtgcagtggcgcgatctcggctcactgcaagctccacctctgggattcacgtcattctcctgcctcagcctcccaagtagctgggaatacaggcacctgccaccatgcctggctaatttttttgtatttttagtagagatggggtttcaccgtgttaaccaggatgatcaattgaaatcttgtggcattttcagcttcaagccactctcatcattttatacctcctgtataaatatctatgtcagcaagggttctttgtctacaagcaagaaaactagctatggaaaatttcagcaaaaaaaaagatattttaagtattatcaggttatgagatggctcattgaacttgactttgtgataaaatggggagtagtacagttctgggataatggtaagcagagaacctcttcaggctgatgtcatgtgagtaaatcaattccaaccattttcatctttttgccacccctcttggagttcaaattcaaaggacagggtccttttgacgtagctatttagggaacttgggcacaatcctggccaaaggatgatggagtatcttgatggatagtcccaacaagattgcatgccatgggaaaagggttcatctataaaagatgggcaaaacactattttggtcatgcaccaaaaattgaagggcattaatgcttgtcaggagaaaaaaaaaaaatccagatgtccattacatcatctcaagaactctcaagatgtttagagcttactgaaataaagcattttcaagctttacttggaagaagcatactctaaaatcagcttctacgtcttcctttgcaaactaaatcatgacttcacaaaaagctaactagactttcatgtagcctcagttcctgccattgatggtggcaaatagatcactcatgatacaaccaactatatcttcaaaaattggcttctgacttttagtgagtattgtagaattttgtagttataaaaatgtaatgcatatatcacagctaccagaaaccatacctatttatatatagagagagaaaaataatacattcacatacataaccacatttaatctttgccacaacttttggtagattgaaaaacatagccacaatatttcttatcttcttccatcaagaagtagcgtctatttctcaactctttgaatctgagttggctttttatttttcttttaccagtagaatatcatggaagtaacattgtatgacttctaaagctaggccttaagaaatcttgcagcttcctcttttaccctattagatgttgccctgagatggataggccttcaagaagtccaggatgaaagacaatgtggagagagacagccccaactctctcagctacatcaagactcttcctgagctaccaactaaatgtagtcacatatgtgagcccagcagatcagcccaactgcccagttaacccatagaatacatatatcattgttgttttaagctgcttatttattagggtggtctattacgtaggaatagataaataattgaaaccttataatataaaataatttttctcaattttagagatgaagaaactcacattgagaagagttaagaaacttgctcaaattcataaaatcaagaggagaggtggatgtaattaaaaccaagcctttgacaaatcaaggaaacttttcatgtcgtcactgctacctcatccgtggccacaaaatctcagtcaagatctagggttgatgcaaactggagtcattcccagtatccacaacacttctcttgtgtcttctgggaagctaagatttcatcccttgagtttcattgctgcctgaatctattgcatcttacttgagagcctcatttattccatgctacaagatccatgcaagattccaggatcaccaagatcactccaggaaatgaagagatcaagagagctgccatggacaagtctctgcctctctgcttcagcttctagttccctcataatataggacaattccttgtacaaaacgggtgctccataaatatttgttgaatgaacttcttttctagatggtgacgtgatggcaaccttaaaacctcatgccattcttcctcatcattctctgggttaaagaaaggcctaaacttttccagcaattgacagagccttggtgtgtcatattgcctcattgtgcctcagttgtcccatcactcccacttgggagaggatatgaatgaatggatcttagttttaaagagctgaaggtggaattcagttgcctgattgctagcatagatagtacctctatgtatgtgccatttctttttttttttttttttgattgtttagttcatttatttgtgtaaccaattttgattaaaagctgaacactgtgctggaagctgaggcttcactggtgtagggatgccatttctgccccctaagaatcacaagggctagagcattgcaggaggtccttacagcaacaattaccatgaactaagcctttgcttagtgcaggcactgtgttaagagggaagttagtaatgttcttcccattttagaattttgtaactataaaaatataatgcaggcttaagaaagagcagtttaaaatgacataaataaacctttgttttagggaaagtttgcatatgtttgtgcttctgtgttatactaagaatcctgagcaattcccacttcagtataaaattctagtggtgtgagggcaaaaggtgaaaaagagttttaaaaaggtaaaaatttatacatgctagaaaaaaaatgagaattgttttcattttcatgattcttcagaaaatttatttattagaaatattttaactacttaaataaaagattttttaaagtatttttttcataatcccaaccaccctgttttagttttctcattttgcctctagtctttgtccatatggtgcattttacatagttgtaaccctggtggatgtatagttttatcttctgctcaacaaggaggagaatttgttcagcatttgagtgtttaacctttgcattttgtggatggggtccctgggtgaggtctgcctagccatctttctggcagaaagcatgtacaactgttgaattatgttattgaaatcactttcattacctcaatcccccaaagcaaacagttgctctccacccaaaacaaaagctctggttcccagacttcatttcacttgtgttttccgtgagttctgtgacccaccctggtattccctgtcattttttctaccagacataacagataccagcccaacggcagaggcgaataaagcggaggcctggacagcaggaaaggacataacatcgtatccatcacaaattaaaaacattctctattagctgcattcaacaagtgttaccaaacaccagccttgtgttgcagactaggggagacactacagaagccaccaaaatgtgcccatcctgcagcctgctctctctcaggagggagaaaatgagtgcttatagcagaggtcagcaaatttctataaagtgatagacagctaacaaatactttaagcttcatgaaccgtaaggcaaaagaaaacaaatttccacatgcattttactgacaaaagtaaaaatttgtctatggacactgaaatttgaatttcatataattttcatgtgcaatgaaatcttcttcatttgatcattttcaacaacttaaaagtgtaataactattcatagcctgcaggccatatagaaacaaggcatggggacagatttgctctgtgcagccatagtttaccaacttctggaattaaagaaaaaggccagcacagaacctggcttgggcatgattctccaaagtggctggcaccaagacagggatccacagaggagagaggtggggtggggtggggtggagtggtccagtcagaagacttaatggaagaaatgagatttgaggatcgccttgaagggagggtaggatttggctacatggggagaacattccaggcggaagtgatgagcatgagtccaaggcacagagggagggaagattatgggccaaaggggacatgcagggtgtttcaccatccttcacggtgacatacttctagctctccaaggtttctgtgacacaccctgggctatgtgtttatgaagagaaggggtattatggcctgtaggagtcagtctttaaatgactacgattaatcatattatatgaatgttaataatatccataacccaaaacttgttgaaaacactgagatccatctgatctctggtttaaacctgatgaaaggcaaactagaccttatttttctccatccagaggctttccacatttcatttggtcacctattttaaataatttttgtaaagaatgcactttttcttcaggatcttagtattctaatgataccagaaaatgccacctgccctaacccaaatattcatggcaaatatgaaaatcttgattaagttatgagtaacaagtagctttggttagtgacttttctgttttcctacatctgtttttgttttcactctagatctgaattttctctaaaaagttagtaattagtgcataccagtaattacttgatacctaaaaaaatgtttttcctggctgacttgatctattcccatgatttcaccccttggtcataacatactactaactcccaaatctgaatctccagcccagacatttccctagagcttcaaattcagatgtccaagttcctgctggatgcctccacctagtcctcccacaggcgttcagactcaactgtggtagcagcctctacgaaggcctccaaagatcccccttctgggtactcatgcccaggggtaatcccctccccttgagcatggcctggacctagtcactgtcttctaacagacagagtatggcagaggccatgggatgtcacctccaatatgaagttacacaaagacgcaggagcctgtcttgcttgccctttcttgccctcctgcctgcccacgctgatagaagccagctgtcacgttgtgagctgccctgcagggaggccctatgcaagaaactgatggaggcctccggccaacagtgatggactaaggcccacagtccaaaccacgcttgatgaactgaactctgctattgataacaatcacacaagcaagcttgggagtcttcagatgagactgcaaccccagccaacaccttgattcagcagtgagaaacgttcagcccgaggcatctagctaagcagtgcctcatttgtgacacagaaacaatgagataacaaatgtgtagtgtttgaagccactaaatgttgaggttatttgttacacagaaagaggtaactaatatgtcagcaaactccctaaacttgtttcttcccctaaattctgttttaattattaggaccaccatgttctcactcacctatgcttgcaaaagggtttatcagaggtcctttatctgtgtttctctcatctatgaaagcttgaatgctttttgtatttttcaatcacaattggtatgatttagtagtcttaaaatttgttccctttgagttccatctggaactcaagccatttgtgctacagcttgaaatttctcaatttctgcatgattctgctagcaacaatattaatgacatcatactggatatctttccacagattaaaaaaaaaaacttggggaagtgtccagagtgatagaataggagaaggaagagtctgggaaatactagaaaattctgcccagagtttgaaaatcaactacataaatagggatggaacaagcatggaattagaagacagaagactatggtcctgtctcggctttgctacccatctgctgtggcctcagaaagtcactttacttctagggtcctccctttcctctttaggaaaataagggagttagatttcaatgaaaggcaggccacgagtgggctatttcaggataaaccaaggagcttgttacacttcagattcctgtccctaacaatcacccaatgcagattcagtaggtctgaggtggagtctaggaatctgtatttttaaagtgtccagttctctgaaatataacaaggtatggaaatccatgaattagatccttccaaagaatatttacaattctagtgctgtaattgcggagcagtgtttattatatggcaattctaccttgcatgcacattgtaaaacatatcccgcaaaaagctaattttaaaggataattttttgtgtgtacatgtgcctgtacatgtatgtttttttcattttattttcttcccaaaccctaactgatctccttgcatcatcactagaacacatgaatctcaggagaaccactggagaccgtgacaggtctatggaaattgggtgaaaaggggtacaaaggtcaagaacaccgagacaaacatccaaggtagcaggcgagctccttctactcgtggtactgcttggcatcacatggaatactgagaagtgtaaggggtgtgtgtgtgtgtagttagcccttcttgttctcacctgaaagcccatctccatacagtgtcatatcacaaaaaacagaatctgtcttaatgagaaaacatctgacatgatcttcagtaaaaagtaacataagtcatcactgaaggactctcatgagatgtgaagggaagactgtgccacaccacgcacagcacagttttctctctttactgtagaatccccatgtctccctcagaccttaatttccccatctccaaatctttcaaatccacccgtacacctgtgcttgccatggttgtcctcctctctgcccctggcctctttcctaagattcctcagtctaccctccaggcccaccagccccctattaggcagagttatttccccttctctcagcttctcccatttgctcagcctgggattcgttttcagttgaaagggaacacaggatcacagttaatgtctagtatatttttaaccctgtacaccaaaaaagaaaaaaaaaaagggaaactaacaatgtaaggcaattagtgctaaaccaacagagaatgggagttctagatgttcagaggagaggaagagacctctatgccacagtgaccagaaaagttttcatggagaaaggaggagatcagctgagggttgaaaacttgggaaaaatcttttaccggtgaacggtagagccctcctgtcatattggaggagaaactcttgtacaaggaaagaccaaagataggaaagtatgcaacctgtttagaagaatggacaaaactgggtggaatgtataaagaagaaaaagagaaagagaagattagaaagtgggttgggaccagaagattgaggattgtgaagaaatgcacattattatagaatgtaaagcatgggaatgacatgatttagaaaattaatattttgtcaccatgcaagaagaactggaaaacagaaatcttttaagaaaggagatcaggaggttaaggcagcagctgggtgttggtgatgagcatgtgctccaaagatttgtcagtacacgtgaaaatgaatagaaaattatagtgtcatttcatgatagaatcattacagctgaatgaatgattgaatatgaaaagcaatggagagagggaagccaaagataacactgagacttgaatttggttggccagagaatggacagaactaaggaattgaggaggagaaagatgcgaatggggaagagagaagatggtgagcttagtgtttgttacatgtggcagttctgaaggcagcccagccgaggtgaagtagccagaaggcagaggttttggagcaattttgccagtcagtaaaggagatgcaacagttttgaagagacttgggattcagacttgtgagcatctgtaagaaattaaatttaccagctaattaaaattgcattttcctatagtttagacttttgattcctaataaacctgcaaattgacctggaagggataaccctcttgatagccagcatttgttctttgagtttcagatatattcttggaaacagattctcatggcaagaagggtaggaatcctgtgtaattaaagaggaaaggagggacaacctctaaatatcagaaacagactctgctgctggcaaacacaaggataaaaaaagacctacatgtctccacttggaatgacagtcagaattttgggaggtgataaagaaactacattcatgtaatacattcatgtctggataatttgtgaataataaatattattagtgcatgtagacactcaaatgattatcaattaaagaaagctttgcaagatggttttgtttccaagagagaatttttttttgtttaaaaactgtccaaaatacacaataataaatttacatttccagagataaatattcagctcttgactgaagatttgagaatacatttgaattacattcttgatcaggaaccaggaagtatatttcatatttattgagcaaaaataaatatccactttcactagtctgagtgcccatcagcatgagataatcaacataaatacataaggttgataccgttagctgagctgacttgtccttgtttctaggatgcacataactattttcctaggcccctacggatccagggaactcaggttgctcggcactgtttggggccctttccacatttatttatctgccccctggccctcaccaagcccaattccatattgccactgcaaatctctgtatttaatacgctgcttttgctcaaactttatctcacattcaaaatgtgttttcccttacaaagtggataatgctgttctctgccaagctctcctcttctgcgccgacgcacacagcccccagttgctgggaatgttaactgctaacagctcacagctgtgtccctctttgagctttgccgtttgcctcagaaaactgctagctcaaggtgatgccctcttctagggtgtggcccaatatttccaacattcctaaaagtctgttatggataatataagttcaatactcttcaagatgaaaggagaggagacaagtgacccatttcaaaataaaagacaagacattgttaaaagtcccacagactttacaaggtcagggaaatattaagaacaactttgtgccaataaatttggaaaattaaatgaaatacaaaaatttcttgaaagacataaattaccaaactggtgcaaaagaatagaaacagggctgaggatacctttaaagatattaaattcataatttaaaatatctccacaaggaaaataccaggtacgaacagcttcactgatatagtttatcaaacatttatggaggatatagtaacattcctacaaaaacttatccagaaaatagaagcagagcaaacacttcccaatcattttattagcctaccattattctgaaaaaaacaagcaagagcattacaggaaaagaaaggacagatcaataacccttagaaatatggaacaataatcttaaacaaaattttagcaaatcagaatcagcaatatatggaaaggcaaatgcattacgaacaagcagagtttatcctaggaatcaaagggatttttttaacattcaaaaatcaatgtaattcaccatactaatgaattaaaagagaaaaacaaaatacagagaaagcatttgagaaaattaaacacaaaattataataaaaaactttcagcaacctaggaataaaagggaacatcctgataaagaacatctatggagaaacgacactaactcactttcagtggtgaaagaccaaacgttttcacctttagtcaggaagaagggaagaatctctgatactgccactgaatttaacactgtactgaatgttgcagcaagaaaaagaaatgaaaggcatatatattggagaaggagaaatcaaactgccacagacaaaacagctatttagacagagtacactaacaatagacaaaaaggtgactagaactagaaagtaaattcaccagtgacatagaacacaaggtcattacacaaaaatccagtatcattctatatattagcaaaaaaaaaagtaaaatagattttttaaagaacattttaaaaacaataccatttggtatttcacttttagtctgactaaattggttcctgctagatgaacacttctacaaataacaataagctagaaaaaatacaaaaacaaaacaaacaataattacaacaacataattatctaaaggactagagtgtgaacaaaggcaggccgattctggagaagagttgatacccagaggaaggaaatggcacagggtgaattttctatttcttatgacttttggtctgaagacaggctgcaaccagcatggtatagggtgactaaaattttgagagaaaatccatagtctttctggactgaggaaacagagtacagagttcagggcaacccagctgatggaaagtaaggggagaatcccaaaaaggaaagaatcaaagaggggaaacaacaaagtttgtgtgtacatgcttttcaaatgtctgcctggcctgtgaatattcatagatggacagactgcatccaacccagtaaaggctataagaactaaactgcagtttgagctactgtccaagagacagagttcatagtctgttgtattcataaatttgaatacaacaaagttaattgcccattaaacaaaacaaaaccaaatcacaactctatttgaagaaatacaacaaaatctagagtcttcgctattaaacattcataatgtccaggatacaactcctagcattcaaaatacagagaaacaataaaatgtgagcaattttcaggagaaaagacaatcaagagatagaaactccaagatgacccaaatattggaattatcagaaaagaaattttaaggcaggtattataattctgatcaattaaagaaaatgtggtacatatacaccatagaatactacacgctaaataccacatgttctcacttataagtgggagctaaacattgggtactcatggaaataaagatggcaacaatagaaactggggactactacagagaggagggagagatgaaggggtaaaaaactattaggtaatatgctcagcacctgggtgatgggatcattcataccccaaatctcggcatcatgccatatgcccaggtaacaaacctgcacgtgtaccttctgaatctaaaataaaagttgaaaaataaaaataaaaataattgtgatgaatgacgcaaaggaaaatatgcttataatgaatgaaagggcagaggaatagcagtgaaacagaaagtataacaaagaactaatgagaaattctagaatttataaatataatatctgaaattaaaaatatattcgatgagctaaacattagaattgagatcatattgaaaagagtcagggagcctgaatattaatcaatagaaattatccaatatgaagaacacaaagaaaaggacaaaagacttaaaaaaattaacagagcttcaaggacttctgagaccaccataacaaaagatctatcataaaagcatctgaagttatagaagaagagaaagagacagatagcagaaagcatagtttttgaataactatgaccaaaaatgttgctatatttacagattgaggatgctcagcaaactggggaagaatcaatataaaaaagactatgttaatgctgctaaaaaaaaacacagataaggagaaaatcttcaaaggagccaaagaaatgacacattacctacaggggaacaatcatgcaaattaattttgacttatgatcagaaataacagaggtaaagaaacagtgaaacaatatctttagggtgtggaaacaaacaaacaaaaattgttggccccaaattctctacccagcaaaaatatcctccaaaatgaaggacaaacaaaggcatattcattctaaaaaatgtcactttaaatttgaaatactcagaaataaatttaataaaatatatgcaagactcatataagaattataaaatattcctaaaagaaattaaagaagatctaaataaatggaaagatgtaatagtttatagatcaaaagactcaatgttcttaagaattaaattcttcctaaattagcctataaacataatctcaattaaaatcctagtatacatttatgcagaaattaaaaaactgatgcaaattttatagggaaaatataaaggaactagaatagccaaaataattttgtcttataattctatcaattgctgaaagtagggtattaaagtctccaactataattgtggatttgtctagctctttcaacctagtggtgactacagttgcctcacactgccttgttaattcttgttggttctgggtgagcatggaggcccattttagcacaggaccctgcagatggtaccctggcatgagagtccaaacacccttcacttccaagagaatcagagcatccttccctttcattaggtagagaaggaacgatcagcttccacctcagccctgctgataccactcagtggaggaatcatagcactcaagtctgtctttgtgggctagaggaggaggctgcaatttttccattggcgtttgaacagagtttggcaaattttgaatttgccaaaaaaattgtgttttgttgttaggccactcttttccccattctttggtggcagagaacagggtttttgttgttgttgttgttttagcgtttttgtgtgtatgtaaggaaacctgggaggctgaggcaggaggattgtttgaggtcaggagttcaagaccaatctgggcaacatattgagacctcatccctacaaaaaaaataaacaattagccaggtgtggccacatgcacctgtggtctccactgctcgggaggctgaggcaggagaattgcttgagcccaggagtttgaagctcactagctatgatcacactagtgcctgagcaacagagtgagagactctgtctcaaaaaaaaaaaaaaaaattgactataatatatatgtctgacataggacatatcagaatacataaagaactcttacaattcaataagaaaataaaccagttttagaaacatgtataaaatatttaagttttgcataaaaagatatatagatggcatatggaaagaatgttcaacattattagttatcagggaaatgcaaattaaaactataatgagataaccacaccctggagaaaccaattcattttattgataagtggcacatcatacaggactggtccagcagccaatatgaaactgcaactttcaagagcaagaaggtcctgaagttgcagggaatacagcagaaatctccaaggacaatctctgttcccaatgccacatactccatcccttggccaatctgcacaggttgctagtgatgtgatgtatgcaatccagcagctgaatatgcacaagaaattaacagcaatttaggatttctctatctgaaggatatcagaacataatgtccctttcacatcacccagctgtcagtcttcctgagaacaaataagtaaataaacatgtaaaagaaactatgtttcatgtgtaaaaatgtaagcctgagcaagtaggataactattcctgttgtcctctacctgggtgcaccttgctagtactacagggtactttcccaccacaggaaaagtaagaggatgttgttacatggtgagcaacaaggcccaggaaaagaaagtttttcaaaacttctttctctgctcatcacctcagttcttcaacccttttcccagcttttggagtccccaaattctacaattagagattcatttatttgtaataatttttaaagggaagtaatacattaagcattcataaatgcttttcttgtatgagggcatagattcagttcctttgctgagtcagattttgacaagggatccttggttgaaacatcacacgtagggagagttgcaaaaacagggaaggcgccaaagtctgtggaaatggaagactgggcatatggaagataaacattgaggacttcactgaatgtcagtcctcacttaaactttaaaaactttcataaatacctgattctaaaacagcataactgttaaataatttctacaaatattagaagattataaaagttctctgccccgccactccgccagatttcccatcttggataaattacttaacttctttgagaaccagtttttcccacatgtgaaatgaagacatcccttgcttatttccaaggtcattcctagggaagggtgaaacttgaaatcaatcatggtagtgtggcctcactctaaatattctgacataaatgaaacccaactcaaataaatgtcaagaatagctttgaaggagacaggccatcccagaaaggcaacctacagcctcaggacaacaaataagatgatctttccagcttgcacttctcatggtgttaactcaagggaaacatgtaggctgatgctaatgtagctgcgtttgtcatcaaagcaagtctgcagctccccctccactctctccatattgtccccaggtcatcgccgcaccccaggttctgagttactttgctcctcacctgagttccccagtgttctaggctattaccataatcacctgtatcgcaaaaatagatttttaaccaaaacaaagggcaatataaaacttaataagaagtagctgaagattttttagaaaaggtatctttaacaactctagaagttactatcatctggagctggagtgaaaataacttaattgaaaacggaatcgaaaatgtgaaaaatcaacacgagaacctatttcatgatacaaaaggaggacgtgaagagagagaagatagcagtcagggagggtaggaaatgcagatgcatgcccaaaacttgtaagggcccctaagggagaaatgaggaaaaccagtacagaagcatcagccgaaagcacccctgaggaaagttatcctgagctgagaaaagaggggaatgagcaaatcaaaaaaatttgctgtcttctaggccaaataaatgcttaaaaagaggcttgcatctaacattgagaatgagctatcaacaagtaactaccagagaacatgaagaaaatatattttggccaaagtttctcagaaacatgccctaagacaaaaaaaaaaaaaaacctacctgtgagcactttcctggggaatgtgatcccagcaggcaggtgtgaagggtagggatgaggtagggtgtagagtgtattagttatctattactgcatgataaatgccacattacattccaaaacttagccacttgaaacaacacacatgtaattatctcacagtttctgtgggtcaggaatccaggagccacttagctgagagcctctcacttgggatctgtgacaagactgcaatcatgtatctgctggggccgtagtcatctcaaggctggacagggacatctgctccccacctcactcatgtggatgttggcagtgttcatactctcactctgttgatggcatcagttccttgccatatgggcctcttctcagggatactcacaaaatggcagactgctttcctgagaacaagggcttccagagagagagagagagcaagatgaaagccagtgcttttataacctattgtcagaagtgacattccatcagtgtttctgaatggtattctgtctttagaagaggttactaggtccagcccacactcgaagggagggaattattcaagggcatgagtatcatgagcccagacattggagatcattttggagctgcctaccacaggagggtggggagcacagtgcagggagagaggaagtgccaatacaaaatgggttagcaagtaggctaatatccttaagaaatacttctcagaactgtctatccagaaacagaaaggaaggaacgtttgtttattaaagtgttgccccagaaagcatgaattcattgattcatccaagttgtgcaaacacaagcttagagtgggatttcatgggaagtctctgtgcagcatgtgaaaagctcttgaagtagccatgggaccaccctaatgtggatggccttgagagagagtctataaccctgcacctgcaggaggctggaaggagtccgaatagagctggttgccatgtaggtgagaaaggaagattagagctgtctgatatgagtctgaactctaaatattgaagtgatggaaactgagtcttctgagggaccagcacagtcaaatttccaaatgtctattatttataaatgatcacatcctagtctcccaacattttccataacagtggctccaataaccacaggagagacaagacataaatctacatgttctattcagtaattaggcaaacattatcatcgttcacttaatcaaactcttcttggctttaatctgatattatttctttaccatatcttcaaaagcaataagattcttctcatttaatttttacctggaaatttatattatatcaagaggtctcatagactccaaaaattcaatacctggaaggaaccctaatgagtcacttaatttaacttcctctctccagacagaactatccctcaaccatccaactgtgctcgtaatatagatctagatctagacagatgtatagatatatgcctacatatattcctttctctttctctctctctacacctctatatctctagagaaagagagagagaaagggaggaagacacacacacacagacacacacacacacatatatatacacacacacacagagaaattatttgctgatgttgcatcaagaataacctctttgaaatagattggatgagccgggcgcagtggctcacacctgtaatcccagcactttgggaggccgaggtgggcggatcacgaggtcaggagattgagaccatcctggccaatatggtgaaaccccgtcgccactaaaaattaaaaaaaaaaaaaattagctgggtgtgatgtcatgtgccagtagtcccagctagccaggaggctgaggcaggagaatcgcctgaactcgggagccggaggttgcagtgagccgagattgtgccactgcactccagcctggtgacagagtgagactccatctcaagaaaaaaaaaaataaaataaaatagattggacattttttgtaattcttttgaaaaaaaataagctcaacagaaaaatttaagaattaggcaagatgaatttgttacaaattattatgggaaattgtcttaaagtcattattaaaaatcttagatctttacctcaaaatatgtgggcaagagaagcaggaaaaccaattaagaggctcttggagtggtccaggtgattgaagatggtgcccgcactagagtaacactgatggagatagagggcaggacacagtcagggtatccttggagattaaaaacaaaaacaaacaaacaaaaacaatggaacgtgctgatggattggatgtgtggaaccagagaaaaaagtcaaggatgagttctaccatggaatggccagacacctggtatctgcttcagaataacccaggtagagggatgtgagtggtggtggaggataagcgagtttgcccaagttgattgctgttgaagtggagtgatgggtgcacgggtttcactttgctattttgtcacttttctttatgctttaagttgtccacaataaaaatgtcttaaaatgccagtatacctatacttttaattgtaattccagaaatcaaactaagaaaacaatcagaactataaacaagatttttatatacagatattcatagcaatattatttattatattgaaatactagaaataatctttttgactaacagaaaggcaacagttgaatacacggtgataccgttcatatgacattcctattgaaatataatgtcttggaaaaatattaatgatttgggaaaatgtgcatgatacaatggtaagtaaaaaagaaacaggaaacaaatcatatatatgaaatgtatgtcaaaagaaaaataccaaaaaatttatcaaaatgttatcattgtgataagattatcagtggtttttattttctcattgtattatatataatttactacaaaggttatgcattagaaataagtaaacattattttaaagtgcagaagaaaaatgatttattgaaattcatctttcctaagcatgccaattaaaattacaagtgactttctttcattctgaaacaatttattgactacctattctttgcaaagcactgctctatggttattctatgttctttgctaggcaaaataattcacatttcagattagttaaaaaagaaaggaggtaaggttggagagagcaaaaagaaaggaatttggtattcagggagctcagggtaactttctagcaagacaatgtgtccagtttgggaaaactcaagtttaatagagttaatgaaaattctccacccatttcctttattgctgctgcctcaatatggtctcaaaaccacagataaaatatttcatatgtcccttttctatgaattctaacttcattatgaaaactaggagaaaagtaaatattgttcaatgacggctgctacaaaaatgtgtcagcattacttacaaaaccctgggaggcagagatataacattctctggaaaaaattggaaaaaatgagtaaacattacaagaatttgtcacaaaaagtgcagaaattacaacccaagctgttgaactcttcctagttttcctttcctttgctttcttccaggaaggctgagggcttcttataccctgagactgagtaactttgtagcaggtttggcctggatgaatatgggacatgcataagccatttttattatcttttgcctgaactctgtgaatacaaccaccctgcactgaaaagatgatggaggccgagccacatcatgcacttctcttctgtgacctgccaagttctagcctgatctccctctaacatagtgcagatcccaaatggctagaaatttcaatatgcccattggatttgtagagataatcagctctattgtcttctgtaggattttctcttatgtatagatcctccggaattgaaaggagtataacttttgctctgcagtgaagcaagatagattcttgacgctaggaaaaccaatgatgaattaaaatggtaaatgacccacatacaataattcacagttcatgagtctgttccatatggaaaggagtgccttttgtaacatttattaaattgttccaagacaatgttaaaaagcacaaagtatataaattcaaactaaaagtacagataaccaaagaatagcaagttaaaattttgttatttagtgcaataagatattcaattttttttttttttttttttttttttgagagggagtcttcctctgttgcccaggctggagtgcagtggcttgatctcagctcactgcaacctccgcctactgggttcaagtgattctagtgcctcagtcttctgagtagctgggactacaggtacgccaccaccacgcctggctgattttgtatttttagtagagacagggtttcaccatgttggccaggctgctctggaactcctggcctcaagtgacccacctgctttggcctcccaaagtgctgggattacaggcatgagccaccgcaccccgccatgggtattcgaatatttagactgacttctgatttctgatgtttgtatatttggggacaagaactagaaacagtttgcaaaacaagttaattagacttggatggctttgatctctagtgggacactcatggtgtatttttcagtatctcacattgacacatgatgattaccgtatatgaggtaatgctatacaatccatggtatgcatgaattaagagagaaatacgcagcatacaatcatttgagatgcagatttttgacagttaatttatattctgaaagaaacagatttttagctcattgattttgaagttgcatatattgctaaaggataaacaaccatattctcatttcttctgagcaaattattttccatgtagacaggcataaaatgacttttaaaaaaagtaaatgtctgtcaaaccttagctctctgcagaaaaacacctttattgaagatgagcgaacctctctaatagtctatttaaattatttttctcctttgagatcagattactaggagaaaaaaaaatagccaggctcttaattaacaatttcaaatgaatataaaagatgtggccatgaacaccagaataaatcttgtacccaaaaatgtgtaatatatctgtgtacataaatatggattctcaaagatgggataaacatggttagtaatatactgtatatatttttccccttaataaaaagctctctttatttatctttgacacagtggagttgtgagggaaagatgaagtgaaatagcatcatatttgatggtgggatatggagtgggggaggagtttacctagataaaccaacaataaaccaaaaacaaaaaacaaaacgtaggtacaaaatagtagagtacagttttatgtagtatagtagaatatgatatactgtagtacaatatagtatatatatatatatatatatatatatatatatattacagtatactctatagttcctggctcaaggagcttaggattcatctggcaagattatgaatacatcaaatccttaaagactaatgggattggttgctgaacagtatgatgcaactgaagctctatcaaagctcacaggaagggagttctgtgaaggaggtagcactagagttctgttgcaaataagaggtgtgtgatctatttaggctaaaggaaaaagattatgttgcccaggctgaggaggaaaagtgtgaacacaaattaaatgagctttatgcatttgaggaatgttaagagacccaccttaatattaagagcagggagaccatgttgagaaaagggaaagagctgctggattggttggtataggcaagtcataccatgaagcacctcagaaatctggcaagggatttatgttagatacgagcagccagtggtgggatgaaagcaatgggtgggatgaaaggaacattcacctggggtccacgtgcaggatagattggaacaggggatcctggggtaggagagcttccccgggaggctgatggactgatccaagaatgagctggaaaggatctgagggaagcagtgagaacagagacagggacacacacaaggaacaagatgaaagaagtcagtagattagctgactgagtatcagagtcataccaagtgactgaagacaaggtttcaaatggaacataaaaaaaaaaaaaaaacctggtgttgacaacactgatattagaactaggaaagatagttggttgtggagagaccagttcatttttacacatcttgagttttcacacggacatccaacaagtgtcttgaaactcgagatacaaaccaggggtttaaaaagctcattttggtattcagaaatctagggtgggaactgacgttgtaataattaagcctgaggttcctgcaaagattgcaggaagaaaaagccatagaaagtgaaaaattatatttttgctcctcacagtcactgtggatgtaagaagaaaagtaagtgaaggaaaagtatattagactcttagtatctcttaaaaatgccattgaaaagggtgccaaatagctaagaagatgatcataaaactttaaacctctttagtatctacacagaataacccacctattacgtagaatataagctccatgaaggcaagatttaaaaatttattcattcatgtattccaagcacttgaataatgtccagtacatagtagcctctcaataaatattggttgaaagaatgaacgaatgaatgaatagatgaggaatataggcataatggaactgatgtttttttttcactcaggccctacaggtcctttgatagggcaaactatatagcaattcacatttctaccacagaaaaacatgaggcaaaattcccctggattgaggctggtgttctacaggcagggatgtagcagggttggagaaggacctacactttatggagaagggtgaagtctccctgggatatttaaagtcattgccttttctaactcttccattattgataacacgctacgtgaagaaagcccggcacagccagggtgatctcattcttactaaaattccctgaagcatgcatagtcattgtttcagtcaaggccaacccagtatctgcagccaacattgctcctcccagaactgagcttcagcttgagtccactgggacaccgccatcccagaaacatggtgttctagcctcacatacttttggcgtgtgtgatgctggggtctccctgaaagggtgctgttttaactacaagaggccctttattcctaaccctgaaagggtttatcctcttgatcttgctgggtggttttctacaagttatatttaataagctgaggctgtctttagtcagactttggcctctctgggttgatgactaaacttttgtgatttcttactcccctctggtttgaggggtggtgtttctgccagaaggggacaaagttagtccaaaagcttctcttttcccatcaagagtcctgtttgctctctaaaaatctgaaaggagaagatttaggatcagagactttgaaggttagaagagacctaagagatcttctggtccagagtcctacgctcgtgtgaacaggctgggcagatgacacagatgggttacatgggagtgatagggtctgtgtcaaacaggagagttgatgccccaacccaagggctcacgttgaaggactttacagccctgtgctagccggataaagcacaactgggcactgatgagacacctgagccaacacagttgcttcatcttacagttgcggtatctgagacccaggcaaggagtgagagcactttgcgatagaaagaacactgcactggaaatgatgagacctgaggttctagacccgactctccacacaacaaatgaccttggcttgaggttgacctctcagaatctcatttccttatttggacacgaagtaggaaaatgagtaatttccctaaggtgttttgtgctctaaaattccaggactttccaaggtcacccaactaattagcggtggatccctaactggagcccacgtcccctgatagaatgctctttttactaaagtgaactgtttgccaagacaaggcagaaggaggaaacagcagaaacacctagaagccaatctttccttcttaggagatgttctcactgcttgggaaagctgtgaaaaccaagggggaggggcaactgagacaccttggagtcacatgtggggcttttcttttcctcctcacatgtctgttgagtgcccatgcgccccaaggcaggacttctgaagatggggtctcagaagttctgagcatttatgcttcttcccactgagtacaagtcagataacaccaaaaggaggatccaactgggaagagatactggattgctttgtttcgtttcattttttgcttttgtttagatgttcttttctgttggaaagtggagaagtaaagggctatttatgagcctctgcagcagcccaagatacattctcattccagggttctcacttccactgtctcatcttatcctcataatgatgctactctgagtaaagccggtacgtgtgtcctggtctacctccccagtctttcttagagcaactttccttctagctacaattttcccactacactggaatattctgttcctcaaagtatcaaattcattcccatgtcataactttgtgtttgctgctacctcaccctcaaatgtcttcctcatcccctcccccaggtcactacatggacagtcttccttcaggtctcagccaaactgtaaagaggagatgatttcgctgtctcaagtggcccacaaaaccaccaatcactatcacatttcttggttttattttattttgtgtgtggtgcaacatataagtagaattatcttctgtatttactttttattttctatataactcctttaaacgtgattttgatgagagccagggcccctgtcttgtcaccatcatattcccagtgcacagaacagtgcctggtccatagtgagtcagaataagtattccatgaataaataaatgattgctgaagtttccacagctgattagtggagaagctagactgtaccaagatcatcctattcacagttctttcccctaaaccactaagcctcagagcaacgactgtgtcaatgcactgtctaaggaagtaagtactaggtctggacttcaggacagcatgggttagaagaaagagccagttgacccaactctagtccaagttctgccatgaaaccttggccaaatcatgcaacgttaattttagacaatatcttagagatcacctagtctgaaggctttgaacatgtttatggcatcagaaaactttattcaaacacaactctaatatgtaaataaaataaagaagtgccactctgctaaaagcagaggagagcccagagcctgccttccgggtctattctttaccccagttaagggtcccctctgaagcaactctgtaaaacgtagatttaaaaccactgggtagcccaatagcccacccagttcaagaatccctggaagcaggatgcctactccatcagggcagcccattctactgttgggatagttattaggaaggacaacctcttcttgggccaagcttcccatttcacagaaacgaaagtcacttctctccagttctgtgccagttgtcaaaaaacaaacaccagcaagctatggcccccgtcttgaatgaaacagacctggtttaagaccagctctaagttacttaacttctctagcctttaaatacctcttttgtaaattagggataaagatatatcatggggctgttataaagatcaagggcagtaatgtgaaagacataatccaatgcctgacacaggtaagtgctcaataaattgttgccattctcaggatcatcttggtcattactattaccacctcacccccttaccaccaccaccattcttcttacttcttctcaaggaaactacaggctactcaaggaagctagtcacatcagtaagatataattcatcatggtaaatttattatagaagtgtgccccaatttttaaaaattattagctaatagcatcaggatacttacttaccaaacatataatagccatttatttctccactatgctttgaaacttttcaatttttcttggccaggccaatgggaatcatttatattctctaaggtcttacaacacacagcagcatcagtatcacctggaaacttgttagaaatgcaaaattgcaagctttactctagaccttctataacagaatctgcattttaatggaagctacagttgctctacatgtgcattagagttgagaggtcctgcccatgtttcaatttcttcatctttgagctggggagataactattagctctgcctacatcgctagggttcatgggaggactgaatgggatgctgtgcattaaagcaacttagaacaaatcagctgtgaattcctcagtgcctaccagattcctttacacacagaacttgtggaacactgattgacttatggcaggactgtcttagtatgctgtcccgtttgaactctgcttcaactgttgaatgtctggaccttcttactatctttgttttatgaactacgtaaattttctgtgaacctcaggaaattccattaaaatgatttctgcctcagagcgtgttcatgtcctaaagcctgcctggtccctgtgtggtcatctttcagaattcactctgacctacagttattgctctcactctattttatggaacattttcagccagctacatgatttaatggttttaaacacatcattattgccattatttcatagctcacatgcctaaaataatacatgacacatttttaaatgcatctgagatttaagttttatcatctaggaattaataaaatctacttattaaatcttgccacccaggatatcaaagtcttggttctagctggcagttgggtggtcaaaacaaattttagggggatatactctgaggtatcacaagaagttaggagccaggaaccacatgggaaaggaaagccttatgtattagtgtagccaacaccctcttaggtggcccaacataaaaacaaatgattcaatagttcaaagcccccaaccgatttcacagaggtgaccaatgtaggcacagttattacaaaatgctcctcaaagtctccagagggccagttatgagtcacatgttattcaggacatatgagaaaactgggaaagatcaggaagaagcctagaaagacaaaattacgaggacccaaggcaagggttcgctaagtcagtaatacgaggtcagccccctaggcacctagaccagtattcaccaccccactgagccttctcttcataagggctgcaaaaagatacagagttatgcaacaccagagaaccacaaggaaatggcccatgttagggacaccaaatgaccgtcttctccattgtttctggatcctctcttctgttacaatgttctctgtttcctctgttgactttctagtatggcttattccacggggaagtttcctagtctgccttgccctggtgacatgggatgagataggctaggaggaaaagtaaatgttgggactatgagccaagaagatagtttgttgaggaaaaatggtccagccacgcctctcacaaacacatatgtacaaacacacacacaaacagattctatgtataaatgtactgtgtgtgtgtgtgcatgtgtgtgtgtgtgtgtgttttcccacctaattctttcttggtgaaaaacttcactagggtttgaagttggttaggagagtcccaattgtctttgttggacctttctagtcagttattatcctcataaagtcaggaagcctagatatgtctcccaaccttttttttttaaccagagacatagcatgtcttcttcatcaaggcatctcttcctagctttcaccctttctggatctgcagctcctcatctgcacacaccatgtaggtgcaccactgcacagtcagagctgcgaatcagagctgacacaggaggccaggccagactgtccctctcatgtcttccctgtaccgagcagcactctggttagcatgaggtattggggagattcttagacatggaatctggggtgtgtttcttttttatttttagccttgtattttgaaataatttttgatgttcaaaaaattgtaatagtacaaaggatacccatatactctagatttaccaattgttaccattttgccttgcttgctaattaatcattctctctctcctctcatatatatgaatgcacaccacacacacacacacacacacacacacacacacacacacacacacaccccaatatagaagattcctatcaaaacagcagcaaacccatagttaatgaaaactttcatgtgcaggaggatggctgtggctgcataggatctgaataagggctcccccttgtcctcccacactcagctaagttagaatggctctcccaagccagcaaacatgtctgccaggtaggttataaccccttggaagcaagtacatagtgaggaaaggcagggctgtcttcctctatcaaaatatgctatttagaattttcaaggtttggccagactgtggactatttggaatatgagctctcaaagaatagggaataagatgcagactcgagtggattaggacagatatttaaatgtgttggggaaaattgagtttcagtattgtattttaaagtcatctgttttagccacatttactttgatgtgtaaggtaaattgttcaaaggaaaatcccttaagatatgtttataattctaagagagtctcacagtccttttatactggttgagttaatttgtacaataaatcagacaaaacatagtgagagggttaattttaactatattgatgggtgaaattagtatcttatgatgtagttgtcatttgaagtgaactgttttccacgtatacattttaacaaatgtagtttcccaaaacaagcatttataatcacaattcaatagtccttagaagaataaaacaaaccttagaatatttttggcaaacagatttacacagaaactggacaatgacaaaacatatacttaaatgttaagataattagtatataaatatctgctgtcttttatctatctaaagaaaggttgtaactaacatagtgctttgattttttagagtgtgttgcttcttagtctctaaagtttgttacttaaagaacaactcatgggcctcttgttttaattttaaacaaagctgaattaaagacatttggagattttaaaaatgtatttatataagtggcttatatgtgcaagattctattctagacaccttaacatgtcctggagaagcagacatcatccccattttagaaataaaatcctaagatttaggaaggctaagtaacttgtcccaaatcacactacttatgagcagcagtcttgggattgggacccagttctttctgactctaaagctcattaatttctgctatgcgccctttggcttccttgtcaggactgcgactattagataaacagcccatgtctcctgaggcaatgtaattcattccaggtgaacctgcagacatgggtagcagcaacttgggatagcattagccatcttgtcttgggaacataatccatgagaaatgctttcttccctacacaccatgtgtggctctctgtggctgcctccattcttctcaacatggagtctccaccaactgccatggatgtgtcccttcctcctcaggctgggataataggtttccataatccacccacacttgaaaagcctccttaatatgtgggagcaagaagtggatgttaccgctttatttctgaatgttctctctacaggtccaacctcttgaatctcatacagcttaaaggatgtaatttctttttttcttttcaacaatttcttgtcatactttcaacttccagcttcttcgtcaataatcttttccctcctggattcctactctaagtattttatctgtcttaagaatctcttcgtctcttctaataaacggaatattcagtgtctcttaaggcttgaagtcttatcttcaagctcagtccctccatgactggtgattgccttatgcacaaaagcaaacacaacacaaacaaggttactagggtaattttctctgtgtgttcagagtttaaatatatgatcatggcttcctttggaaatgtcaactaaaaatttgtaatagaaataggcaatcaataataggaaatacaacacagataaagaagatatgagagatgagattgaggatgtttgtaaagagaatttcaaaaactgcaaagatttaaaagactgtaaaaggcaagaagcaagaaccccttattaactcctcaaactgaaagacaacctatttgtcaaagaaaaaaaggctgccttgaacatctcactccctaaggattcataagactggaaggtggaagaggaagctgaagatgatgatatgtcgggctgttagtccatgggacacgtggactccttccacaggcaggtgttactgaaaggtttgcaggatcatctggatgcccgctgagagttcactcactcccgtgactcactgtccggcctgctggaaataggtgcaagtggaagcatggtacatgtgagagaatccctatgatatccaaggtaaagggatacgatggctgtgaaagcacttatggcaggctccaaaagaaacgcatcacacccaagcaggagaaagtggggttcaagaaagctcctcacaagtcactgaaatttaactccgaaagatcaaaaagcacaatgcctttcaactaacaaataaacccatagattcaaggcaggcactgcagacgttcaggaaatacccagcagacacagagaaagcaaattgctgagttccatctacaaagaatttaatatcacatatgtcatgacgggaaacaacacatgatctctttcttgatttgaaccaataaaactgtagtatatcaccaaagacgttaagaaaatgtgacatgtccttttgaattataagttcaagagagtaaataaatgaaattacattttaaaaattaataattgcctatttactactaaattcatcatgcaaagacttcgagtgagtgtcctattaaactgtccaagtatttaataaaatactcctctttggaaactttttatgtatattagtatattaaaaatattttaaacttattttaatacacttctcaatattccaacaagaaaatatgtggcaaacattcaacacccacagaacagcagtttaggaaatggcagtgtaattgtatgaaagcatctgaatgcataaaaatatgggaaatatttaaatatcttttgaaaggcttgaagctatagtaacttacaataataatttacaatgataaacattcaacaaacctctgaaggaaaatgaactgatcagtatctgttgtgtgtagaaaataaaggcacagactgttttttgcctgacattgttggaatccccaggaaaaactgaatggatttttgtcactcagccatgtcatagtcctcagcaactgattttcattacagtcatccatagcttaatgacaggaatacattcgcagaaatgtgtcattaggcaatttctgtgatgtggtgtgagcatcatagagtattcttacacaaacatagatagcatagcctactccacacctaggccatctggtctagcctactgctcctcagctacaaacctgtacagcaagcagttactgcactaaatacgggaggtaattgtaacacaatggtgtttttatatctaaacacatgaaagggacagtaaaatgcagaataaaagataaacagtggtgtagctatatggggcacttaaccctatcaacactgtacacctaagttatactacatttatctttaaaattgtcttttttcaataataataaataaggtttcaataataaaccttaatttactgtaatttttttactttacacacttaactttttgactcttgtaataacataaaatgcaaacacattgtgtagctgtacaaaaatgttttctgtctttatatccttattctgtaagctttttctatttttctttttttaactttttaaacttcttgttaaaaatgaaaatacaaacacgcacattaacccagacctacacaaggtcaggatcatcaatttcactgtcttccaccgccacatcttgtcccactggaaggtcttcaagggcattcacaggcatggagctgtcatctcctgtgataataacaatgccttcttgtgg

SEQ ID NO: 25 - DNA, 192047 bp, Artificial Sequence
  Synthetic BAC sequence
aaattcaaagttgaaactcatgactataacgctatgctttctctatatattatatactccaaaacaagtattatatattttatactatatatattatatattacatactccaaagtatttcatatatatattatatactccaagtatatatatattatttatatatatacacatacacacaattgtggagtatataatatataatacttatgtgtgtatgtgtgtatatatatatatatatatatatatatatatatatacacacacacacacataatacttggagtatataatatgtaatatttggagtatacatatatacttcaagtattacctggcttggtttcttcctttgaataagagaaaacaaattctacacatacagagagaaacactgtagaaagttgagcctttcaaccaggcatggtggctcacccctgtaatcccagcattttgggaggccgaggcgggtggattacctgaggtcaggagttccagaccagcctggccaacatggtgaaaccccgtctctactaaaaatacaaaaattagctgggcatggtggtgggcgcctacttgggaggctgaggcaggagaattacttgaacctgggaggtgaaggttgcagtgagctgagattgcgccactgcactccagcctgggcaacaagattaaaactctgcctcaagaaaaaaaagaaaagaaagttgagcatttcttctaggcttgaaaatacttaatcagactccagagcggcaatgttagctatgcccaaaagccatcttttgtgtcaacatctctggaaatggaaggtttcctgtgtctgggatctggctgcactttgatttcagactacagggtacatgacataccctgagagatacagctgcacttcaaagttcatcctatccaaggaaaacaagtatacgcttaacacttcttaaagcaggctatttcttctaccccttgttattataatcataacatttatcattatatttatgcaacatattaacaaaagtactcttagttctactgaaaggaagcataagaaaataacttttatcttctgaatgtacaggcattactgaacaaacagaaattcactcaacagtctttctaatgtgaggaacctatatattaagtgcattgtgtttcccaaacatataaagcctggggccacgtactgtcatctggctcctgctggtgttataagttcagtaagttaaggctaaaccaggtgatcgggatcagaattttaccagcctcagcaaacagtattttgatatatttagaatcatagtcagttgctgatcagacattcttggaaattgaccagatctgtcctctgttacccagattcttcagtaaaatttcatcttcaccttggggaacaaaagggatggaggaggggaaaaagagcaaataggaagtaacgtgtaaatcttcaatgaaatagtccattatttgatatagaattaccttggactgtcttccaacctctctaccatcccaaacattctagaaatccaaagggagcaaaataatcaaacccagtaatactgaaccaaggaggcctctggcttttatgacaaattaataatagatctccttggtaataaagttcaatattagggtgacccagatttgtactagtataaaacctagctggactggtaaagttaaatgacttttctagcacagcaatggggctaataatgacaatcatgtatccatattacatttccctttccaatttttgtggctttatgacttaaatcacagtattattgttaacacagggctattattataagactatagtattttaccatttttctttgaataaaagattttaaatgtctgtaatattcttaagtatggtttagttttttgtttgtttgtttgtttgttttttaagacagagtctcgctctgttgcccaggctgaagtgcagtggcacaatcttggctcactgcaacctccagctcccaggttcaagcgactctcctgtctcagcctaccaagtaaccaggactacaggtgcacaccaccatgcccagctaatttttatattttttagtagagatggggtttcaccatgttggccaggttagtcttgaactcctgacctcaggtgatccaccgccttggcctcccagagtgtttggattacagacatgagccatcttgcccagccaagtatggtttaattttaattagaatttgtatatattagttttcaatggctgccaataacaaattacctcaaaatttagtggcttaaaacaatactttaggctgggcgcagtggctcatgcctataatcccagcactttgggaggccaaggtgggcagatcacttgaggtctcgagtttgagacgaacctggtcaagatgatgaaacccaacctctactaaaaatacaaaaattagcctggcgtggtggtgcacacctgtaattccagctactcagcaggttgaggcagaattgcttgaacctgggagacggaggttgcagtgagccaatatcacaccactgtgctccagcctgggtggcagagtcagactgtcaaaaaaaaaaaaaaaaaaaacctacacttgattatcttacagttctgtcgattagtctggcacgtgtgggccaggctgcattcccttccggaggctctaggataaatttctgaccttgccttttccagcttccagaagctcccctcatgtgggtgtggctcaggaatgcctttctcaatcttcaaagccagcgatggctggtcaagttcctctcacaccacattactgtgacctccttttatgcctcctaatttcacttttaagtactcttgtgattactcttgtcccatccaggtaatctaggataatctccccatctcaaagtccttaacctaatcacatctgccaagtcccttttgccatgtaaggaagtacactcacaggttccaggaattaggatactttgagggtgcattattctacctaacatagaatccaaatttttttgtggagcacattgtctactttttataattgaggacaatcagaaacaagatttgtttatgaggaatttactttgtgacagcttgtgccagaatagaactattctgttaagtaaagattacttatggtttggattttgagtggatattcatattgcaccaaacttatgtataccaaatgaaaattcagacttacctaggccattggaaaccgtttgcatatggtgggacaattgtttctggggtaggatgacctaatggcaagaagtcattaagttttagatccatagaagtataaacaaaggacctcccaatgaaaaaaatttaaatgactcaaagtattaattgacttgcttccatatttagcaccagagaaaacatttatctcttaaactttaatctcttcaaacagagataaaagaaagacagactttatttctcttctaggtaatttaattcctttgggttgaatacagagaaaacacaagagccagtatgtagagttgccatgaaaaagcattgctccaaatgaccggtttagagtcaattctgaaaattctatagaggaactggagaaatttctaaccatgaacttgatgtcagaaatgttacaggagtccttctgggaggcggccaggttgggggtggtggctaatcatttcaaagagtctttgcagtctgtaaactctctgttctaaatataccagtgattgttttgctcactgtataaaagattcgattatttttaaaagatgcaacaagctcttaatcaaaattctgatttatagtattatttgaacaaattggctaaagtgaataatttagttacctctacccaaaatatactttaaaaacgcataggggaagaacaaacaaacaaacaaatgcatcagctcttggctatattctaaggtggattttaatagtttcattatatcaaaatcctagaagcaagtgtaatactagtccaaagcttgaggattaaaagagccatttaaaacgctgactgctttgcttcctctttcagtgatgcatttgattttgagattggcgtggttatagtcagaatcagccaaggatttgacatctctcaggttcttcaggtgcaaggtatgtactttctttattcaaccaacaagtatttattgagcacctactttgtgcctgacattgttatgggatacagcagggcacaatatagacaaaactccttgacagtggagcttacattctagtgctactcgtagtgcatatagttcccccagtattttcttcaatgctaagacaagtagcctttgccctgctaaccagaaatatagaggaattcaaggtagtcatcaattatttttcttatcacaaaaccacaaagccagcatcaaggaaaataaacaccttcggtaaaataacctgccaaattaatttctgcaagatgtctcagaaaatgaagattaattctttccttggaaaaacacgtattttgcttttgagagtctatgaactggtttgtagctaacatggaaatgagcctgaatgtatcatgctgtgaatcactaatctaagtcagaggcagaaacactaattcagatgagtgactctttgttttttccctgtagagaatttggtatatttgcttagtcttagaatttaaacatactcttttgtgtatgaaataaagaacatattgatatacttactgaaaaattagcacaagacatgaattcatgatttccctcttccgctgagcttcacgacagagtccacttacaacacaacattaagaaaaaacaatgcttttctggtgcctgttatgtaccaggcatagtgtaggtgcaagtggtgctgggtagaccaagattaataaattctgtcgtgccctcaagagacacacaacctagtaagggaagtagatcaattattagcattataataggtataaataaggaattatgggaaagaaagaaggggcacctaactcactccaaaaaggcattctggcaaaaattacctttgatttgcgatgcactggatgagtaggagttaaccagacaaagttgagggagagaaaagtaaggagacagtttggagaatgcattcctgacaaagaggaaagcatttgtaaaggtgaggacatgagaatagagaggaatggaatatgtagacaaccaaaagcagattcatgttactgaattgaaaagtaggaagccgacaatagtaaaatatggggctgccactataaggaggatctagactgtaaaagcctcatttgtcatattaaaaagatggatcacattctgtaggtaatgaggaaccatcagagagattcaaatgagggaataaggtggtcaaacttgggttttagatatcatgctctttcggttatatggggcatggactcaggactagaatggaaatagataaatcaaagagttctacaataatcaaacaagacaaggtgacagcttgaactagggcagcctcagtagggatggagagaaaagaacagaattgaaaagtattttgcaggtacaaagagcagcgtttgggagttgattgaatgtgtgggatatgggaaagggaggagtaaagaaaaactccctggctgactggatgagccaatggaaatgggaaatgcaagaggaagtataggtttaatgaggagatgcctggctcaatttcaaacaatctcctctgggaaatcctacgggaaatgtctaataggcagttagacagtcctcatcataaaagagaaatctgagctggaaatacagatttaggagatgttatgggctgaactgtgtctcccccaccaaattcatatgttgaagtgctaacccccaggacctcggaatgtgactgtatttggagacagggtctttaaagaggtaattaaggtaaaattaggttatttgggtgggccctaatccaatattactgatgtccttataagaagagattaggatacagactgaggggtgatcatgtgaagacatggtgagaaggcagctatcttcaagccaaggaatgaggcctcagaataaaatcaatcctaccgatgccttgaccttggacttccggcctccagaattgtgaggaaataaatttttattgcttatgacaccctgtctgtgacacttgttatggcagcctgggcggactaatacaggagacatcatggctaatgtggattgaaaccaccaccctagaaaatagaactcaaagactgcatgtagccaaggactcgaaagtgtaggaaaaaggccccaaagaagagaaggagaagtcagaaaggtgaagaaaccagaagtctggggtcaggtaaaccatgggagtacagtgctcaaaatggggagaataatcaacattgccaaatgcagcagaaatgtacagtaagatcatgaatcaaatggaattggcatgacataggtaatcttagtgagagcaatttctgtaaagcagggttatcagaatcgagattgcagtgggttgaggagagactatcagatgaacaagcagagaatatggatgtagccaacccttctgagaagcttggatggtaacaagaggaatgagattgagcaggcttactgtggggaaactatagatctctgggagatcaaatcatgtttccagactgaggaaatggcacaagagagtgaaaaaattgaagacgtaggcaaagaaaggggcgacccacggagtaagatccaggaggaacagaaaattgagggaaaggcatgaatggaagagttggcctgaaacataaaaaaattaaaaaatttttaaaaattaaaaaaaaaccacttcatctaaaattggagcaaaggaggtgaggattgatgatgggatatgtggatttgtgagagtagagtggtaaattgaagaagatgatgcacaatagtctcaattctttctattaagctggagcaatggtttacttctaaaagcaagagaggaatggtttaactgagaatgagaagaaactagtaagcattttaaaaagtcatgatggagaatgaaaaagatcagcaagaactgatcagtgtacaacagtgaaaacccagttgtggttgtccagttttctctggcagcatgaagtctccaaggtacaggagcggcatcagggtatttctgagagtaggttcagcagacagaaaaaagaattcttaagggctattgcctgatcgattcatactctatttgctggttcattattgtctacatcaaaacaggaaagaatatgagtggattaggtgaattttctgatgcaaccattctggtatgttgtaggagaagaggaggacgaagaaaaaaactagagatcaagtgtttgtataagacagagagctactatctgattatgtatactctatgataatgaagcattaaaaaataaaacagcgaggagagtgcatcctatgcaaaattgtagcacaaaaggttatctcttggtgcctttagccttcctttttatgccccttttcttctttatggacattttaaatctccagatcagaaatactaactcccactcagtgagtattcactattaatgtatattccctcctagtagaacttaatactttagtagcaacatagttaaaatatttgagcacttacgtgaacccgggaggcggagcttgcagtgagccgagatcgcgccactgcactccagcctgggcgaaagagcgagactccgtctcaacaacaacaaaaaatatttgagcacttattatgtgccatctattatgcttcttgttcacacatagcatttatcatcccagctaccctatgaggagagtattatcattgtccccattttacaactggtaaaatgggggcttacccaagattcacaaggctagtcattggtacagctgggattcaaacctgtatctgtttgaaagcccctattttatctttgaaaaagaggagctagagaggatggtgacatataaagagaggcaatggtgaaatctgagctctgggaatgaggcaaagctgtttctatgtgttccttaagacacccaacaagggggctgcctgtctatggtaacatagacctgactttgagggcaattacaagaacttagtattaagagaactgttctgttgcgaacttcctaggttttactttaatttttttctcctggcttttgtgctgtaatgttttccatctaaaaatgagaatgcaaaatataacttgtatttagattacacatttgctttgtgtgttatgttgatctcttcaagctgaaagatgtgatgtagctgaaaagcattgctcccacccctcattgttccatctgccaagatgcaccatcaatttacttctataaagcaatacagcaaccaagttttgcaatatttctcaaataatcctggcagtgaactgcatccccttttaatttcccaagggttgtatcctatttaaataaactttgatgtttgaaatatttctgcttcttagtcaagaaagggaaaatgcaattggatgctaataaaataattacaagtaccaactatctagggtaaacaaagaaaaacaatgttacacaaatacatgaagaacacgcagaaaaacaacatgatagaaattaactttccgccacatttccatgcattgttttgaggtttatgtaatttacgacacaaacctcttattagattttgaattggaagaaataaacttgcatttcattatattatgctgtaattcagggcctaataagggcctaataaatcttaagtattgcattatactatgttaatgattgtcatcatagcttttccaacacaggcaccacagtgtcatcacagattataatttaaaggaaatattagcaattcagagtgcccatatactgtagttaataaagcagtgaatagaaatcagctttatagataatttaccagctaacgacaattatttttatattgtatcacaggcttatgtgagaataacttttaatataaataagatcgatgctcataacattgtaacttgtatactgtagcaactcatccaatactgatgactgatagtttctcttaataaattattgcctgacaacacacacaaaaaaagccatgatatttcatactgctcacttcccagaggaatttagcaagttttccaactacaacaaggagtcaaaattgtactggtaagaaataaagtgatggaacatgatttgccatatattgtggtcaagtattccatgtaagtacagcatgatttgtgaacatctcagagcacggggatactgctgtgtctgatcaagtggcttagcaaaataaagacagatggcagtgtagtaaataattacttgattagaaggcaaccactgcaggattgcttcctgccttcaattcaactagacttcacctggggtacagcacattgattcatatgagcatttacagctttgagttgattgaccaaggaaagaattacaacttaaaattaataaagaaaaaggatgctgtaaaatgggaagggattccattccccagtgggtttccctgctctcccttctggtgtcagataattaacgactctctatccttaagattcaaagcagattgtaatttgtagggcctctgcctatttctaaaagatatcttaaaaaaaaaaaaaaaaagactggggacataacatttgaagcaatcttgacaagtaaattgagtttcaaaaaataatcactccaactgggtaccatataatcgatttataaagcacttgaaaatacagtaactactattcaaagtacttttggcatttacatgacagtatggctcaagagtcactcttagttattactgtgaaaactgtttgggatgtggatgacaaaattgattagaaacctgccctcaactgagagaacctacaggtctaagctttttcttccaccgtcataacttcaggttgaggttataaacatcttgaaaagagagaagggcaggcatgctctctatatccctatttccatatctcgatctctatctatctatctctatctctatctctcagtagcaatgtggccttataaactatgacatactacagaattatctaatgtattcaagttcccagtaggtaccattaaaggatttccaggtggtggtcttttccagggaaaagtcccctctccttccccacttgcctctcatgcttccatttcccaggctcttatctcactggtcccaccttctgtcctctatctgccccttttttatataactttgtatacggtattaactgcacttctttcaaacattgtcttttgtacttaccacacacacacatacacacacacacacttctcacacccccattcttcacaactctgcacttgtttttcttcttttataaagacagtactttcaaaactattgaactgaattgaacagcattgatctgttctttaatttatttcaacatacaattcttgagtgcctgttggtgcaaacatgggtccaggtaataaacgggaggggtggcagcatgaagaacatgggagggataacatgaggtccaagcatagcgtttggaatagacagacctgggtttggatcccaaatttgacatcttttgtctgtgtgatgttggtcaagttacccatcctctctgtgtttcactttttgcattttccaatgggaataattatagtacctacgtcacagatttgttgttttggattaaagaatttgatggctgcaaagtgtttggcattgtacttggcatacagtaaactctcaataaatgttggtgatgaaaaatggcgtaagttctgccctccaggagtctggagtccattgtgaataagatagacatccaagtcacacagttatagtagttagtggaataaaggtttaagcaaggtattacggaaatacagaggagattgattctgattgagaaatttggggatggtttttgaaaacatgcagactgggtgttccttcaacaggcagctattgcgatcaaggcatatcactgaaggagaagagagaagagggataaacactagaattgggagcagaagacttgggtcactagctgtgctaccttggacaaatcacttgaactttctgagcccaagtttcctttttggtaaaatggggagaataataccagctctgcatgcatcccagtattcgtatcaaatgagatactatgtagaaagggctttgtaatttctgaaaattaaaaatgtagtcgtgatggtggtgatgatagaaaaagtaatttttattgtcaggctagtggaaatcaacttatatccattcgttcatactctcttggctggctccccttgtggctaatggtatgcctttgcaagtcatctggccagtatttctgttgacaaaaatgtttagacaaagtctactcttaatttccctgcatgcaaacagaggcaagcagtacaccagatagatcattcagaagaacagataatcaaaacatcacttctgtttagtgttgaaatgcgaaaaggaaggagtgcacagaaggaggccttagatcacctaccaagtgaataattaagaattaacttgaataagaacttgcgaaaatcactatgcaaatgggaatcacaccatggtatggatctgaaaatccaagatggcaaagcaagctgattttagcctttagaataaatactctctgtaatcttctgtctctatcatctttgaggaaactgctacatctaaagcattcgagcaaaatttgattttgtctctcaggcctgcaattttgcagcttgctctgttctggatgggctgtgcacataccttcaagcaattgttggaatcgctcccagttcactcagcccgctgactccattacaaaagaggatttatctttctttccctctttgtccaaactagaggacaaagagcatggcaaccagtggctaatcatagggcgcactggagcctgcccaaaaaaaaagaaaagagaagaatcccctcccagggcagcccttacagttgccacatcagaggactgcaaagagcaggttaccccataagtggcccctgcaataccccagaagacaaaataacagctaggatgccgtcatccaggacagtgacaacaaagtctgggtaccagtgctgctgctctagtgcagccttccatatagaaccgtatctttagggtcctccttttaaaatgacatgttggatgggccatcattttgggggattaacttagcccattacaccatatgcctgagagtgtttaggtttatctgatgataaagcataggaaggtaataaaacaactctgaaatagtaataataataagccacaggaggaaggtcttcatggtgggaagcatatgcagatctctttgcatatgaaccctgtaacttgctgggtgatatcaggcaactcacttaacctattagtttcttcatctacaaaatgaagatgataatagtagtaactatctcagagttgtttagaaaggaataaaatgcaacacagtccctggcacccaaagagtgtgcaataaatagcaattgctaaaataactcccaggcatctcaaaatactcaatttgttttgcatgactaggcccatttccaaaagttgcataaatatactgcctatagaatgccattcttgctctgttttttaaggacctccaaaacactatgcagaaactttgtttattctttttgcaaagcttggggggtgggaaaaggaaagggttacagttttccatttcacagacgggaaatccgaggcatagaaaaagtaaattacttgcctaatgtcacataaagccagcagcagagctgtaattggttgtgaccccccagtgcaatgcagcttgtcttctcctttcaaaagtcaggggtaagcaacttctgtctcagctttaataccatcagtctaatttctcagattttctatagctgctgatcttgagaacctttgaagctttggggaaatcacatgggtgatttgaccttaaatctcatgccactcgcaaaagattaattgctaagacctggaaaggggccagacaattctgtgtagctgaatagcagcatcgtctagggatgtgactgtcctgacagatttagttagtacataattgataaatctagagtttgtatagcttcgcttcacagatagataacgcaatgggctccaagggttgacatttacagaagctctcccagtgttttgtaacactgaatctaggttttctatcctcttcctctgagcattgctcattttctaaggctctgttctcagcaggcaataagatgagggcatctgacaagagtgccacctcacccagtataagcaagaagcaagaagcctcctaagtgtagcactgtcatatgactgctttgaaagtcttatttaccctgattcagtgcagggtgaggtcaaagagagatccagcacattacatagcagctaggaaattttcgtcacaatcggaatccaaaaaagataaaaggcagccagatacaacatcaaagcttggatagtgtgtctcaaccttgggcaggaaattttgcactgcttgactcctgttccagactaaaacatgtcacaagaccccttttagcaatttgaactctgacaggcacccagaaacctcagcttttatttctttgactttggtcacccactccacaaagttattttgcttattgaaaggaattggtggtggatattttccattgtaatttgtatccagagcctatagagtttattgtaagattttgttatcttttcttaattcttgctgtctagttttatgtttcaattcatgaagcattgttgtgtggctgatatatactcagtgtacttctgtaattttgtcacttccagttgtaaaacatctgacccactagcttaggtcagtaaatcagtggcttacagtgtgaaagattttctgtttgtttgtttttgcatggtagtgaataagggtggcattaaatagcctctcttgccctcacaaataaaaatgctgtaacttcatgtatcataacttaacacatagagctgtttttctaagctagttgtgacaactttctgaatacaatttactaagatacattactttttctcttttcttttggagacacgatctcactctattgcccaggctgcagtgcagtggcatgatcatggctcactgcagcctctacctcccaggctcaggtgatcctctcacctcggcctcccaagtagctggcactacacaccacacccagctgatttttgtatcgttcatagagatggagtttcaccatgttgccaagtctggtttcaaactcctgggctcaaacgatacacccatcttggcttcccaaagtgctgagattacaggcatgagctacctcacccaaccaaaatatattacttgtattagaagataatatataaaaatcatttagaaaaaattactatgtataaacaattattttatcacatacataccattttaaatattaaaagtttataagattgtttctagaaactttgtagttctgagttaagtaggtgattttgtcttctttcatcagaggaattagagagattagaacaggagagactagcattggaagcgactatcaaagataatgagtgtgaagaggaaagtggaggcatccgaggcttgtttaaaaaagctggcaagttgaacattactaagacaacgcctaaaaaaggtaagaactttttaaaatttgcaaaaaagtttacaagatgagtcactatttgagcatctatgaagagtccgaagtcagcatctaagatgttgggagcattgagtgtgggtaggaactgaaaggtttctctccagaaggtagtatggataaacggtagcagctattgtcatttatcaacctcattaagtactttgtaccatcttactgtcaaaaattattttttaaatgtaatatttggtttggaagtcaaatagtgcttaagcagattgcatgccataaaacagaagtttctcagttaagatggaaaggggatagaaatttaagagccaatacccaaactgtcttatccacagacacccttacctttcagacatttcagggaactgaaatacgactagtacatgcaaatacggtatccagctggaacgctgatttcaacaaaagcatctttatcacaaaccagaatgcacgacttagaactttattggtactcactacctgtagatttcatctaaatgctacacttatatgtggacttatggtatgcagtcctgggacaaaggatcagaggttgggagagcttgttacacattttataaacagatgattcaaacgtttggttttttgaaaattacttcccgaaacgctatgggtttgagtttaatgaggtccacagtgacctctgctggtcaaaaatcagaatgttaccaggcatttgtttatgcacgaatgtcctgtagttactgaagtcatacactggtgtgaggccaggaaaagatggtttctctgggagggtctccaagtcaaacagcaggatccaagtggagacttagcaagcttctggtctaggttgaccggcgccaaccctttaaagaggcccttcgacaaggccatctcctaccctgtaaatcgtttgtctgtttgctttcctactatagcccaaggacgaaatttcacctgtaatataatagttttatatatccacagagaatgatgggaaatccagatattgccccacttcaaatactctggctactgtcgagctcctgggataccccatgggccgtggcctactccttacagtccaccttaaaatgacataaatgatgtgtttgaattcaacttgaagctacatcaggacttttagggtgaaaatatttaaataagactgttctggatgctaactattatcttcttttctttctaattatttggtttaactgtgaaaaaagttaacaatccattaaatctgctctattaagtggtacagtctggaaaataatgggaaattccaaagtcatagcccaataatgtgctccaactagagagagggaagcattaatgtccttattatgacagcgggacttgttatttattctggaagcttatttctgcgtcacaatacttgttttggcaaaaatatactcttccaaaagtcaacatgtcaaattgttcagaaaagaaaagtaataatgttatatactgttttaatacctagaagtttaaacacagctctaaagtgggcccattcactactctgggcttccattgcttgtcaactcttttgagttctagacgagaaccaatcctgcctccaggtacctgagtgtgaacaggaggcctctggctgctttgacttgtctgtaagtgagggcagagcttggtccattttgtaaataaatttttctccctcagcggtcccagggatgtaaaaacaatatcagatcattgcttcagaactgacagactctaaacatggaaacaacaaaagataaaacaaagcatcttcagaacctcttagatcagagaggaagctctgaagaggctgtcagccctcctctaagcaccaggctgacaccaccactttgaaacacagcaataaagtcatgactttcaaagacacagatatgagaaatgctacgtacgctgtggcaaataaacccctcttggcaaacaggaacaggtccagttccaacactggccgagttccctggtacactttcactgtatccatgttagggtagaaatcacatttaaaaaaattgtaactattttatatacacccttaattataactcaagtaaagatgttttgtatttccatattttctaaggttttttttttttcatctaattcacaaagattcaaatagctcaaatggctttactttagcttcgcaagattccttgaaaagaaagcagaagagtaagccaggccaactaagagactaaatagtcatagagttcaagatgcacacagtccctggcaaattttataaaccagacctgaatggaacttaaaccaaaatagtgcttcatgaatcaattccctaatgaacggatatttctgattctatagcttatttctagaaaaccacttaccacatgttaagtaaatacaaaaatattaatatcattaaggtgatttatatctgagattttgggaaatgtggatattctggctagtagcattgttgcatgcctaaataataactccactctgagacagattactaaaggtctgaaaaaatccattgtcttttaataaaaactattattataaagctgttttacttattgactgtcaatattttatttaactattgaaggtgttctcaattattctgggattggacttttatctctgccttttgaagaataccgctatttattttaggtataataaacatgaatctgtgaccttttctctattttcatcactagattgattggaaagttattttgtttctgccctcaaaagcaaacagatgcatcaattcctctttcgtttcagatggcagcattaacacaagccagtcgatgcatgtgggagagttcaaccagaaactggtggaagccagcactcaatttaaaaagaaacaagaaaaaggcacaattgatgtttggtggttgtttgatgatggaggtaaaaactttcagaaaatacactagggacaagaatttcaattttgataaacttaaactgcatgagaaggtatatgggaacaatactggttaaagaataacatttctgtgttctccaaagactataacttaattaagagctatcaatgtggtaatgaataaagatataaagctattcatttccttccatttagatatactcattgtgtcataatttattctttattccagggttaacacttcttatcccctatatcttaactctcagaaaaaaatggaaagactgtaaattaagaatctatgtgggagggaagatcaaccgcattgaagaagaaaaaattgtgtaagtagtttgccactcacatgttaggtcatttcagaggtttgttgctttaatgctttaattttaataactttaagtgtctctgagacacaatagactcaaagacaaagccaccaggataggcctcgtgtttacttggttatctggtcagtaaattattcgcatatttttcctgatcgctgtcttcaagcaagtcctcttatcctctgtcacaaatgctttccaaaaggaaggtgccacagaagcctcatctcaagtcttgagtgggagcttcgttatctcatataatgcttattttgttctgaccagtaaaggcatccaagaaaagaagagcctgaaggaaatctgggtccagttgctttttctgtgggaattcaaaactcctaattcatggcagtcactcttagaacagcatatgtaaaagagaactaaatggagagactgcacctgggttctagccccagctctgccatcaaggagctgcaggactttgcaacagtctccaaacgcatctgggtccccagtttctcctttgtagtttgaaagagtttaaagggatgactgtagagaactcttaattaaaaaaaaaaaatcccacagtgtaagtctgtatctttctcattaatttagccattgagagttgatgccagttgtgagaataataagcatgctgagaacatgacacatctagaggtctctgatggaaatccagaaaaccaccttcagcagctcttagtccctcagggcactgagggactaagctctgagcccttcctggaaccagcacttccagaagtcacaaaataatgacaggctttattcagtaatttttaacattttctcttccctcttaggatgtattatgctgtgaatgtgacatatatatatatatatatatatatatatatatataatgtataactatgtataactgtataatgtataatgtataacaatgtataacaatgtatatacacacacacagttatacactgctacattgttacattctgagaaatgtatcaggcaatttcctattgtgcaaacatcatagagtgtacttacacaaacctagatggtatagcctactacacacctaggttatatggtatatgctgttgctcctaggctacaaatctgaactgaatactataggcaaatgtgacacaatggtaaatatttgtatatcaaaacacagaaatggtacagtaaaaatacagcataaaaggtaaaaaatggtccacttgtattgggcacttaccatgagtggaacttgcaggactggcagttgctctgggtgagtcagtgagtggtgagtgaatgtgaggccccaggacacgactacactactgtagattttatcaacactgtatacttgggctacacaaaatttatacaaaaatacttttcttcaaagctggacctgggaataaaaaatatttttttcttcaataataaattaaccttagcttaccgtaaacatttttacttcataatttctaagcttttgacccttttgtaataacactgagcttaaaacgtattgtacagctatgcaaaagtgttttctttatatccttattctataagcatttttctactttttaaactgttttctttttttctttttaaatatttttgttaaaaactgaaacataaacacacacattagtgtaggtctatccagggtcaggatcatcaatatcactgtctgccacctccacatcctgtatcccactggaaggtcttccagggcaataacaggcatggagctgtcatctcctgtgaaaacaaagcttcctctggaatacctcctaaaggacctgcctgaagctgtttcacagttcactttttttaataagtagaaggagtacactctaaaataataataaaaggtatagtatgtaaacacataaccagtaacagtcatttattatgttatcaagtattatgtactgtacgcaattgtatgtgctatatttttatatgactggcagtgcagttggtttgtttacaccagcatcatcacaaatgtgtgaataatgtattgtgctatgccgttacaacagctacgacatcactaggtgataggaatttttcagttccattataatcttatgggaccaccatcgtatatgcagtctgtcattgatcagaatgtttttatgtggtgtatgactgcatatatattatgcatatatgcatatatgcatatatgtcttttcaatcaaagcaatatgatatttgtatgctaatattatatagatttaattatacttaaagaggatcatattaacatggaaactaacataatgtctataatattttatatttcttaaagctgccaatattttattgggacaattagtataatttgaaaatgttttgtggcttagatggtagtatggcaccaatgttaaattttccaatttcaaaaattgtgctctctttatataagagattgtccttgttcttacgaactgctcactgaaaaatttaggggtaaaggtgcctaatatctgcaactgactttaaaagattagagtagataggtagatagagatagaagtaaatagatagataaatataaagagagagaaacaaagaaaatggtaaatcaaacgggacaaaatataaacaactggtgaatttgggagttctttgtattatcttaaaaacttttctgtaactttgaaattatatcagaattatcagttgccaggaaaaaaccatatatatatatatatgtgaggttttataatatatatgatggtttataatgttataatatgtttatatattatataatttagatatatgtttgtatatataatcatataatttatcatcttatgatatattgtatgataactgtttgtcagtagcttgtcagtaactctataaaaattatcaccaatataatagtccataagtattaagacttgctgtctttcaaataataagaaatgtggacagatttgcattctgttccctgtgacataaatgcagagttggattggctgttgccagtgtctgcacctacaggggtttctttatgccttcagtgaaatagcttggtccacacttaatgcgttcatcaagtactgtaatgaaaatcaaacaccaaccaaaaagcctctgtctgaaagctaagctgaaataagacgtgattgcttttgatatcttaactcaaacaaaaaactctttgattgaaaatagttaaatatgcaatgatgaagtattttccttttatattttcagaatggcttcccttctgagcaaatttaggataaaatttgcagacatccatatcatcggtgacatcaacattaggccaaacaaagagaggtatgaaatatttaacaagagacattgattacccatggtactctctcattctcttttgtgttgattatcaaacagtaaaaatgttatgtatttactgcagcgacttcttgataggatctaataagaagagccttcaaataagcatgacatggaactaacaagtacattctaaagggaaggaaagcttttacagtgaagacaagcctgagagggagaattgttgaaacagattagttagtattttagaattgcccttcctgttcttgttttctatggtggcaagagcagcacgaagtgcaaggtcatactattctgaatggagccatcagggcaagttttgttattcagagttactcgtggggcagcctggatggggagctctgatggagaatatatggaaatagcttgtatcttcttggcacactgacaataccaactctaaagggccactttagcttttaggcactaaaggcccaacagggaaggcctatgaattttggggggacgtctaaaactatttgaagcctggaaaagaaatgtattggctccaaaataaaaaaaaaagaaaatgacaaaataaaagtaatcatttaaatatcttcaaaatgtgacattattttaatcctcattaattgttatatttatcaactccattagtgtcttagttagctcaggctgctataccaaaatgcgatggactgggtggattaaacaacagacatttatttctcacagttctggcgaagttctgggaagtcccagttcaaggtgctaaattactcagttccctttgagggccctcttcctggtatgtagatggccgcctccttgctatgtcctcacatggtggaaagaattctgctgtctctttctcttcctataagggcactaatcctaaaatagggaacctaccctcatgaaatcatctaaacctaattaccacccagaggcttcacctccaaatactatcacctggaagttagggcttcgacacatgaatttgggtggggggacacaagcattcagcttataacaatgatatttttgggggttttgtggggttttttttgagacagggtctcactctgtcacccaggctggagtgtagcagtgcaatctcagctcacaacaacctctgcctcctgggctcaggtcattctcccatctcagcctcctagatagctgggaccacaagcacatgccaccacacctggctaattttttggtagagacaggctttcgccatgttgcccaggctggtctcaagcccctgagcttaagccatctgcccgccttatcctcccaaagtgctgggattacaggcataagccatcacacctggcaacactgatatttgaaaacagttgtaggttagatcttcacagtagtttgcaagggtgcaagaagattgtttaaaaaccatggccaattataaattaaattaaatatttagagttatcatttaacaattataaaatgtcttcaattatttatagtctaaaatcatattttctgttgcattcagatgtaatttaatacatttgatttcatgtggagtggggcctccaagaggaatcatacagagggatgtgaaggtcctggaatggcttagattatcacggttctgtcagatctcttcccttttctgttgaccatcatttcttcttccttttgtacttcttgatggattataattccacagttttccaggcttcttgcctctttccttcctttgatttattgctattctatatgagcttaataactaactgaaaattattccaatttaagatgcattcctactgatcaaacaaacttgaatttcatattctttgaggttattcatgatccttccaaggagatgggtcagttaaaatggctttacaaaacaccttaactgcaaggcgctgtggctcacgcctgtaacctcagcactttgagaggccaagacgggaggatcacttgagcccaggagttccagagcagcctaggcaacatagcaagacccccaaaaatagcaaaaatttgccaggcttcgtggtgtatgcctgtagtcctagatactcaggaggctgaggcaggtgagatcatgtgaacctggaaagtcaaggctgcagtgagccatgatcaccccactgcactgcagcctgggtgacagagtgagaccctatctcaaaaaaaaaaaaagaaaaaaagaaaaaggagccaagcactgtgactcacgcctgtaatcccagcactttgggaggctgaggcagcagatcagctgaagtgaggagtttgagatcagcctgaccaacacggtgaaaccccgtctctactaaaaattcaaaaatagccgggtatggtggtgggtgcctgtagtcccaactactctggaggctgaggcaggagaatcgcttggacctgggagacagaggttgcagtgagccgagatcgcaccactgcacctcagcctgggcgacagagcaagactacatctcaaaaaaaaaaaaaaaaaagaagaagaagaaaagaaaaatacattaactgtgatcagaaagctataatcgacagtgttaaactgattattactttgtgatatttctttacatcatactctactgccttacatttttatatttctacagttgtaaatacataagaaaaattaagaacatataattttcattgataaatggaattaacattctgatatgaactgggttgtcatacaataatctctggtagccttccactttttattcaagaacttccattctctatgtcattgcattttggcatttgcagtgatataatcaaacaagctcatcatatggctctaattggtagaaatacatcatctttcacaacagcaagtccaacaattccttagtacatgccacttagcaatagggcatagctggccagtgctctgcaagatagggccattttctgttgtctagtgggtagtcactgtgtcttctactgacttaggatttcctataagccctagcttaatgctgggcatgaattatccacccacttctttttattttatttatttatttatttatttatttttaagacagggtctcactctgtcgtctaggctaggttgcaggtggtacaatcatagctcattgcagcctctaactcctgggctcaagagatcctcctgcctcagcctcttgagtagctgggtctacaggcatgagcccctatacccagcttttttttttttttttgtaaagaaaagtctcactatgttgccctgactggtctcaaacccctgggcttaattgatcctgccaccttggcttcccaaagtgctggaattacaggcatgagccaccacacctggcctcacccacttcttgtagccaaattctccttgctgttgttggtcttatacttagctaagcattatcaatgtttgctgattaatttgtccctatatttctttgtctctttacttgtcaatctggttttctcaacccaagtccttgtttccttccccttctttcataatagtctctatctagctgccatggtcaccaccctgcatagccatcctttctgtcctgttgctgaggaggctgatgtacctcttccattaaccaagcctctttattctttgaatacttttcatagtctagacacttttcttcttactactgtgacctttgtcccaagatgtcctcttctgatgtccaccatgttaatttggtatttgtcacatgtcctcattatcctggaataaagagaattaatttttttgtcaggaaataaattagttttcaaaattttggagattttctctctgttgtttcaaggtattaaggaaaatgcagggaaaaaaaatccattcttactgaaataaaagaatccttgtggccaatataccctgctgacgaaacaggaggccaccaggagtgtgctggaagagccatcctcctctcttcagcctcctaccatagtgatgccatattaccttataaaacagtccatatctgatgttggcaatggctgttccaatacctgaaagtaaccctaatgtagaagacagtatggtcattcaataaatctcacggatggccactagtagcgcgtctggcacatttgtaataccttaattaaggcaactcctctggatggtctaatcagagaaagagaactcttcctctgggctgatgcagccccagacccaggggctaaggcttagagaatagaacactggctctatttcagctcccacttggacctcggccgggcagcccttacctactgttaacaactatctcctgatcactcactattctttcttggttgccgggtgatacacaatgtcaaaaatagtttgtcaatgatttccatgttggaggctaattttaaatgccctcaaattgcctttaataaatcttttgactacccataaaacatcagtaagtcttgatggaggaattttatcatagaaacattatctataaacatggtagggcaagggtgaaagggagtacaaaagcaaagttaatgagaaaataattgacccaggagaaactgaaaagctcttgtgcttaaattctattttttattgtatagactgaattaaaagtcataggacaaaaagacaacaatctttatgtggaaatcaaagagaaactagaagcaattaagtaggtaatttagtttaaagatgctagagtagtcccagaaacagttggtacattactttgagagaagaaattttatgtggacttagggggaaaatattatgcaatttaaaaatttttaaactttattatgaggaacaaggatgaggaaggcagcagttaattttaaaaattgaattcttatttatatttaatagcatgtaacacttggcttattctatagtcaattaaaagtacttataaagaaaaaaatcagatttaatgagattcaaaatagaaatcttgagctacgtcaggatcctctagcaaagagaatgaaaaatggccagctcagagatgatccaaaggatagaccaatcaaagatgaacacagagaaggagcagtaagagtgcaaagacaaaactgggcaaatacagccccgttatcaccccctgtgtcacttagcatgtttcaattgcaagtaaaagaaaacttaactcacagtgatttagacaataggaattactttcacatataacttaaaaataaaatcatattttggatttcagggtaagcttgatctaggttaattttgtaatcaaggactgattctctttcagtctccctactttacttttttttaataaaatcatctatcaaagttgatttcacttataaaaacaagatgactgtcaattgcaaccaggactatctactcgctcatgtatgttccgtaggagagaaagtttgtctcttcccaaattactgagctcagggtccagggctcctttcaggtttcactaacctaagccactgagacattactgtggtcagcatagttgtgggtgcttattggttcaagtttacctgtgttatgtgcccacctggccaattactctggaagaagacatagagttgtgctgattggctgacaatggcatggagccattcccactgaaagtacaatgaggaaaacacagtacggatactggggagacaaccagcaacctctactccaccttctatttcttaggaaactatttttgtactgtgctttctaacaaggatttgggctgagctgcaaagaaactctcatcctgatcaaaataagtatacgaagagcttaaacagaaagcctctccattgctaatctcaaccctgtggctgctgagtaaagtgaatatcttgcctttccaaggcactgcatgcttttcagagcactgtcacccaaatactcacagtgactctcaagccagtttctagcagccattgttactccccttttatagcctagaatatccaggtcaaggaggacaatgcaagagctggagcgagaacccagaccctactctccaaagccagcacctttccatagtaatgaccactcctagaggtctctaaaggcacgacactgttgaaataggaaataaaagttgaaagaataatagggcctatcagtcttattctttccctgtctttgcctacctttctaaataagttaatgcaatagaagcctaatgcattaagtatcttttcagtctcttaacaaaggctcactagtagggacaatcctgctcctttgtaatctctgcacttttatctgcaaatcctaaatcaggccagttggtgagataattgaactcattacttcatattttcacttcttgacttaacagcatatcaattctaattattattcattctaaaattactaaattataactaagctacattatataaaaccaaagaaatttttcatacttgagatcatcttaaagtagcatactagagacaactactgccataaattataagttttactttgtgtcattgtttttaaaaataaatcttatgaggttcttataagtaatttttaaaatgttctatagctcttagctgctagttttctcctcagcgatttctttttaaatgttctaacatagcctcagatttttaggcattaaaacattattgatttttgttctttctcctaacatgaacctgaataatactcatttgaaaatctcagacagcaacatcaaacaacaaaaggacaaggggagcattatttgcagaaaacgtccaaattgttctacaatcattaaacttgtgggagcccttgctgttctcctcctacctgcccgcggcctcctgccatgagtgggagttgccatgtggactaagggtgagggtagccatatccatttcctacattaattgataaatgtctcccatagagtctgtacaataagcaagtggaaactcatttgtgtggtaaagtatctacattacaactatgtcttcgactacactatgcagaaaatgtctttgcagaacaattactacctatgtgtatatgtgttaatattgtaagtatgtatgcgtatgtgtgttaatattgaagatctaatacctaataggctaacaaggccttgaacactctaaggccttttctggggtagggagggagtactgtagccatggttttactcacagtaaattccctgcaaagataattcttaaaagatttgcatgatattcagctctgattccacagccagcagagccagtcacacctggagtatctgtgaaataatgagttagtttcccactgtgaggcctcctttataattcaaattttagctggaaagtctttgaagagatgattgaaccatatcgtctccatgaaagctgcaaagatttaacaactgctgagaaattaaaaagagaaactccgtggaaaattacagatgcagaactggaagcagtcaaggaaaaggtaaggatttgtctttcttaatttttttgctgtctaactagctgagaaaggaaacagtagttgatttaaagacaaagaagcaatatatttattatcaaatgtcattattcaagatccaagctttctgcatttttcaagtgcttttcaatcatttactggatacgattatttagaaaactttttcattttttcccataaggtcaattatattttaaaagttaaaaaataggttattggtacatattgtgaagtctcctttcaaatttaattttaaagagcaggagacagactcatcagcctaaaataatttgagtcaatatgtgtgcaaagttgataaagttagattgactcacaatttaacacaataagaaatacttttaacctgatgaagagatggctatgaaaaacttataaaggcatctgaagaaacatatgatgtgactggaacaatgaatatggaagctggatccagcacacattgtaagatggatgtaaaatggtgagcctttctagacagcccagtaagatgctcccatctgtgccttctgtcctgagccaaatgaagttggtgataatgagaataatgcaaagggcagggggtcaacaactaagtagaagaattgacacctggattggacggaaatgaaaaaggaccacaagaacttctaaactacaaaatcttgagtgttttcacaggagcactcaagcgctgctaatctcattgtactttaagtataattgcaggcatttacaaatgttagaaagaaatcttagggccgggtgcactggctcacacctgtaatcccagaactttgggaggctaaggcgggaggactgcttgagcccaggagttcagggccagcttggttaacagagcaaaaccccacctctacaaaaaattacaaaaattagcctggtgaggtagcgtgtgtgtggtcccagctacttgggaggcgaaggcaggaggatcacttgagcccagggggcagaggtgagctgagctcgtgccactgtactctagtctggatgataggagtgaaaccctgtttaaaaaaaaaaaaaagagagagagaaatcttaggataaatgggttaatcaatttaaaagctcttcaggtaggattttgttttactggaacatgtgggattttggacagtgaaggaagataagggccaccctgagaccctgacccctggggcccacgagcttcagagagcctcgcttggactgactgcccaccatgccctacataaaccacattaggagctgaacttgaaaaaattcgagcaagaaacgctaaaagccttttagatttagtgaaaaaaaagagactgaactagaattataaagtctgtgtgtaacaaactgcccggttctgaccaagttttttcatataattgagcaaatcatgcatctgagccttggtttctgaaccagtgaaatacaataaaaaatattactctcatcactgcaaagtggttatttttccaagtgagtcttttggtggctttttaattgaaagccccctctgcttacagaatattcagagagcttaaagaaaggcagactagaatataatttatgttcttagagtatcaaattggtataaagattcaatcggtttcttttttaacagaaaacctattgcctcaaactggccattccactgtgcataggcatgggcatatgccactgtgcccatggcaggttcatgaggctccttgtagtgtaggaagaggccagggtaggagaaaacaccttctttttagtgttatctatgttgtttgcttcccctctccctagaatttaataagccactatagcacaatgaaaatctttgtactgtgtcttattctttatatttctaaaatttctcatgaggttttaaaacaccataagtttctaagcctgaaaaagtaattgtaatttttatacattttttaagatgagattttctgcttgttcatgatttaagaaaataaattctcattcataattctggtagaactgtactcaacaaatctgaatgttgcccacagagttaccgccaagttcgactgaatgaactcttacaggagcactccagagctgctaatctcattgtcctgtaagtatcattgcaagcattgaagaacattagaaataaatcttagggttaatgggttaatccatttaaaagcttgggactcttcaggtgggaattttgttttgtttttgtgttttttttgggggggggaacacgtgggattcttagacagtgaaggaaggtaagtgccactctgagaccttgacccctcaggcccatgagcatcagagagcctcacttggacttgctgtccaccatgccttatgaagaggcgtgtgcccatctagtaagaccatgctccaggaatctgagaccctggatttctctgcctaacagccacaagtcagcgaccacagctcacgggccccttccctgagtggatgtccctgagccactgtgcccatggcaggttcatgaggctccctgtactgtaggaagaggccagggtaggagaaaaaggcagagccatttccattttcactctttatgctctagccttacaaatgttagggttgcgtctactgaaaatgtatgtttgtttacttaaaggttggtatttaaacaagaaaatctctaatgacttcacatttatacctcatgaattgactcctatgtataaagataaatatatcttcacgtagtgtagactggacaactatccatcaaagacattgtagaatggtctgctggattgggtggtagggttccaatagatggtttctgaggtttttcccaaatataagatatttaaattatttgaaaaatcatttacaccaaaaacgggggtaggtattagctgatcaaattccctatttaaaggaaagtgaaaatgtacatttttgttttgtctttacaatacctaagcctgtttttctggtttatagatagtattacctgaaaaatacatcagtttgctatctacagtaaaaataattttggtgctttcatcttggggtggcgtaaaaattaaggctgccggccgggcgcggtggctcacgcctgcaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaaaaaaaaaaattaaggctgccagttattaaatagctcagaaatactagtgccgttactacctatagtaattttcactttcatttttaaatttttccttcatgtcattaggagccttcccgtggcaagaaagggatccatatcggatttgttgtatatggcttggttggaaatcctcacaaagaacctcccacctgtcttactagttagaggaaatcacaaaaatgtcttgacattttactcttaaaacatgaaagattggaatacattttaacttaatgtaatgcataattaagaaacatgttccagtactttatgttgtaaatctgatctatggatatgcaaacctctggagaggatcctaccagattctacatacattgcataatttttatcagttaatgcgagcttttttttctcttctcagcttaaggggttgtcaaagccaatgttatccctagaaaaacatttttgtcactgctgttgataaacaagaaaatcaaggaaactcatgttggcttatgctcatgaaaaccaccaatgtgattgtaaacttctccagacaaacttaaccttttgtttcttaattttttgttttgagtgtttgcttctcagccctggtataggtctcagccccacagcaggatctcaataaatgcttattgacaggctggcatagtaaccacaggtggttatcaaaggaaaagaccaataggctggggaacataattatgcttggccccctcagaggcttatacctccaaagcagatttaaaaatcagtaactcaaaactttaagaagtagttgagtctacaaaatattcaaagcagttacctaaataaggttatttaatgtaacagattatatacttaaagtgatctgagcaatcattgataacatatggcttaaatttgctgctgcctgaaaagtatattaactagattagaagacaccatatactccaataaaatgaaatatattctattctcaatatataaactttaattgtactccctatcaaatattttgaaatttccatcacggcattactttgcatatttttttctaattaaatggttagtacagatgaaatctttatagatgactacttgaaaactaagtgctacaaattttcaaaccattattaagaaatatatcctgaatcatatatttagttactttctatagtgattgtatggatttaaaagaataattaaaatgtgaagttgaaaaacttgtaaaatttggaatatacagatactgatttttttcatttttgttagtatacctataatacataatcacattgacaaaccaatgaaaatattgattttctgatgaatggcttgatttttctccttgacatgttttgactgttcattctaactgaaaacatatatgggaaaatatgaacctgaaataaaagcactcaaattcaattgctttggcctaggtcatgtttttactttcagtcactaaaattgtggtgcaatggtgtatcagatgtgagcctgaagatttcagtcagtggcctcatctgcagctgcttaaagctaggattcaagatcaggacttcctaacccagcctctctgctcagaaggatgaccagagaataagggagaccatcagcaaagcttaggcagctggatattcctattccaaatccagggccactgtgcttaactctgcccttgataaaaccctttctcttgagcactatggacctgaaatccaaatgcctaaactcagcttcatgtgggcctgacacttctctgaaatacttgagggtctctgggaaaggtgagaagtaatatgacttctttaacaggacattctggctcttgtttctttcccggctgctgcaagttgggctccttgggaaacagactctgagacaaagtttagcatgatcccctggggatcaacacctgagggaaggaggggaagaaacagcaaacatagaggtaagcagtgagctgggatgcaggcccaacgacagcctctgctgaccctacagagagtcatcccaagcagggcagaaagggccaggcttttgtactctgcttttatcagttattgcatgggggctgcctgggaagaggtgtgacctctggggcaggggggtgcatggggcagctctgtgcagcagaggcaatcccccaagggcctggcagggaaagtctatgtgctgacagcactcctagctgttagggcaacaagctcttcattaaacaaggtctgggtagtaccgaagggaccatataaagtagtagaaaccgagttactgaatttccagagggctagtagcaagaagatggctgagtatagcccttggattccaggttaagggttgggtggctctaaggtactagagatcttgaggtcaagagcaactgtattgggaataaattcggagggcagaaagttaaaaggataggggctacagtcacatagcagcagatttatccagcccttggtgccctgctgttgtccttttcttcacccaactctattgatccagccacccatcatgtccatgtctacactcaggtttctgagcaagaaggagaacattccacagtcatgtgcattggtgtccaactgtctctgtctcctcactttgtgcatgtttctcaacagcgtccccaccctttcctcaccatgacttcaccatcactttttcagttgctgtctctgctcccatccccacaaatatagacatattcatagacataaaatttctttcatagatagtgccatactgggagcattgtcctatgagttttttacttaacactcaattttagaaatatttcaatggaagctttatttattataattattattattatttagagacaaagtctggctctctcacccaggatggagtgtagtggtgcaattatagctcgccataatctcaaactcctgggctcaaacaattctctcacctctacttcctgaatagctaggactacattcatacgccaccacacctggctaaccttttaaaatttttttgtagagacaggagctcactatattgcccaagctgctcttgaactcctggcctcaagcaatcctcccgccttggccttccaaagtgctgggattgcaagcatgagtcaccataccaggccattgatggaaactttaaaaagagagtataaattcttggggaccaccataaccctggtaaattagaatctctgggagtgggactgagggacctgtatgttctgatgatctgcaagattttggaactagtgctttgagggcagtccctcccatttccatgatttgatttccactacatgttggtgtctcctgaatttacatttttaactcagatctcttctaagtctcagatccatatatttaaacactaattgtcttgatgtttctctctaggtgtcctaccctaaatgcagattgaccagacttttgtaaaacacacacacatacactggaggaatggcatctaattctctttctctctctcttttttttttgacatggagtctcactttgtcacccaggctggagtgccatggcacaatctcgggtccctgaaacctccacctcccaggttcaagcaattctcatgcctcagcctcctgagtagctgtgattagaggcacctggctaatttttgtatttttagtagagagggggtttgccatgttggccaggctggtctcgaacgcctgacctcaggtgatctgctcgccttggcctcccaaagcgctaggattacaagtgtgagccactgcgcccagcctatctaattatctttctcaatgcgtatcaggtctcccctgaaacagccgagatcacgccactgcactccagcctgggcaacagagtgaaacttcgtctcaaaaaaaaaaaataaaatttttaaaaaacagaagaaaatctgcatcacagcagaaaactaagaaaggatgccattcacatggtaatttatttagaaataaaatcatgctatagtttacatgggtggagactgatggaagcaatcaaagatcagcttacaatcaatgctcctggggaaaaaaaaatcttagggaataattgcaggagaccctgggagaattccaataatccttccccgcaatttgaagctggaagtgagaataggcagtaggacagggtggagcaccttccttaggacccattgtgttggatactgcaagtattcagaacagcttccctgagaggttgcatggtatgcttggtgggcattgctatgcagcatctcatggatgcctttggcagaggcatcagaaaagaaaacaacaacattgtgtgtaaatcccaatacataaagagcataaaaacattaaaaataatccaaaagagaagagtaaaaaaatattacttaaaaaagagagaaattatacaataatagaatcctacaatagaagaaaaatcaaacatgcaagaaacaaatagaaaacacaaatgtgttcatctttcttattaacaaaatgactctcaaatttaatgaaaaaatcaaactctattctatctgcaagcattatattcagaattaaatataaaaaggctaaaagtccacaagtggaagtgaaaaaaaaaggctaaaagcaaaagaataaacaaaaatatacacaaacatttaagcaaaaggaatagagttgacaatattaacttcaaagtttaagactaaaagaattaggaatgacaggagagtatcattttatatttataaaatagatatagccacaatgtagctataataataatgcagcattctgtaaacaaatagcatagtattgacataaataatacaaaaaattgttggaaacaaaaggacagtcccagaaagccaatttttgatttttttttttttttttttttttttaagatggagtttcactcttgttgcccaggctggagtgcagtggcacaatttctgcctactgcaagctctgcctcccgggatcaagtgagtctcctgcctcagtctcctgaatagctggaattataagcatgtgccgacagctcggttaacttttgtgtttttagtagagacagagtttcaccatgttgtccaggctgttcttgaactcctaacctcagatgattcacccgcctcggcctcccaaagtgccgggattacaggcgtgagccactgcacccggccagaaagtcaattttcttaggaaacagttcacccttatgacaatctttgacaaatcaagtataggaagaattcaaacaacattaaaaaaaaattgaataggtacaatagtgctcacccacagaaaatacatcaacttttaaaaatctattgaatatttatgaaaacaaattctatgttaatagcaaataaaaactcagtaaattccaaaatgtagaaatagtaaatataacacttttatcacaacacaataaaactgacattacaaatatataaacaacaatataaaaaaccttacttactggaaaaagaaaattctcctaaataactcaggtcaaaaagaagtagaaaatgcagctttagactctttggtaaaaatgacatggagaattccacatagcaaaacatatgataaaaaagcaggagttggaggcaaatatgtagccataaatggctttattaataaataagaaaaatggaagttaacattaaactcaagaattaaaaacagcacaaagtaatcaaaggaaggcatgaaaaagaaattgagggaaaaagcagcatagtaagatgaagagctcaagcctaggagacaaagagctgggagctgaatctcagtttccccactctctagaagaggggtcgttagttggcgtccttaagaatcagtcttctcctatgtaaaacggggattaagagaatgcatctcttagggttgttgcaaacagatgagataatgtgggtcaatagatgagcacagtactgggctcagcactttatggtaaatacttaagcacagacattattattttcaataaagacagtaacagctcaaatgacaaactcaactgttgtttgttgctgttgctaaaaaagaaaaggaataacatcaaataaaaaaacttctttttagttttagaagaatagataaaatataaatatacacatttacaaataagcaagggactttgggttcaactttgggaaagaatgtcctttaaaactctagtatggtaaatttttaattacaatacacatatctatttgtagtaaaatataaaccactcaaattaactcaaaaggaaatagaatacctgataaaatctaatacttcaggataaaacacgaagattgtcaaagatctagctcaaaaaagtttcaacccaaaggattttttctaggcaacttcttttaaactttcaaagaaaatataattaccattatatttaagctattgctgaacagaacaagataaaacattgtctttccctttctcagttattttgcaaaactagcataaacttgataccaaaatatgacagaccacaaaaataggatacaagtcaatttcttgtatgaataaacataggaaaatccaaaatagaatactagcaactcaattttaccaatgtattcaaacaatattccactataatcaggaatatggtattctaggaatacagatatatcttattgctaggaaatcagttaatttaattaatccaatttagtgagcattagttaccatttacttattcatattttttgaatatttatttgtaaatgcatagtgtacctctagaagaatgcataagaaaccaattagggttgactttggagaagaaaactgaatgaaggacaagtaagagatttcatttttactatatacaataataactactcaaaaactaacatttaaataattaaatccataaacaagctacttgtctgccagactgtatttaatgattaactcatgtttgatctgacatatattgtgaaggtcatatataataaatttctaacactcaaaaatatattataccatcattattgtgttgtgcttattcgtaaaataagtgagcaactaaaacgtcactgtaaaaagaaaaagttgaccccatcacatacctactgataagcttaggtttttagttttgttttttttttaaacatgagatcttttaaaatatatatatgcctctttcttgggtggagaaagtgatagagaaatattgcatcagatttaccactatggccctgcagacattatttaggtcagtaggttcatattgcatattttactttctggaactcaggaatagacaagtataatcttgtgctgtgttttgttttgttttgttttgtctggagacagagtctctgttgcccaggctggagtgcagtgtcgcagtcatagctcactgaagcctctgaactcctgggctcaagtgatcctcccacctcagcctcccaggtggctgggactacaggtgcaagccaccatgctgaactattttttcgttttattattcctttttctatagatggggtctcactctgttgcccaggcaggtcacaaattcctgcatttaagcagtcctcccacctcaacctccccaaatgctgggattacaggcagcagccaccatactcagccaagtataatcttaataggttctgagttttattttctgggccaaataaaactcagaattgatattatccatagtaggatagggtaattattataatgtgactgaattgtgtgaatctatgcattatgagtatagtatgttctttcatccttttaaacacaaaacccaagtgggatgtgtattaattttctactgctgcataataaattatcacaaacttcatggtttaaaacagtacccatttattatttcacactttccatgggtcgagagtacaggcatatcttttattttattttattttattttatttattttttgtagagacaaggtcttgctatgttgcccaggctggtctagaactcctggcctcaaacaatcttcctgcctcggcctcccacagtgctgggattacaggtgtgagccctatggctggccagacatatcttaactgggttctttgctcaggatcttactatactggaatcaagattttagctagggctacagtctcctctgaggttcaggatcctcttccaagctcaagtgattggcagctgtattaattttcttgctgctatagaactcatggcagcttgcgtctttaaggccaccagggagaaatctttaaactctagaccctctgttaaagggcttacctgattaagtcaggcccactttagtcaatctcccttatgattgaacttaaaggccgggcatggtggctcacacctgtaatactagcactttgggaggcagaggctggtggatcacctgaggtcaggagttagagatcagcctggccaacatggtaaaatcccatctctactaaaaatataaaaattagctgggtgtggtggcccgtgcctgtaatcccagctacttgggaggctgaggcaagagaattgcttgaacccgggaggcagaagttgcagtgagccaagatcgctctactgcactccagcctgcccaacgggagcaagattccctctcaaaaaaaaataataataaaataaaataatttttaaaaagatcaaacttaaagtcaacagattaaggattttaattatatctgcaaaaattttcatcttttccttataaagtaagctaataattagaggggcaccccaccatactcacaggtccctcccagactcaagaggaggagattacacaggccatcttagaatcctgccttcaatattgctatctcacatttctagagatcatatatatcagctatgaagagccaagctgggagttagataagttaaaaatggtccatgaagtgtcccccaaaaagttccactctctgtgcatgcacaatagatcatattcatttggagggatatctagaaccataaaaataaattaaacctgaaaaagacctcagagatcctcaagtactaaaatgatgtttccatacagaacatttgcacacaattctagttacattgtttttcagtcaacaaaatgttaaatgagcagtaactagccataagtgacaccagggataatgcagcaaaacatgaaaaacttttaacaaaggaaatatagagcacaaaattgcagcaatctgaggtcaaaaacgtgaaagagattctacacaccccagtagagcttgaggacatcattactttgtaagaggacagactaatggcagaaaagctcaattttgttccatgtatcctggttaagaaagcaaggatacctgcactgcaattcaccctcagaaaaattctcgtccacatggctggcatcaaaagatggctaagcttcagttatctggaaaattaatttacatagacagactctttctgcagttaagcagagtatatggagctccagtgtaagatttaaacagtatattttcaggttaagtaatttaagatgaggaatgcagaaaggagaacttctcagaggttgaggccaagaaccaggtcatgaatgtcattgcttcagagaaggtgacaagcaatgacaactgggataagaagactaatttcctcctcagcctgggagacatattgcagcagagggtagtttgggacaaaactcagcagttgactttgagagaaaggcataagtaactgctaaactgtgagactgctgcagaccctgggggctcaagcccaaccctctgttgtcatgcaagcccctgttctcacacagcatggctttcccagactttcaaatctggatcatctgctcttttcgatgcccaagagatgaagaaaaagagactgacttctctgttattatgtacttgcactttctgatgttcctattgcacttctgcccaacaaagaggtggtaaaattattctcagggaaagtgagaagttcagaggagtaagaaataacaggtatttaaagatgttaggccaagcacggtggctcacatctgtaatcccagcactttgggaagccgaggcaggaggatagcttgagctcaggagttcgagaacagtctgggcaacacagtgaaaccctgtctctacaaaaaaaaaataataataataataacaaacattagtcaggtgtggtggtgtatgcctgtagtcccagctacttgggaggctgaggtgggaaggatcacttgagccctagaggcggaagttgcggtaagttgtaattgcaccactgcactccagcctgggtgacagagcaagactctgtctcaaaaaacaaaaaacaaaaacaaatacaaaaaaaaatattaaacaactccagctgctaacacaacacgcacattggaaacagatcaccatactgtgatttcctaatgctcaaagatacatttacaaaatgaattctactaaaaaaaagtattatttgtgcacttttgacttaatgtgtccaaaagtgagctcttactcttccttcccaaaggtgctctttaacactcttccttcatctccatgcatgacaatgctatccttgccatgaatcttcgagtcatctttgactctcacacgcacatctgatttatcagcaaatcctattggcttcagaatatatccagaatctactcacttgtcaccatctccacttctgcctctctgacccatgttgccactggaccatttctcacctggatcactgcaggagccttctcaagggtctttccacatcaggcctagctcctcctctgcctcatttcaacatcttctcaaaggtctttccacatcaggccttactcctcctcttcctcatagcaacccaagcaatcctgccaagtaaactagagattgtcattcctgttaccaaaatcttctaatggcttcccatttcagtccatggaaaagccactgtccttacaagagcttacaaggccctacccctgcaccccatccacctatttctgcgacttcaacacctacaactgtgtacgccttcctctgtcactgttcagaccacactggccttcttacaggtgagtttgcaccctgggaccttagtgcctgctgtgtcctctgcctggaatgcccttccccaagatatcacttccttcaagttaggtaaaacaacccccagcccccagccccacaatcagcaaatagcatgttctcactgaggccttccctggcttccctctctgaaatcagaagtctaaatcccatacctccctccctgctttacttttctccttaactctcggcactactcatttgaatcacatcttctatctgttgtcagacttattttgtctgttctgttccctgccatatcctcaaagtctagaccagtgcctggcacatggaacacattcaacagatatttgttggaacgatgaattaatacagggcactgaggggacatggcaagtatgaaactcctttggggtctggtctctgactcactatgaagccgcattctgccctgctcagggcccttccacaccagctatgccctgacgcaccacacactctgtactctccagagctctgaatatgcttatcctgctgcctgggatttctgactctctctctctctctttttttttttttttttttttttgagatggagtctcgctctgtcacccaggctggagtgcagtggcatgtctcaacccactgcaacttttgcctctcaggttcaagcgattctcatgcatcagcctttcaagtagctgggattacaggcatgcgccactatgcccggctaatttttgtatttttagcagagatggagtttcaccatgttggccaggctgtcttgaactaatctcaaattatctgcccaccttggcctcccaaagtgctaagattacaggcatgagccaccgcacccagcctcactcttttttttatgtttttgagacggagtctcacgctgttgcccaggctggagtgcaatggtgcgatctcggctcgctgcaacctcgcactcccgttcaaacgattctcctgcctcaacctccagcgtagctgggattacaggcaccgccaccacgccaagctaattttttaatttttagtagagacagggtttcaccatgttggtcaggatggtctcaatctcctgaccttgtgatctgcccacctcagcctcccaaactgctgggattataggcgtgagccacctcgcccagcctcttttttcaatcactgttatttttatccttatttagttcactactatactcactttctcttgagttgattggccatctggtgtcagttcttttgtcaattgattcaacaaaaatgtgtcaggctgtaaagacacaaagatacactgttctgagctcttaagatattggcatccacattccctgccctcaaaaagttaaaggtttagacagacaagaaaacaagttacacataataattacaaattgtgaaaaatactgtgaaggaaataaagagaaagtgttgagacaggataactctgttgaccttgatgccctttgtgggcgggaactggagaggctcctttcactcagcccactgtcggccactcctcccaaaagagagcctgcgagcaagcgagtgcagcaaccggagacaacactggaactggcccattactcctctctggcaggagcacgctctgtgcaggccctatagcagcatccaagcccctgccctctccgtacccgggcatccaggaagaatcaggccacaagaacgaatagaagggtggttggtgtatgcggaggattttactgggtgatataagtggctctcagcaggataaggaattggaaaggggatgggtgtgggaagaaggtgatctttccctgaagccacactgtctgaagttagccacatctatccatagtcttgatgctcagcagcttgtacccccaccgctccgctgcttgtgttgctctgccagttgaagtctttttatgtcaacaggataggggcgtggcaggccaaaaaagtaacatttgggtggaaaaacagggtcagctattttcacttagggctgtggttccaggcttaagggtggggtggggagggggtttagccaggagcccagctgttctgtatcagtgtgacagagaataatggaaatagtaatactttattagggtactcagtgaggatgtctatgaaaaacacataaggataagaaggtgctgacagtgttgaactttaccggagccctgtgctcctggaacacagcaatcgttaagaagtctccccagctttctgtgttctagaaatggctaactgaaatcaaccaccattccctatatgacttagacaagacactgccaactctttctcatgattcctacaagactgtagatgattcctttgtttacctgtgacaaggtcaaacccagacttttcccctttaaactgagcctgcacataaggtcagacagacaccttctaactttattctttgtctcatggatgattagctgagataagttttgtcctcatgaaactaactagacacagaaataaacaatcccaactttaaatttactccacctataacttgtctactcttccctataaaaatctaagacaaggccaggtgtggggactcacacctgtaatcccagcactttgggaggccaaggtgggcagatcacttgaggtcaggggtttgagaccatcctggccaacatggtgaaacccagcctctactaaaaatacaaaaaaataagccgggcatggtggcgggtgcctataatcctagctactcagggggctgaggcaggagaattgcttgaacccaggaggcagaggttacagtgagctgagatcacaccactgcactccagcctgagtggcagagtaagactctgtctcaaaaaaacaaacaaacagaaaaaatctaaaacaaaactatcctgctagatacactgtagtaggctgaacacggcccctgaagatatccaggtcctaatccctgaaatctgtgaattttaccttacatggaaaaagggcttttgcaaatgtgattaaggatcttgagatgaggcaatcatcctggattatctggctaagtcctaaataaaagcacaagtatttttttaaatttaaattttattttactttattttattttaaattctgggatacatgtacaggatgtgcaggtttgttacataagtaaacacatgccatgatggtttactgcacctatccacccatcacctaggtattaagcaccacatgcataagcacaagtatctttgtaagggggaagctgagggacatttgactataagcagaaaatcatgtgatggaagcagggtcagacagaagatgctacactgccggttttgaagataaaggggccatgagccaaggaatgcagctctagacatgggaaaaagcaagaaaacagattctcccttagagaatctgcatctctccagaggcaatgtggcaccagagacaccttgatttttggcacggaagactcattttggaattctagcctccagaactgtaagggaatcaatttctattgttttaagtcactaattttgtgaaaattttttacagcagtaatagaaaataaatacatactctaatcttcaaatctggggtgttttccctattgcaatagccaaaataaaatcaatctccttacttattcagtttttgtctttgatggtgctacccatgtgaagaacagtgagtagaacaggccaggcagaatgaacactacgggcaaaagcccccaggcaagagaggacttgagatattctggaacctaggaaatgagtgtgactcaagagaaagttgaacaataacagtctgatcatgcagggccttgggccatgacagggaattggggatttattatatgtgtgatgggaaacctttagaagattttaagccataaatggtgaaagcagggaggttagttaacagtcccggtagctgggtgtggtggcttacgcctgtaatcccagcactttgggaggccgaggtgggcagatcacgaggacaggagatagaacccatcctggacaacatggtgaaaccccatctctactaaaaatacaaaaattagccaggtgtggtgttgcatgcctgtagtcccagctactcgggaggctgaagcaagagaatggcttgaacctgggaggcggaggttgcagtaagccaagattgcgtcactgcactccagcctggcgaccgaacaagaactccatctcaaaacaaaaacaaaaacaaaaacaaaacaaaacaaaaaaccagtcctggtaagaaatgatggtggcctcagaatgggagaataattcagatttgtttagatacagaattagtagggctggatgaaccagattctgtctttgtgtgggtcacagtaggaaacagagaacacagtcaaattaggataacttgaggagggtttactaaagggactattcataaagatgtgggcaagaaatggaagcccaaaaccacaagggagagtccagtacctacaagctgggaataatgtgatgctcttccctttgccaggtccgaagagaaaaggggagagcatcatttctagagcttggaagacaaggcaacttgacaagagcagtggcgttcagtagaggtttaacgcccacctgacctttcccgcccttctccctctggtctcctgctggggctctccattgtcttaacccacattgaagccacaagacaaaggagctcgttggtgatgcccatacaggtcagctgcctggacagcgaacaaactgtaaagggacagagagtgggcctggagggaacaaacaaaggtgtgttagggatagtccaattattacaatttactaaaagaaaatgcagagacttgaattttctacatgatttccttaatactcagtttcagctagcctatgcctataggcacaaaaataatgaactctcaccttcctgacttctttttcttttttttgaacatttacaactgcttttttgtcctaaaggcaatcaggaaagaaagtgattaaaacacttatgaagattaataatgctgtcttcaaagttcagtggaaaaattattttggtaaaattctaaaatttgagaaaacgtttctataggagaactggataatacccactttggactaaagagaattgagtttgtgcagtctagtaagtaaaggttgtttcaccagggcagaatgcggaatcacaatcacccgaaaccacaagcggaattcatacgtctccctgcacagatacccatattttgccattgcttaagtttcctttttgttgttgttgttattactctggaagataattcaattcatattgcacatttcctcacagaaaatttgaatcttatgaatataaaaatcatggacttggcccaattttattttaatcagtttttcagtttcctaattcaggattagcttcccagtatatatgcagacatttagtaacaagtgcaacagtgtgcacattaaaatatggagagtttcagcagcaatttgagttatagtaattactgggtttgtttacacagacatagatgaaaagtataacctttttctttttttttaatttggaaaaatcatgtgctaccagcagaaaaaattatacaatagttgtataatgtcatagaggaaatcaggtgcaaccaatgagactgagaaataaagggatcaaaatcatataaggtagtgtcttaactaggcatcctttctcctggaattagccccaatagtagagaaaggctctcacaggcacattctgctcagaatgattgccacaaccttcaccagcacccaaatcacctgcccagtggacaccaggatctccatttaccaattccagtgcaatcccaaagccatcttctactgcgctttggcaatcatttgtcatatcttgttccctggccccatttgctccatctgggaaatcagactgattgagatggggtttgtaaaggggaaggagagaagagggaggaaaatgccctctctgctaccctagcaactgggagccaacaagagaggcactagtgttcttggggaaagtgggaaagtaagtccatccctggggacactcagaaacagatcaggcctgcttttgaaaggcttattgataccagatctgaaagctctcccaagacactcagattactgctttcatgactacagggctgtttctctaaaggcagcaagcaggcatacagagaccttcacaagtcttacaatgattaaaaaggggtaaaattacccaaatcaccaataattcatctcaatatcttcttccacctattctaccctatttccatatcaaattgacttactgagccatcaattcagctaaaagggaagtcctattgattgtttaaaatatccgttttaagtcttgtggtagacagaaaaatggccttcaaagatgtccacactcagatccccagaactatgaattttattacctcacatggcaaaggtgactttgcagatgtgattaaggtcaccaaccttgagatggggagattatcctggataatctgggtggggccactctaatcacatgagtcttgaaagagaagaaactttctcagctgtggacatagaaccagagaggtggcagtggcagcatgagaagaattcaacttgctgcgttggcgaggaagacggaagaaggaggtcacaaagcatggaatgcaggcagcccagcagctgggaaaagcaagaaaatggattctccctcagagcctctagaagggagggcggccttaccaacatcttaattttagtccagtgatacccatgtcggacttctgacctaaagaactgcaaggtaagaagtttgtattgtttaagccatcaaggctgtggtaatttttttacagcagcaatagaaaatttggactgtgtagtcttcatcacctcaagcttggattagcacaatagaaaatttccagtctccccagcctccagcttcttagtctccacgtcatcttagaaaatctcattccactaaactcttgtcaaatattactctactcattctactcccctgtccaagagcctacaaatggcaatttttcaaactaagcacctctgaacatcagatctgtggtgtcctctttgggcctgccaaggggggaagatgggaggctcaccatgcacctattttaatggcaaaagttctggtctgactgttctacactgtgtacttcagaataaaattaggctgaaagaatgggttccattgctttacaagtatttgacctatagcattaaatataagcttctcggctcaatttttaaggcctgcacaatctcaccctactctgttcctctagtctatgaactcctttagtccccaaaagtaatctttcacataaatcagaacaatttactcacaatacctacaaatagttatgttcctattgatacccacacactgaagagtgcaaatactgaagcttaaaatcattcagtcttctctcaactcggagaaagactttctttttttttttttttttttttttgagacggagtctctctctgtcgcccaggctggagtgtggagtgcagtggcgtgatctgggctcgctgcaaggtccgcctcccgggttcacgccattctcctgcctcagcctccccggcagctgggactacaggtgcacgccgccacgcccggctaattttttgtagttttggtagagatggggtttcaccgtgttagccaggatggtctcatgagccaccacgcccggcccagagaaagcctttctattcacctccagacctttttacaccaagaaaccaacccaacttccctattccctccctgccaagtaaagtctacctcttctactccagggagcatttacaggttaagcatcccttaactgaaatgcttgagaccgaaagtgtttcagattttgaattttttcagattctggaatatctgcatatacataatgagttatgttggggatgcgattcatgtctaaaggtaaaactcaccaatgtttccttttttttttttttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggccaccaatgtttcatatacaccttatacacatagcctgaaggtaattttatacagtatattacataattttgtgtatgaagcaaggtttgtgcatatatgaagttgatgtacattgaaccatcagaaagcaaaggtgtcactatctcagacacccatatggacagtcacctgttgtttggcatcaccatcattgctgactttgaattgatatgcaaccaataagcaatcattttcttatacttattcacatataagtacttagtaaaaaatatgacataccactaatacggtgaaaaaatgtgttcagggtaactaagtggcacaatagcaccaccagaacacctgtatcatccattaaacaacagcagtcacaaacaatgacaggctctcagtttccacctacaattctgtgttttgattgaaaagttactgtgcactgtaaccccttgggaatggtgaataaacagtgtgttttgtgtctaagtcttgattgcaacaagttgcatgaggtcaggtgaggaattttccatttgtggtgtcatttggtgctcaaaagtttaagattttggagcattttggattttcagattagggatgttcaactcacagagctatagggagtcactgtgtatgccaagggaatgcctctcctatctcatgagtcactttcctccagcttatttgagagtcaatttgttttaagatctaattctacattgttgcctagtttcttctcagaaccactcctgtttagtccccgtaagtctccaaaccccaactcagatggggcctctgatcacttctgttgattactggggggattctaagatttcctttagcacaatgtcgtcatcatcaggttaaaatcagaggagatgtgatccttggagagaatactcccattctccgctttatcccttcttagcctaaaatgccactaaccttgtatgcaacatgctttaatgaaggtttgtaataactgaaaggatcgtaatgtaaatcaaaagcaaaaatggaaagaaaaagtaaaactggatgtcaaatttgactgcaaacaaagatcaaggtgaaatgttataacatttaatcgcaaggtttccaatagctgcctgttcttcctggggcttggtagttcaattcaacaggttgaacaatacacccattgttcttccaaataaatgttagttgttgataaggttagctcaggttagtttctattacttaccagcaaaagactactaatatatcctttacaaaaaatggttctatggccacatgtgcttgggaaatgcttacagagcacatagcccagcttggaaattcacaatggtcattaaagactctgagaagtcctgcaatacagacacgactttaatatataagccattattaccaaagagtatgtcccaaacttttgtcagtgtaaaacttccattagcaatacgtgaatacaatgaatgcatggaggcaatcacatcattattccaaaagaatttgccaactcatcagattgtcttggccacatttcatgtagcattttatgaataatttgcattaacatattgattaaaagtaaaagggataatacttttgtttttgaggcagagtctcactccgtggcccaggctggagtgcaggtggtgcgatcactgctcacggcagtctcgacttgccaagctcaagcaatccgtccacttcagcctccaaagtaactgagactacaagcgcgcgccaccacgtccagctaatttgttagttttttgtgtgtgtggagacaaggtctcactgtgttgcccaggctggtctctaactcccaagctcaagcaattctctcgccttgacctcccaaaatgttggaattacaggcatgagccaccacacccagtcgggataatacttttgaaatgcccttcttggtaatccagggttttttctttacttaccctttattgctcagaatatgggagggtgagatcgaagaagtttttaaagaagagaaggtctctaaacaacaagaaaagacaggaaacagcagaaagaaagaatatggccgagaaatctaaggatcctagctttcccctgctaccctcctcacctctcctgagtcaaaaatatgggggagaggggtatttgttgctctcctgaaaagttttcaagccctttaaagaagccccatgatacagaaatatgtttggtgatctgaaatgtattcccaaatgaaaatattgcaaagaaacgtgttttacattaagaaataacgaaggcatgtgatcaagggtacacattaattttgcgagagcattttacaggaaaaatatcttgattcctgttatggactgaatgtgccccaccctcccaaatttaatgttaaagtcctaaccgctggtctgatggtatttgagatggggccttggggaggtaatcaagtttaaattaagtcataagggtggggtcttaatccaaggaaagaccatatgagtacacagagagaaggtggccttctgcaacccacaagagagcccttagcagaacaccacgatgatggcaccctgaccttggagcctccagaactgtttgaaaattaatttctgttgtttaacttagtctatggtatttagttatggcagcccaaggtaactaagacatatctaagtatttcgaaggaagaatatcttgattcctgagctttcacaaaatgggttaaaatgttcctagttcccaaaactctgatgcaataattgcaacttagtgccccttagttataatgtatgtttccagacgttacttgtttctgacattgagtccatatttaccttgtttggtttaatataattacagacaggaacattgcttgagcttccatcatcataccttgaaatttatgagccaaagatcaggctgaaaggctaattaatattactgaagatgaactgaaaagattccttgggcagactgatgggtcaatagaagtttccagggttttcatcaccaaacatatttaacaatcgaaatacgctggtcagcttacaaaatctcagtgtttgcccgttacactgcattactactactatgaaaatagtccgtgtgctggagtgaaaccagttctgctactctagccaaatggagccaaacaattaatgtctgaaccaggtataaagacggtctgcattatatgtttacttttccagtccaattggatgccctccaaagatgagagagggagacacaatatgaagagatcatataagccagaggagacagtgggagcttagagttgacttagtttttaaagagctttccagtttagtccatgtgattcccctccacctactcttttccccttatctaatcttgaacaattaaaaccagcaaatatatttcttacactagaatttacattaaaatttcactttacattctacagtgtttcagccttgcagtcctgtttaactattggggcctcgttagcgacttgtttatttaatagtctcagcaaaactaagaaataagcaaatattctgaatgctgcctggtctgcagttattctttttaaaaaaaaatttttttaaagactagtcaagcatagtagtgagaaggggagaaagtagaacaaggagtttcagatcaaactcctgactgtgaacaatcggttgagataactccctaccttcgggccagccatgcaattactcttaatacaattgtaccacagaagcattgctaagaacacagaccctggctctgcctctatatttaaggtaatggagcctttattaaaacggtccacagtatagtatacttggtaaagctggtaatattggttatatgtgacattattcttttcaggatgtcttgacccccacagattctctagaaataaatcccctaaagcagtggtctttaaccaggggtgggcaacagaatcaccctggagattttgtgtagtcagttggtgatggggcttggatatgtgcatttactctagctcttttgatgattctcctgtgtaccctggcacttaagccatctgcttataaaagataattcttattcttattctttttttttttttttttgagatggagttttgctctgtcgcccaggctggagggcaattgtgtgatccaggctggctcactgcaacctccacctccttgattcaagtgtttctcctgcctcagtctcccaagtagctgggattgcaggcatgcaccaccacacctggctaatttttgtatctttagtagagacagcatttcaccatgttggccaggctggtctcaaacgactgacctcaagtgatctgcccgtctcggcctcccaaaatgctgggattacaggcatgagccaccacgtccggcctgtttttatttcacttcctaaaactcaatgatgctttaaaatgaaataacaatagtctttctctggactgtaattacagaacttttggctcctagtgcttctacgccactggcataattcagagtatgcttttcatggtgattatgtttgttaagagagattgggtattcagtgtattagggagaactatagttctgagtttgtggcttaagtattctgctccctttgagcctttagttcaatgaggcagtcatttgtgagcttgtccaaagtaattttgcagaaataaatgcttgttttgttgattatctgctagctccttaactgtttatttaactgccattcaatgtcaatctactgagctacttacatgcttaagagttctgtgttggtcttatgaaatcaagtctacatatatttatctggtctttgtgctcttcccaagaacctggcaggaacatttttgtgggtttcataaattataccccagttcagtgttttcacattcagccatatatactctcgggggagtataagacattccaaggagtttcctgatggtattctggacaaaacagttttataagaatgaaccgtcagctagtcaacatacaaatgtactttttactgaaactgatctgcctatattctagcccttcttcctacctcctctattgcaattgcccttttgcaaaagatgggcacacttacctatccaaaacctgactggcaccttatcctatggtataaaaacctctgggcttgaaacaaaggagcacttctaaattttggtaccagaacccaaagtatggcttctgtctttttttggcttacacatatttctattaagcgtgaactgtggcatgataaatgagtattttgttccatgatggaatgttctaaattgaaatatagattccttcagttataggaaatgatgacaattttccattaattttttcagttcttccattcctcaatgatcgccaaagaacatattcccccgaggaggagtttgagagttttgttcaaactcacaaaaaactaagacagctcaactgtctattggagatcctctccatgggaggtttgggcagaaggacagtgatccagatggaggtcggagatgagaaagaggagcaaagaaagtaataaaagcatgggtaaatatttttttaatgactataaaaagtagtaaaataatgatgcttattgagattaaaagatacatttaatacactagacagtaatagcatatttgtcaaaagaagggttaatggtgttaaagcagtctaaggtccttgagttatccagaagacaatcattttgattaattttatattttagacactgtatgttttaatttatttaaaataataaaactaaagagtaaaacatctaaattagaggggaaaggtgaaataaaaaacatttagtaaatttcacagaaggcaggaaaaggttttaaaaaggaacatctgaaacccaaattaagataggtttaaatccatcatgaaggttatatgatagtggaggaaacaaacagctaacgagtcaagtgaatatacatgtaattttacatagcaatatatactatgcagaaaaacccaacagggtaaagcattagatgctgcctaggaggagactatttttaggtaagggaagacctaagatagaaagaggaggtaagtaagactccaagggtttttatcgtgagcaataacaggttgagaagggaagaggagccaaggagactgaggagacagccagtgaaatgggaggaagtgtttcaagaaggatggtatgatcaactgtgaaattaagaatgcttggcttatttactacaaacatctctcccagacctggaaacacagccagtagcaaggtcagtattaagttaccacaaggccaggcacagtggctgatgcctgtaatcctagcacttgggcaggccaagaaaggcggattgcttgagcccaggagttcaagagacccgccatgggcaacatggtgaaattgcatctctacaaaatgtacgaaaaattagccaggcgtggttgcacgtgcctgtagtcccagctatctggaaggctggggtggaaggaccacctgtactccagccttggtgacagagtaagaccttgtctcaacatcaacaactgcaaaagagttaccatagactcaacaggggacatataaatctacagcgcacagtggctaaacgcaagggttctgaggccagactatctgaattgtggtttaacctccttctagttgtgatctgtgtgatcttgggtaagttatttaatcactctgtgctttggtatcctcatctgtaaaatggggataaagaatttgtttcctctagttgtcatgattaaacgagtttttttttttgagacagggtctcactctgttgcccagactggaatgcagtggcatgataataactgtctgcagcctcccaactcctgtgctcaagtgatcctcccacctctgcctcctgagtagctagggctacatgtgcctgccacccaccatgcctggctaattttgtatatgttttgtagagatggggtctgcctacgttgcccaggctggtctcgaactcctgagctgaagcaatcctcccaccttgacctcccaaagtgctgggattacaggtgtgagccactgcacccagccaattttttttttttttttttttttgcgacgtcgttttgctcttgttgcccaggctggagtgcaatggcgcaatctcagctcaccgcaacttccgcctcccgagttcaagcgattctcctgcctcagcctcccgagtagctgggattacatgaatgtgccatcacatgcggctaattttgtagttttagtagagacggggtttctccatgttggtcaggctggtctcgaactcccgacctcaggtgatccgcccgcctcagcctcccaaagtgctgggattataggtgtgagccaccacgcctggcctcgagttaatattttttaaagcacttagaatacacctgacataaagtagtaacaatgtgtatctttgttaaaatgagagagaaatccccaaaatggcaaagataggaaaaacaaccatgcttttcaagtactgacttgcattttcagaaggttcaaattggcactagacttaggtaattgaattaatcagcatgactgataggataactatagtctgataaagaaaacaccatgaagggcagggtgcggtggctcacgcctgtaatcccagcactttgggaggccgaggtgggcggatcacctgaggtcgggagttcgagaccagcctgaccaacatggagaaaccccatctctactaaaaatacaaaattagccaggcgtggtggcgcatgcctgtaattccagctacttggaaggctgaggaggagaattgcttgaacctgggaggaggttggggtgagccgagatcgagccattgcactccagcaaggctctgtctcaaaaaaaaaaacaaaaactatgaagtaaattatggttgaaacatgtttagttcttaactgcagtatcttgcatttaaggtgtatgttcataacaagttatatttctattgtcataaagaacgttctattaaatgcttactggctcagaatcctattactttttgccagttagattatggccgtttctcttttagtctaaaataaactcagctgaaaagtaacaataaacactttatgtatacagattaacaacaaaaaatagaaggtaacctgcttggtgttagatattgtaataagccaaacaagtaacttttgtgtaaacactgaagtaagtgctttgaagaattcataaaagtttatgactctaattcatgtgagagataaaatgcatatacatcagaagattacacaatgaaagtatatggctaacgactaatgaatgatatagtaagtgttaaaagagataagatggggcagaggtcactactgattgtaaaaagtttcatgaatgaagcgagacttttatctgggtctaggaaaatgaagtcgttacaatcattacatcttagtacaagcaaggaatcaaatagtatgtctctcatgtgaacattttaagtaaataactggagaaagtacttcaacaaaataagggagcaaaataatgttggctcaaaatgaggtcgaaaagttgcagggctcggatcgtgttgctaaaggcataaatttgggagtcctcaagctgtagctaatagttaacgtccagagaaggtagtgtatattccatagcctcatgcaaaggaattccaactacgaagacgaaccagttaaggagaccgaaaagggggggcctgtatggaaaggcatagcaacgaatgtaaaatttccccaataatactctaaaactgccccacagcttttttaattttgaaaattcaaaaccattcaattcagctcgcagatttttgtgagaaataaggagatacttgcagctcagaaaaaattattaacaactatctagaaagttactgctttatcccccactgtaaactatactaccacgacccgggatccttgttcgactcctagccaaggggttcccactgcgtttctgttgggttatcccaaacctgtgataggatagtagcgccctccctgcctccggtcgaataaacactacaacgtctgacactcggtgctgaaaggaaatcgggcgcggtgtcttgcccacagcttggggagcggccccgggcgcaataactgtcaccggcgccgagatgcggttccggcgcttagggcgccgctaaactcagagcccgggagtcatggctgcgggcggtgccgccccaggtaaatcagtccaggagcagggcccgggcctggcgtacactctcggaaaaatgggggccagagcaaacaagaagagcgaaagcaagagggctaggcagccagaggcggcagcaagactcaagacgccaacggcgccgtcttcctggggccccagggcctgcgccatccctgggctgccggggcaccgcctctccacgcccctcgtccggcggcggctgcgactgcttccgaggtcatgttcccaggacgggcgcgtcttcagggtggaagcctggcgcacgtccggaggtgccgaggacccaaccagcccaaactctgggggaaatgactcccctctgccctcgccccgcgctctgctaccatttccttacgtctctgcttcgctcagcgatgcaaaacgcgcgaggcgcacggcagagggccgaagccgcggtactctccgggccaggcccgcccctcggccgcgccgcgcagcacgggattccccggccgctgtccagcgctggccgcctgagccaaggctgccgcggagccagtacagtcggggccgctggctggaagggcgagcttcctaaggcggggggaagcccggcgccggggccgggtaggaaaggcgggggaggggctccggccgtctggaaggaatccacgcggcttgaggctgtgggggaagtagggtggcgagcggtccttctgcgcgcggggggcggggggggtggggtggtccattagggtcccctggcgagggggcggctttctagtgtgtgagggcgacgccctagaagctccccttcaaagttggccccacgcgctgaatgtggaaagttgactgggacccagtagtttcccatcccaaacctgctttccgagaagggcttcaaacccaaaatgtgaatcccgcctcccctctcagccagaactgtggactcgtcccggggaggggcggtgggtggggcggggctggcgggaaatttcggttttggcgcgctccctgcggcgacgctcatcgtgcgctctcctcttcccccggtggtctcctcgctcgccttctggctctgccatgccctgctctgaagagacacccgccatttcacccagtaagcgggcccggcctgcggaggtgggcggcatgcagctccgctttgcccggctctccgagcacgccacggcccccacccggggctccgcgcgcgccgcgggctacgacctgtacaggtgagcggggacctgccggcgaggaggctgggaagggccggccgtccgctgccacagctagaaacagtcaccggagagatcacaggaacacactagctataaataggatttctgcctttttcgtgtttaaaattttagctttcatctttggcataaattaaatagagatttgggcaaagactgcagaataagtaaaatagctatacggtgtctagcaaggcgttactttgcaacgtttattgtgcccttcctaaatagaagatagagaggaaggcccatggtggctttcgagtggcccgagggtgatgctgtgctcaatagaaaaaccaaggtgagagcctagatgtgagcgtgaaaatacctaagaaggatgaacgaagatgcatctgccttaaaaagttattttctatacattcatccggcccagggcggaatttgagaaggcatctgaaaacgaaaggcagagctgcctgtaatctaccacactttcatctctacagcacgttttacctgtactaaaaactttccgtatgctgttgtatttagtcctcacaacaatccttaactagataagtgttactttttacacaggcaggagtttgtgaagagctgaattgatttccccagaggcttgaagatgatataattttttatcccgaattttgggctttttttttttcatctgactactgtgcccagttcttagaaccattaaggtaggagaaaagtaatgctgagagggaaggagattttatactaaatcccaagcattgggatttattttaaagtatctcagataattcaaacatgagaactattagtctaagcacaggagaagagaaagtagtgcctgatgatagcaacagaaaaaaaaggaaaaggaaagtaggtatggacaattgtagctggaaaaactacagtctcttaattttgatgaataaaagtagagtgatatagtttgactagacctttccaaagtatattttggagcactttcttgagtcctaggggagtccttgatttaagataccttaagtagactcctaataaacacaggtgactttctgtatactgaaattgacatggaaataatggatcagcaataaattagggcttaactgtttaaagagggatttcagtgaaagaaggggtagtactgctttaccagagttaattaaggtctccaaagtaaacttccggttctgctcattgtaaaatctcttaaatttctacccaggagagggccacagtaatatcaagagtagcagcatttgctatgtggactttagaggaattctgttcctaagcaaggtccatctccaggggccgttcacggtgatcagctgtctccctcagccaggaaattcatagcctaagcttggtaaactaccaagccctgcctgacagatacaacacagttctttatctcttattttgtccacccgtttttctcctttccttctgcatattttccctaatcacacagatcattgtgagaataaaatgggttaatatatgtaaaccaattagaactgttcctggcacacagtaaaggcttaatcaatgatagctagtattattagtagtatttggccttttttctttgttctttcttcatttttttccttttcaaactatggttgtaaagcatccaccttttgaaagtttgcctttctgccctttcacgctgataagtacctcagtttccaataaacttttgttcaggggcaaacatttacaatgttgacatctcttcacaccaccaaaaatattcatggagaattattttatctaaagctgtctttttaataataaaatagccacctctaccttcttcataaacttttaagatgaattggtaattcatcatagcaaggttgattttagaaactaaagttgcattaattcattaaatacactgaaagtaattttgtatgcttggtcacaaagaaaatataaaaacaattttataaatagatttgcagttattttctttcaatattttcttagtgcctatgattacacaataccacctatggagaaagctgttgtgaaaacggacattcagatagcgctcccttctgggtgttatggaagagtgggtaagtcatttaagaaacaggtaactatttgtcaagttctcctttgtgatagattcttcatgtttcatttggggtaataagcaggcaatattgcttgggctgtgtcctaaaagaagcaccatttgtgatagcaaatgcactctttgaaaggctttatttacatctctgctttgcctctttttgacccttttatttttctccttcctcactggagcttttaggctcacactggcctagaaggctgttctcagaacatggcattttatattatgagagtaaaacttctgacctgttggtcccagaatgtgtaagcctacttaaccttttcttgtttggccatggggttagggtaagggatactcttcagtgttgtagaggcactgggaggagctaggacaaaatggagtacacgtcaacaggtttgatttttctggagcggatcagttgttaccagacagttctttgcaagagcgtaagttctttttgactaacttcagagtaaacataaaggaggcaatggagctgtgacgccctcctccagggaaaggagctagactggcactatattattagccatgagtgaggaaactgccagtacttcagcccttaaaagataacaagatgggctctcatctcatctcttgagcatcattgactccattttttagaattttttcaggggaaggggcaggagatggagtgaaataaaggttagtacagaaagaggcagcattattgacaaagtgcctgatttaaattattctaaaataaaatgctggaagttaggataattaattataggcctgatgcttgagtctgcaataataaggtgtaaccttagctttttatttttttcattttttaggattaaaaagtatactagcattgaatcattgagacttagtttttggcatttttacttaactgatattagcccatttatcttactctggttcatgtgtttcctacaggcatgtcttttggcatctgaatcatgaatagtggggtcccaagttgtaggctatggtctgctactatttggttaggtttgtttccctctcccttcctcttcctttcccttcccatctgcattgtacatgttgtggtgtcccatcttaaaaccaaagtcttcttcctcagtagtgtgttcctgctggccatacttctctttcttcccctttgaggcttaacttcttgaaagagcagcctacagttgttcccgcttgctcacctttcagctcattctagcagtccttctcccctgtctgcagcaccacaaattctgactgaagtcacatgggagtggtttaagttagttttgaattaaaaccttgtggaatttttctaaactagtctttccaactttggtaatgcagtatgatgaatatatattctttaattcaaaaccatgtgctaaagttaagatgaagatatagatattataggtgaagagaatgacatgcttaaattgcatcagttatctctgatatagcccttcccccttaaaataaccaatgtctccttttttgttttttagctccacggtcaggcttggctgcaaaacactttattgatgtaggaggtaatatatttccttttttattctgtaaatgtttgcaagtatttactttgtctttaaaaggtaatattcaaatgacagattttatttttaagaaaagaaaatgattagaggaaagcttgttataataggaggaaaagctttgtggttattttaagtaattatattttgtttaactactaacttaatttttaaaataatgattacctaattaataatgacagatttaatgatataataattaagtaattatttaagcaacaaaagttctagaaaacacaggtctatcttgtaagaattttcttcataagagagctatctgtctttagcaaaatttaagaagaaaatctttccctgaagtcaggagagaaaacacttttctctaaatttgttaagacagtcctctgtgttacctgtttcccttataataaagcctttctcatgtttgtctcaaagttaaccctacctcatgtggtacctttcatgaagaaccctcagtgtcctctgctaactactcttgatacagagctactcctcttattgtaaggaaatttctactttcctgatgtggtttccttgtttcaggtccgctccaactgggattcagaccccacttatgtggtccttacatactgaccctttatcccatcagtagtgaatctttcacttaacaagataccttggcccccacataagtaggtgtgctagatctcctcctccacccgtttttacagagctgctttatggaggcttgttaacagatcaggaaaactggcttagaaatgagcccacatggatatgtggtaaaaactggagtctctgtgtgattccagcctccttgttctttccactgcaattaattgtggagattaccctgctgcatccccctcaccaactaaacacgtccagaattagctcacttttatgtgccactgcaagggctaactaagcacttaatgaaacctggctatcctagacctgccccttagtctaacatttggtgggtgtggtgtctctccatagtgtcaccaggtggtgctgtgggacaagacaggaccccaaaagtacaccctttagggactaaaggggagctgagttttacatagcagggtggacattgacagcccactcttgggttgaggattccttgggctctgtaagttatgcccgatgttcaaaaatgcttttacaaggtcaactgtggtcattttgggacagtaacttaaggatataaataattgtatatattttcaatgaagtttcaaatgattgttcaaggaacgggagctttggaataacaactggatgtaggtcccagctctgtcattaactagttattacttaacctttctgagcctgtttcctcattttacaatggaaattagtgtgcctgcctctagaggtaggaggattaaatgataatgtgtatgaaatacctaatatagtacttggcacatattagattctgtgagatataatttctgtccttagggacttcacagattgtttttatgtggaaactttttcttttattcgactttgttactaatttttgctctgtttaaaacaactttctggaaaaaaattcatgtaaaagaatggaaagttagtttgcctagtggttggtatggtgttattcataaaatcacattgtggtgtgttcttggatgcagagaatcttaacaatctcccttaggcacaagtttatcatagttggcaacagtttttatttctgaagagagatgttgttagaaatcccaggctctaaataagggtcaaagggaaaagttgagcattcaggattctgttcagaattcacatctggtaggtgtggatagtttttcactaaaaaaggtttccaacaaatgacatgccaaactcttgacacagtaaaacttttgcctgaagtcagttaatcactctgccagttccaatgcatgatttttccagtgataacttcaagttactttctgctttctctgaggagaaatatccctgatacttatatcctgtaggcagagaaggcttttcttggaggtcgaatggcaattgggtggtaaatgaatttggaactactgaaatttttataccgtcaacattcatgcaaaaaaaaaaactattgagggcctttttttctgccatacatttgaattgacttcaaacttcttaatttcttttagtcacttaaaggtttttcacattttcgtggcccaagcataaagatcacctatctgcaggattcaagacacccaatcatttgagtagttctgataggactgctttacagatacgttagcagaggcctttcaaaaagggagtgtttttgtatgttagaagatactataaagccaacaagcaaatatttgcaacttatatgaaaaagaacaaatgagaaaaaaacatacacaaaatatagacaaggacatgcaaatgtccaacaaatgggaggaaaaaaatccagcctcactagtcatcagggaatgaaaagtaaggcaatgagatagccattttgtactcatcatattggccagaatgtaagagattgttgccatcaaatattggcaaggattttggaaatgggcattctcaaatattgctgatggaagtttgagtggctacaccttttttgcaacctatttgatgaaaataaaaagcattcatatacaaggatatacttaaagggctgcttcatttattatagcaaaatgtaaaagcagcctgtgtctgatattatgcaagagaatagttacatagaaacaatggtacaggttgggcgttgtggctcatgcctgtaatcccagcactttgggaggctgagacaggcagattgcttgagcccaggagtttgaggcttatttgagcaacatagggatactttctctctacaagaaatacaaaaattagccaggtgtggtggtgcctttgtacctggaggctgaggtgggagaatcacttgaggttgaggctatagtgagttgtgatcataccactatactcctgcctgggctataagagtgagaccctgccaaaaaaagaaagagaaggagagagagaacccatatttccatatcttgtatctaaaaagaatggctaacatttacatatattaatctcaaaggataaaaagaaaaaaataaagtagtatgtaagatatatttctgtaacattagctatctcagggagggtaagagaatattataagcttttactttatatgtatttgtattgttttagttatttaaaaatttttgaataaagtagaaacaatagttcagaagtcagtccatgtctttctctaactcattcaagatagatgaattattagcttgtacctcaaaatctcccagcatggaagttctctagcctactgtggccattttttctagcatggaacaacatgctatgttgagggatttcttcattaaatctaatttaaattgtccctgcagtcaaaattttttccatatagataatatggaaaacagctggtttcatctttatatcaaattttttcataaatattaaggtgtaaattaatggtcaactgacggtggagaaataaagcagggtttggtattggaattggtcaagttcaataatggattgtttccttcaggcccgacaggagatgaactgcctttgctgcttttctgcccagttttatactcactcttctcgtaaaagtgttgcatcaggaaccttttaagaagtgcttaaattcagattcacttgtccctagtaattcattcataaagcacaggggttcatttaaacgtatgttgtaatccattcggaaaatctaaaatgttgtttttgctgaatatttttccccgtggtggacctaagggtttgcttttttccccccattatatgagaaaattgaaaggatatgcttaggaattacccttgttcttaaaaaatggggggtgggtatgctttggggtttttttgtctgttttctcagctttcaaataatgaggagtatgggcaaatagcattactgcccattgagctgaacacaggattatttttatttccatattttttccttcatcagggcttttgtttggggtagagtattaataacaagtaagatgtgacatggagctgtcttcagttagattcacgtgagtcttatccagcctttcacaaactgaggagaaagaattaacgtgtatagcaggaaattgggggtgggaggaggaaggggagtgactgctaataaggtaggggatttttggagggagggtaatgtaaatgtgctataattgactgtgacgatagttggccaactctgatacactatgaactgtggaattgtaacacttcaaatggataaattgtatgctttgtgaattatttatcaatataaaaaaatgaaaaggcccggtgcacctgtattatctgtgcttgtgcttatggaaatattttaaattattggctcaaagataaatgctagcaagtctggtaagtataactctctgggctatgtcagggacctggctcaagtctcccctgcaaagatcttctccccctgtgttcataatcttaaacaagtattaattacacaaaaaaagttgtactcatgaagcctatgtgctacagtcttctgagaaaccatgctctaagaaaggatggtggttcagattaaaaggagaggaagattatgaactgaaaaatacagcttcatttttagtgtaaaaatggaatattctaatatttgcaagactgctgcttaacaatgtcagcgttgatttactccactgcagagctttaggctttttgacatttttatttatgactcaatcgtatttcaatctgggtattagcgggaagctgataccaggaaaaacctttaaaacccaaatcgtaattttctcctagtctttttggcaagtgtgccgtgggtagacagtaggttggagatggccattgctactgccagcttaaaataggaaatggtcgccatttgataaagagtgacaggttggaaaattaggacctgttttctaaatttttatttgtattttagtaatgtcatttcttggttttgaggctttacatagtaccagggcaagattcacttattcaattgtaagaatacaaatctcagagctacatgataatgattttgagataatcttacacctctagtattccaatagcaaaaattgagataatattacttttcttttctctagctggtgtcatagatgaagattatagaggaaatgttggtgttgtactgtttaattttggcaaagaaaagtttgaaggtatgttaaatatatacattcacataattttagtgaattttcagagtcatgtatgtgtaaattaatattgactcctttaattctcattgaataagacaggatatggcgaatgtgtcagtaacgtcagtaataaactattctttctttgaagtcaaaaaaggtgatcgaattgcacagctcatttgcgaacggattttttatccagaaatagaagaagttcaagtaagtattacaaaggaagatacagaataagtaatataacatcttaagtgaagaaatatatataatcttgagaatttaatatgctgtttgtaactaaatagtatatatgactaaacttattttaagcaaatttaaaatactagttttagaatttctttaaatgtttttcatgtagctattatgtagtattactttggataataagttatttaaacatactgtgaacttctaatattttattagaattttttaaagttatccagtattctaatttatggagctttttagaatttaattttctttctgtaatctcccttttgaaaagatgatatagcaagagtagaattctggctgtatttttcttaggagctggagaggaaaactgaaagaggctcttaaaaaaaactgtgaagcttactacctttctatctttcaggccttggatgacaccgaaaggggttcaggaggttttggttccactggaaagaattaaaatttatgccaagaacagaaaacaagaagtcatacctttttcttaaaaaaaaaaaaaaagtttttgcttcaagtgttttggtgttttgcacttctgtaaacttactagctttaccttctaaaagtactgcattttttacttttttttatgatcaaggaaaagatcattaaaaaaaaacacaaagaagtttttctttgtgtttggatcaaaaagaaactttgtttttccgcaattgaaggttgtatgtaaatctgctttgtggtgacctgatgtaaacagtgtcttcttaaaatcaaatgtaaatcaattacagattaaaaaaaaaagcctgtatttaactcatatgatctcccttcagcaacttattttgctttaattgctttaaatcttaagcaatattttttattcagtaaacaaattctttcacaaggtacaaaatcttgcataagctgaactaaaataaaaatgaaaaggagagattaaaggtattccttgttcttcccttctcttcactagtctaaaaacttctttttaatcttaagattctttgtgatgagggtgagaaaaagaatcctcagtttatttttccactattaatctttcttttgataaatcctctattgactgggtagaggtatgtttgtgaaagacatgtaacttggggatttgttactttaggtttgttcccttgaatttcatctcatcaggcaaattgtactagttgtagttacgagttttccctcagtgaagtagcaataggctgtaatcaagaaaatatgccatttatagagataagataaatgaaataatacttcagccaccaggtttttctgtctcacatacataagcagcatttcattgcagatatgggactgattctgtggcttaccttgattaacatcttttggaagttttgctagtgtgctttcctttctttactatgtttctcagattcctttgtatcagggttttgggtgtcacttaggttttgtccatcagattctgtgagacaccaggcatcgttttgaggatgtgggttatacacatggagtgcttctggaactatcagcccacttgaccacccagtttgtggaagcacaggcaagagtgttcttttctggtgattctccaggccatttaataccctgcaatgtaattgtccctctgtggctcacatttcattagtgagccatgaaatcaactcagtgggacatagccagcatttttgcataccaggttgggctataaaatatttctgttgtcaataaattttaaatgttttcctgctaaactaaccagaatgaattctgttttgtgcaactaaactgtgatcaataccgagtaacagttgagtaagaacaaacagtattacatggctaccgagaaatatggtcttagtttacactgttaatgtcagttacctcttacagaaagtctgctgtaacaggcacttcataaacacctggttttttactcatactgtgagagagtaggtaaaacccattgtacagaatgcagaaatgggctcagagaggtttagtaacctgtataacatttcagctatgatgatcactgtctttgttttgtgctgctatacctgagatggtaatttacagagaatggaaatttattctcagttttggaggctgggaagtccaagatggtgcctcattgctatgtcctccagagaggaggaatgtcatatcctcacatggcagaagactagaaaagagccactcccacaagcccattttataagggcactataatgcattcatgagggctcagtccttaggacttaaacacttcccgttaggcgctgcctcccaatactgttgcattcgagactaagttcccagcatgaattttgggggacacattgagaccacaccagtgacttaaaatgcaggcccttatgccttcaagtccatatgtgcagtatcttcagcctcttccaagtggtagaggtagagaatgtagagaagagagagtttaatttcttcatacccggaatgtttccatctgtgtaccatgcttaaaggaacatgctcagatatgaagctgctcgggaaattagagatttggagtatgtccatggggttaggtgaaagacccaggatgttttgtttagagaagaaatgtatcgggaatgggaggaatatgggggaagaagtggctattgaaagtccctgggatatgatagatgtccttagattaaacacttagatggggctgggcacggtggctcacgcctgtaatcccagcacttttgggaggccaaggtgggtggatcacttgaggtcaggagtttgagaccagcctggccaacatggtgaaaccccatctctactaaaaatacaaaaattagctggggatagtggcacgcgcctgtaaccccagctacttgggaggccaaggcaggagaattgcttgaacccagaaggcagggttgcagtgagccgagatcacaccactacactccaggctaggcgacaaagcaagactctgtctccaaaaaggactcagatggaattagccttgtcacatatgacttgagggaccagaaataggattagaggacttaatctataggaagatggtggcataggggcggactcatagaacttccctgaaatagcaaaattaataaaatgaaataaaagcaaaatatatgccatataaaagaaaataacgtaatgggattattggagactcatttttctgtgttatttctataaagtttgattatagtatttttactgggtgaaatgtaaaatttagaaaagcatacaaagcaagtttacagtatagtgaataactacaaaataagaacatctgaataaccattaccaaagtgaccaagcagaatattgccaggagtacattccttctcaatcatacgccacctgtaggggtatccattcttttgacacttaatttccttttccttaaagtttgcaacctaatcaagcctaagtttcgctttgcctggttttgaactttatcaatgtactcattaattcttgggtcttgcttcctttccttaacattgagattttatccatgtttcatatagctgtagttcatttattttattaccttacagtgttctgttgtattaatgcaccacaaccttgccaaccgaacttggtcatgctgtattattgttattgctaaacttggttttctaatattttgtttagggtcttcttttttatcaatgttcacaggagagattggcctataatttttcccttgtcacattgtatttgtcagcttttggtaccaaaattatgctactttcataatgtgaactgaggaatattctttctctctcttcgaatcccctgtgttcctcccctctcctcccctcccctcccatcctttcttttctcctttctccttccctcccctcccctctcctacctccagcacctctacagtttctggcttttcttgtaacagtttaaagagtcagttgtcaatcaagctctagacaggttatgtgccttttttcctctggttggttttaagattatgtgtttgtatatgtctttggtttagtgtagttgcacaactagggaatagattactgtttatcttttggggattcactgagtctcttaatctgtgtattgatatctttcatcagttctggaaaatctcagcatctctatctctgcatgttttattataatattctgaaatgtctgctcaaattacagttatagttgcttattctcaattaagttaaaaccacttctttttatagcagttttaggttcacagcaaaattgaaagaaagtgcaaagatatcccatatacaccctcctcacacacgtgcacagccccctccattatcagcatcccccaccagggtggtatatttgttacaattgatgaacgtacgttgacgtatcatttttacccaaagtctgtagttacatttgggttcacttttgctgttgtacgttctatgggtttggacacatttataatgacatgtgttcatctttattgtatcacacagcacattttcactgccctagaaatcctctgtgcttcatctattctgctcttctgacccatgcctgcctacccctcgcttagcacacttaagcaaccactggtctttgtactgtcttcatagttttgccttttccagagtcttacatagttggaatcataggatacagctttttcagattggcttctttcattaatgtgcatttccatttctcctgttattttctaggagttttacagtttcacattttacatttagttctgatccattttgaatttttttttatgatcttttaatttttgaattgtaagggtttttattctggattaaagtccaggatcaggtatatgatttgcaaatattttcatttattatttgagtgtcctttcactttcatgatggtgtcaagaaacacaaatttttaaaattctgattaggtccaagttatctttttaatgttgtttgtgcttctgatgtcatatattacataatgcaaggtcataaagattttacacctaattttcttccaagagttttatagttttagcttttacatttggggctttgatccattttgacttgacttgggtatgtggtgtgagatagaggtctaacttcattctttggcatgtggatattcagttattccagcatttgttgaaaagactatttccccatctaattgttttggcatccttgttgaaaatcaattgaccataaatataaggaccaatttctgaattctcaagtctgttacattgatctttatttgttagtctttatgccagtatcacactgccttgagtactatagcttctatgaagttttgaaattaggcatcctctctctctctctctctttttttttttttttttttttttttttgagatgtagtttcgctcttgttgcccaggctggagtgtaatggcatgatctcagctcactgcaacctccacctccctggttcaagcgattctcctgcctcagcctcccgagtagctgggattgtcaccacgcccgactaattgtttgcatttttagtagagacgggtcttcaccatgatggccaggctggtcttgaactcctgacctcaggtgatccacccgcctcggcctcccagagtgctgggattacaggcatgagccactgtgcctggcctaggcatcctctctgtgtctctctgtatatgtgtccatatttccctcttcctcaatgtagtatgacctcatcttgattacatctgccaagcccatatttccaataagatcacatttacaagtactggaagttaggacttcaacatatctttttaggggacacatttctacccactacagatataattaatagtatttttcctctcttgtgatgtctttgtttttggcattaggacctcatagaatgagatggaacgttttccctcttatgtttttaagtttgtgaagattgtttgaattctttaaaggtttgaaatttaccagtgaaaccatctgcatctgcacatttctttgtagaaagcttcgattactaattaagtgtatttaattgttattggtctgtccagattttctatttcttcttgagtttgttttggtagtttattagggctctctcagagggacagaactaataggatggatatatatatatatatatataggtgagtttattaaatagtaacttacacgatcacaaggttccacaataggttgtctgcaagctgaggagcaaggagagccaatccgggttctagggcaagaagcatcctacatggaataaagatgtaggtgcggaggctaggcccatctttcctttttcacatttttctgcctgctttatatttgctggaagctgactagattgtgcccaccggattaagggtggatttgccttccccagcccactgactcaaatgttaatctcttttggcaacacccacacagacacacccaggattaatactttgtatccctcaatccaatcaagttgacactcagtattaaccatcacaggtagtttgtgtctttttagaaatttctccatttcatctaggttatctaatttcttggcatacgcttgttgatagtgttcttataatcctttttatttatttcctttttttttttttttttttttgagacagagtctcgctctgttgccaggctggagtgcagtggcgtaatctcagttcactgcaatctctgcctcctgggttcaagcgattcccctgcctcagcctcctgaatagttgggaccacaggcatgtgccaccatgcccggctaattttttttttttcttgtattttagtagagatgcggtttcaccatattggccagcatggtctcgatcttctgacctcaggtgatccacctgccttggcctccctaagtgctggggttacaagcgtgagctactccaccctgccaatcctttttatttctacaaggtcaatagcaatgtacgtctttcattcctgattttagtaatctgagtcttctctcttttattcttggttagtcaagataaagattcattacttttattgatattttcaagaatcaaaagtggttttgatttttctgctttttatattctctacttcatttattgccactctgatttatattattttctttctcattgctttagttttagtttgcttttcattttctagtttcttaaggtagaggattagattattaaattgagatttttcttttctttttaaatatgggcctttacagttataagtaagaagtaaaaaagaaaataaactggttttctaggaggtggaagccttatgctaatgaggcttggttcctgagctcattgagctttgcattcccatttgctagattcctgctgggggcaaagggagaccagggaagtgtctttttctaaaggcaagttcttctgcactagaaaggaaaccaaagttatttacttatggccaaggagaagaccttatgattttcagattaactaataattgaatagtagtaaccattttgccagtcttagtaatttcccagcagaaatcaggcagttgtcttctttcttgacagtctgcctcactcactaatgatgcccactgttcattcctgtccttggtgctatatgtacatcagaagagaaataacaggaagtcttctaaagatgaatctgatgctccatcaattaattgacttcagtggggctatttgcagaggaagcaacatagtattatttaaacagttggcttggctgggcaaggaggccagggcctgagatctgagtttcatagcaccttcccttcacagtactatacttcctggccatttccatcccaccttgcaggaaattggtacctcaacttctttttcatcttttcatattttatcaatggaagaatagggtaggctggagggccaagatatgcagacacctggagtgttgtgaagcgagtacatgagagattggggttaatgggccttgaacataactggcaaaattaaatgagtattgaatagtccaagtagtcacatagaaagcattctcagcagaactcctaccccaatccccttgtgttgactgtctgttgactgtccccagaccacctatgtcttacttgcccttctttccccctgcgtcttcacctccagcagggctccctggtaggacggtaccaatagttcatactatctatgccatccagcttcctttctctccctactgtttatttctactacataccctaaggtagtggggatcgcctatcagttaccagaactgcagattacataggataaaagtaactcacgaatggaaaaccaaacatcgtatgttctcactgatatgtgggagctaagctatgaggacgcaaaagcagtagaatgatacaatggactttggggactcggggggaagagtgggagcagggagagggataaaagactctacactacagagggtgcagcgtatactgctcgggtaatgggtgcaccaaaatatcacaaatcaccactaaagaacttactcatgtaaccaaataccacctgtacccaaataacatatggacaaataaaataaaaaaatttaaaaatcatatgggccaaaattcaattataagatggtcagccctctgtatctacgggttttgtgtctgtgaattcaaccaaccatggatcaaaaatatttgaaaaaagaaataggtggtgtgcctgtactaaacgtgcagactttttttcctcttgttattcttgcctaaccaatacagcataacaactttttgcatagcatttacattgtattgggtattataagtaatctggaaatgatttaaagtatacaggaggatatgcataggttctatgaatatgacacaattttatataaggtacttgagcattctaggattttggtatctgcagggggcagagagatctcccggaaccaatccccagtggatactgagggaccactgtattagcagtaatatttatagattcacagaatatctccggacatagagaaaactttacacacaaaatccatgctaacaagcatgtgaacattctagtaaagataatagtataattcttgatcaagcatttaaaaccatttcatcttccattcattaatgtaaaatatatagttttattggtaactgacctagtccttttatttttatttatttatttgtttatttatttatttgagacagagtctcactctgtcgcccaggctggagtgcagtggtgtgatctcggctcactgcaacctcggcctcctgggttcacatgattctcctggagaattacaggcacccgccaccatgcccagctaatttttgtatttttaatggagactgagtttcaccatgttggctaggctggtcttgaactcctgacctcaggtgatccacccgcctcggcctcccagagtgctaggattacaggtgtgagccaccatgccaggctgacctggtccttttagctgagaaataccatctagtattatcatcctaagaagagagctgaaatggggaggagtaacttctcaaaagggaagataaaatgccttttgtgaaaagatgcttctccactggagatgggtatgtaagcaatgttttgatgttgctctttttcttactgaaaagggaatgaaaaaatggaaaagaaattataactgaaacaaattttcactggaagaattatctcaagaagcatatgattaaaaaatattaaaaagtctttcatggcaactaaacacatttaagttgggaagattctaaaagatccaggatatctcataaagaggatatctcataaagaaaaagtctaataactacgagagcaagattagagagaagagttaagattaacaaactaccggccgggcgcggtgtctcacgcctgcaatcccagcactttgggaggccaaggcaggcagatcacgaggtcaggagattgagaccgtcctggctaacacggtgaaaccctgtctctactaaagatacaaaaaattagccagtgtggtagtgggcacctgtagtcccagctactcgggagactgaggcaggagaatggcgtgaacccgggaagcggagcttgcagtgagccgagatcgtgccactggcactccagcctgggcgacagtgagactccgtctcaaaaaaaaaaaagattaccaaattaccaaattatgtctaggtttgatcatatgttttcaaaatgggtttacctatgagtaaagaaacttctaggagaatatatatcaaaatgatgatatctttggctgttggaattgtaggtaattttttcctttttgcatgatctatattttaactttttttttttttttttttttttctgatacggagtcttgctctgtcgcccagagctggagtgcaatggtgcgatctcggctcactgcaacctctgcctcttgggttcaagcaattctcctgcctcagcctcctgagtagctgggattataggtgtgcgccactatgcccagctaattttttttgtatttttagagagacagggtttcatcatgttggccaggctggtcttgaactcctgacctcatggtctgcccatctcagcctcccaaagtgctgggattaattacaggcatgagccactgcgcccagcctattttaacattttttaaacatgaaaactatattacttgactaagaaacgattaaaattttattataaaatacttttgttaaatttgtattgcatttactgctttaacaaatacttttaatattgaaaatatatgggaacattataaattacaaattttgaagtaaaaaatgagcctgatctaatgaaaaaaatagtaactttgggagttttacatctgagtttaagctctgttcttttactaactaaaatatcttcaataaataaagtaaacttccagatcctcaatttttatcataaaataaagagagtcggtcggataatctcggtagtcttctccccctctcccgttttacgaatcttgaataagaccagactgtacagccgtggcaaattactgccacctggtggcagttatctaaggtgagctagctgtatttaagggatagaatcaccatcattcatgcatacttgtgtttgcctagcatctatgtgccaggcaagtgtcagcattattgtttatccaatttagtgtttttctagatgatgtaggtgaaacaaccaagacataagctgtgacatgctagctgtgtgaccttaaggacatcatctaacctcttgagtctgcctttccatctgaaaaataaagttaataatatccaccttacattattagaagacctagagatgataggtgtaaagtatcttacacagtccatggcaaaagtatttagtcaataaatggtagtagttatccttaggaaggttaccatctgtagcaggggaaataagacaaatataggcatctgtgcaaatataggtagtgtgacatatatgatgtgcatgaaaatacaaagagggcatgaggtatattcaagaaatggcaaaaccaaagttccaatggactggagtataaaggacatgtagggaattgttggtaactcttctggaatggtaggttgcagatctgctctagagggtcctaaacgtcaaggaggcaatggccagtcacagaagagttttggactaagaataatatcactagagctgagcttcagcaatactgatattaatcaaatgtctgacaatgaggttaagaagccaggtaatgagcacagaggatggcaaaagaaaggtgggtggagaccgagcgtggtggctcacatctgtaatcaaagcacctcgggagactgaggtgggcaaattgcttgtgcccaggagttcaagaccagcctaagcaacatagcgaaacctagtctctaaaaaaattagccaggcatgatggctcacacttgtagtcccagctactcgggaggctgagagatgggaagatcacttaagcccaggaagttgaggatgcagacctttggtaattaccccaggcaacgaggctgttttacaatgcggcataatcatgccactgcactccagcctgggcaacaaagtgagactctgtctcaaaaaaaaaaaaaaaaaagaaaaaaaagaaaagaaaagaaagaaagatggaagccaggtgcagtgactcacgcctgtaatcccagcactttgggaggcagaggcgggtggatcacaaggtcaggagatcgagaccatcctggccaacatggcgaaaccccgtctctactaaaaatataaaaattagctgagcgtggtggcgcatgcctgtaatcccagctacttaggaggctgaggcaggagaatcgcttgaaccagggagtcggagcttgcagtgagccaagatcacgccactgcactccaccctggcgacagagtgagactccgtctcaaaaaagaaagaaagaaagaaagatgggtaggaatgacactgaaaaactgcagaactgcaattgtgagtgaatctttacaaatgaactacctgagacaaagggaaactaagaagtatttggtgtcaggacaccaaccagccatagcagttgtaggactaaactccagggttcctggcctgggtctaaaaccctttccccatccatgaaaggcattagcccaaatttctactgaggtctgaaccaaatatgagtttggccttcgaatcacacattgttcaatacataggatagtaactctttgtgactattttctaatgtgccatgggctagagaggaaatacgacaaaatacttttctacaaggtcattcactttgagtatcagaaagaacattctacttagaataaaataaaatcccaagtgtgcccattttaaaatccctgtgggatttataatggcttaacttttagttgagaagaaattttttttttttctggcatcttagagaagcagacagagaagcagaggtgatgctttgacaaatagtagcatagatcaggataaatgacaggaagctctcataaaatatacttcgatgagagcaaaggcaaataatgatataatgccctgcagctacatgtttgaaatggaaatgtttggaatgaggatgttagggaaaataatattagaaaaagactaatgctgtatgaggttcctgtcagatgaggagtgtaggataattgtgtaatagtgaaataatatggtttagaaaaaagaaggtgctgttgactgagactgtttgattatcatagaagagatgaaacactttttcatagtcagaaaaatcaatatacagcccaagaagagaagtcgtttgatgataaggcaataaaaacttcaaagggcaagttaaaaatgtttcctaattcatttcagcctaaactgatccctgcgcccgtctcacactgtccgccagctcttttgctgaagtatgttaccctttctccttggaatcattacccggtctccttggaatggaaactgtgtcagactccaggggtgagtgggagggaaaatggtgctcgcagaaagagaggaagtgttttttcaatttagagctagaagtaagtgctgacattgtctcatgtgtgtttggggacaatggcacaggccagcggtaacacatccacttttctgtgtcccttgctcagatgtgtttggcatgaggctgcaaaagccacggctactttatcgcaccccaaatctctgaatctctgttctccctcctgggaatgtgaaatatggacaacatgcagtttctaccttgtattgttaacataattatccagatgaattctcttattatttccccacacatattttgaaacaaaaaatcctttcccttacgaaacttcacttcctttcttcagacgcacaccttctgtggggtttgaacattaacctcagctgacttcagagctgcactaagcaaagcctgtgttttctaggccaaagtagacaaagtgaagtgaaaggagctgttgccagttgatgctgacgaaggtagaagagaggctgggtactcacgctaggttccaccccctgcaccgccctctcccccagtacagctcatctgggagttcagattcctcagccttctaggtcacctctgatgagcaggggctgtgagaactgcttagccttttggctactgtagtgtggttgggagagaaaatacgtattaatattattacttaaagatagttttatttgtgtctatattgaacatctcttgtttagaaggcaaaataatcatctgcctgccacattttacttcgtaggcatagagtatcaccttttttttttttttttgagacagagtcttgctctgttgcccaggctggagtgcagtggcacgatttcggttcactgcaacttctgcttcctgggttcaagagattctcctgcctcagcctcctgagtagttgagattacaggtgtccgccaccatgcctggctaatttttgtatttttagtagaggcggggtttcaccatgttggcgagactggtctcaaatccctggcctcaagtgatccacccgcctcggcctcccaagtgctgggattacaggcgtgagccaccgcgcccagccagagtatcatcttttaaactgctttgttctaatataattatctgtgtccaaattttagaattgattttcataacttaaattagaatacaaataataaaaggaagagagctaacattttttaagtgctatatacaccaggtgctattctagttgtgttccttttacctgaatgaggtattgtaaacctaggggcagaatttactcttagggtgaaaactggtctctttatttttagggagtcagcaagccattctgatgggctactcaaatgttagagtaggatctcagagctcaagggcttgtttgggcaggctgagaaggagaggcagagagatgtgagggactcaggagttggtggcaggggtggttagcagggggcaggaacgccaaaatatggtaggaggctaatcagagaaaggaccagtgagaaatttcctgcatcaaggagtgccaagacacttcttctaaatttatattatggaaatttctagcatatacaaaagcagaatgagaagtataatgaaccccgtgtaatcatcactcagctttaacaatgatcctctcatagctgattttgtttcttccgtatccctacctacttgcccactcccaacccccagtgaattattttgaaacaaatcccagacattgtatcacttcacagattacattttaatctgttttccgagctatctgtacggtagctcccctcttattacccaaacttcagtcaaatccactcctttagtgtcagtgggactttagagggggactaaaagcaaaagagtttgcatctgggccaaaatgggtgaagaaaaagtagtgagaagcctgatgcgcagccgagattaagaataagcagagctcctgagaatccttgaaaagattggaggtgaagggatgctagttcttccatagaagtcagatgggagttttatatagtagtgtgtgtgtctgtgtgtgtgtgtgtgtgtgtgtgtgtgtgtgtgctgttattaaaatgaagagtgactctggaagactggaagacttggggacagccagacagctggcctttgggttacagttgcattttccaagtttcctttccttgcaaggaaagaaaatactaaatttaaacaccatctttcaatttctcagtcaataatttccttttctgtctctttcacaaatgcagtttcaagacatcaatgcaaggcatttattttctacggcgcctttcagaaacatgaaatcactgaaggagcgttgttaagcaattccaatcccaattaggtttgcagctgatgtctacgtagccttgtttaagttactattctttaacaacttgtggtgtaactagcaaaaattgtaaaaagtggacctagattcttgcaaaattaccctgtagcgttctcaaggtgggggaaagaaaaatatggacaacaattgaactaaatttaattttatcaagttaataatgcctttaagattatagataggccaggcgcagtggctcacgcctataatcccagcactttgggaggccgaggcaggtggatcacctgagatcaagagttcaagaccagcctggctaacatggtgaaaccacatctctgctaaaaatacaaaaaaattagccaggcatggtggcgggcgcctgtaattccagctacttgggaagctgaggcaggagaatcacttgaaccagggaggcggaggttgcaataagctgagattgcgctattgcactccagcctgggcaacaagagcaaaactccgtctcaaaaagcaaaacaaaacaaaagatgatagataaacagaggaatttgggatttgaaatgtcatcttctcttaagatgcatctagacagttgataattgcccaaataagtttaatatgggatagactgcgaactttttttgcatgcagatagcatgagttatagctatttccttatttatattctaatagaaaaagaatttttctttgagaaaagaaaatggcaactttactatctttatcagatgcgtttctgtcttaaaaaaagaccgaggctgtatgtgggaaacaaaaattataaccaacattaagacaatatgttgttgaaaatactgctatctagaggccttaggaaatagtatctagcaaccactagatgtcacttgatgtttgcttttttgtaaaaggtagtttttttgttttgtttttgttttttcatagtttatctgcaattataagtctacaattctcaatgggtccaagctggcagaaaacaaaatgctgcaatatttgagtgaaagcaggcaaaagtcattagatgagaacaatgattttaactttaaataagatttgggtggttgcagggtttgtataatctctcctggcatttgtaaggaccagagaagccagcagctttgccctcctgctgtgtttaaacaaaaatggaaaattgtaatgaacagctagatttttcctatctttcatttttttcttcctcctccttccccatttttaggagaatgtgacttttaaaatgattgccctttaatgaggttacttgcagcattttaagatcaatccttctttgttcaaatttctacccacaaatcaaaactgttttaatcttcattatctcagtaaagcgcatgtgacaaaagtaaatggagaagacgtctagaaatgttgtgagggttctctggggttatccacttcctgtatttgctaaaactctaataatcagttccagtagagaccatgtatcctggggttttgttttgtgtaacagctatttgtttattttttttaactgtcattgtattttggcttcatgatggttaaatgagtctccgtattaagtaaacctctctgaccctgcctatttcctgtcttgtcaaacctttccttgtaagaataacagtgttcttttatttggtagtgtgcagcatgatgtttttggcatggccaacatttttgacttgcaaaaatttgtgacctcaagtgtgagagaagtgaatgcttttttcggtacctcatggggtctcaatcttaaaaagtatcttacgaaagaattatcagcatgtttatttcccaaacatcacaaataaacaaatagaaatagctttttttaataagctactaaaaatattaaaccaatgaatacttggtgaacattttgctgctactaaacttacataatttctcaaactggcctagctatatgaagacacagagcttttatcatgttctgtctagtaattcatatttttgaaaacatattttcaaaccaaaacacattgtatgtgagtggagtatggctattccaagtcacagaatggaagaaatatctttgttgcctcatccttatatacctaggtctatttagttctgaaatggattctataagataagaaccatcaaaatcaaaagtctcaatcaaatgcacctcctttttttaaggtagctagccatttgctagcatttttctcttatcttttggtttatttttcaataatgtggacattatgagaataaaatcatggtaaacatctcttgcatttaaagattgacaactgctaaatattaattttgaaatattgataactaattagaatctgaagaaaatagattgtgttgatttgaaggtgtcatgaataaattcttataatcacatagcagtagttctgaaagtcttggctaacaaaaatctaaatatctgcagcaaatggaatttgataaaagtaccaccaactagtagttttttgttttttatcattggctagaaatatagttctaataaagagcctgtgatgtataggcagtaacaaagaaaaagctgaggactaaaaagatacattcatcattctagtatggaatattttttctcaaaatgtctgaaacacagaactataagcttaatttaagattttcagcctgagcaacatggtgaaaacccatctctaccaaaaattagctgggcatgatggtgcatgcctgtagcctatagtcccagccattcaggaggttgaggtgggaggatcaattgagcctaggagttcgaggctgcagtgcaccgagatcacaccattgcactccaacttgggtgacagaatgagatcctgtctcaaaaaaaaatattttttcttagacctgtcattcaaacttcctttaattattcattgtcattaagtatttctttttcagagccaaatccaaggagacttaaattgtattatcaagatttatttcatttataccacacacatataacacatatactttcctatactatagttttcaaaacactattgtgttgtcttcctttttagaaaaaaaatacagtaatacttgaaattgtattagcattttaactagcccagcacctatttttttccacatgtggtttccactggtggttttcataggcctctagaagttgtaggtgtagccccttgtaggtacagattgccttgtttaaataaaggaatcattttttctttaatagaacctaattttttaaaagcacatttaagttgtgcagttgtgatttgaaataataacaaaaagtgattacacctaaaagttctaaactggtacaatattatcatgccattagctgtgatggagctgaaagctgatagaacttacacttgtatctcatgactctgtttcctttgaagtaagcactggtggctgaccgagtttaatgtcccagctttttggatctctaagaggattacagtgtgattttataacctgccacaaattcctctctatgcaacttactatgtgctatgtatgtgtttttaaaaaaatcaactggagcatgtgcctgtagtcccacctacttgggaggctgactcaggagaatcatttgagcccaggaggcgggaggttgcagtgggctgagatcacaccactgtactccagcctatgggacagggagagattccatcttaaaaaaaaaaaaaagaaaaaaaaaagcaaaacaaaaacaacaacagcaaaaaaccaattggaatcaaaatgtgttttcaaatgagtcactttattttttatttcttagagttttctgaaaaattttttttttttttgagacagtctcactcttttgcccaggctagagtgcagtggtgtgatctctgctcactgcaagctcagcctcccgggttcaagcgattctcctgcctcagcctcctgagtagctgggactacaggcgcctgccaccatgcctggcaaatttttttgtacttttagtagagacggagtttcactgtattagccaggatggtctcgatctcctgaccttgtgatctgcctgccttggcctcccaaagtgctgggattacaggcgtgagccaccgcacctggtcttctgaaattttaaaaattgcttcagcatagtgctgaaatactttatgtatgtaatgtagaagtcaatacaacaataaaaatatcagtcctctctctacccctctccactctgagtctaaacactttcaactgtttgtgatttactttcatgttcctaaataatatgcaagtgcagttatttcatttcgtttcaagtgtagtcactttctactggttttcttctggggctgatgagaatttagctttcttaccatacccctctggctgcattcctcccatgcccccactttgtccttcctctcatcctcccaacataatcgtctaacaatattctggctaaatttaaagctgagtcatatagtgtactatggtaacatgtttatgtaaccttttgtgggtttctttttttcattagtaatagcttattttttgttgttgcttagttttttatgcttattaggaatttctccctaaattctttggtagaattgtgatactcccttgaatagagttggactctaagataatctatcagtttctttttcttttcattttttttcttctagatgcttccccactttaattcctttgtctctagctcctgtcactcctgactactctgcaactgccatcctggagctcagtcttcataggaatccctttcatctgtgtcctccacgcaatttcctattgcctgtatcccatgcttttccagtttgggtttgttcctcactttggtaaagcacaatctccagcagctgctttttaaacatttgaaaattttattttatttatttttttttttttgagatggagttttgctcttgtcacccaggctggagtgccgtggtgcaatctgggctcactacaacttctgcctcctgggttcaagtgattctcctgcctcagcctcccaagtagctgggattacaggcaccctccaccatgcctggctaatttttgtatttttagtagagacgtggtttcaccatggtggccacactggtctcgaattcctgacctcaggtgatctgtccgccttggcctcccaaggtgctgggattacaggggtgagccaccgcacctggcctaaacatttttttaaattgaagtgtaccaaactgtttgctaaacttaaatgcactaacttaagtgctcagcccaatgcatttttgtatacacagacattcacgtaactgacatccagatcaagatattgaatagttcccaaactcttcaaggctccctcatgcctcttccccatcagtaacctctatcctaccccgtaccttcaacacggtcatcgctactctggcttctaccaccatcaatgagttttgcctgttcttgaactttatataaaatcatcatacagtatgtactgttttgtgtttggtattcttgcatcatgcttgggagagtcatccatgttgttgcatgtaccagttgtttattttgttgtttgtttttgctattttatgtggtatgaatgtaaagtatttggatataataaataaagctgctacaaccagtctggtccctgtcttttgttgcacgcatgcactcatttcttttggggaatatcacctagaggtggaattgctgggtcatagggtagccattaacttcttgagaaatggtacagttagaaatatctttgataggttatacattaggttaggctagactatgctgcagaaaaaaataagcttcatttcttttttttttattatactttaagttttagggtacatgtgcacaacgtgcaggtttgttacatatgtatacatgtgccatgttggtgtgctgcacccattaactagtcattaacattaggtatatctcctaatgacccagccatcccattactgggtatatactcaaaggattataaatcatgctgctataaagacacatgcatacatatgtttattgtggcactattcacaatagcaaagacttggaacgaacctaaatgtccaacaatgatagactagattaagaaaatgtagcttcacttcttaatgggttaacatgtcaagtctttttctgggtcacaccaagttggctggaagttgggtaactctccagggcaactatctttcatgtggtgatccagtaatgcaaactgcttcaatctcgtggctccaccatttcaacatcagacgtcttcagaaagcgtggagttcatactcctgtctaactatttggccagaaagtctatgtcacttctgttcacagccatgatcagaacgtgtggccctgcctaacttggagaagcctgggaagtgtagtcctctttgcacccaggaaggaaaggggaaccagatattggggagcataaatactgtataccacactttacatacctgacaataccttgattctaatttcacagtgaaatgagagattggccagggagtaaagccttggtagaaagtaattgttttccttgggatctttaagtcatttctacattgctttttagcttctactgttactgttaagaagtccagtacattttgaatcaactttatgtggaaactatttgtttctttggagttttaaagagttttattttttattcctagtattttgaaatttcacaatgacataccttgatatgggtattttactttcttatctttactcattgtggtttttttgtttgtttcttttgtactgccttctaaaagatattcttaattttacctgccaattctttgtggatttttaaaaacatttctactttaacattttaatttttaagagatttttatagcatcttattatctaggtgcaggaactcttaaaggagggtttctgaagtcttctcttgcattgcctcttttcttcatgtttttgttttctatttatttgtcattgctcttgtttttaaaacctgtctctcatattggagagtttcctaatgtatctggagatctttggctgcctacatttaggcgtcagggaataaaatgttgattggaagccctgtgtgctttggtaggacttgcagactggtggactgcactgtagaatgataggcaggagccaggcacttcgttgggtgactgccatgtcagtattagtaggtgttttccttagggttggtcactttctccaaagaagaacttgccagtctcctctgtagggagcataggctttgatgtctgtgttcatggagctgcatgaaggtttccacgtgtcccccttcagtatgtggactttcacttaatccttctgtttctgtccagcctcttaccctactccccagtatcactgagtccagaaccctgctggttcagcctctccagagagcaaacatcctgccttctaccagggaagaggagagacgctcatctgactggaggcatggtgaagactctataacttacttttatagacattcaacaaagtctttgcctttggctccacccattcctgtcatcttcatcaacaccaagaactatcaatcctgacctttcctaagttctttagagcaacttatctttcttcttcttggcttcctcttaggttttattaggcttttaggttttggttgttttccccactttactcagtcaacaactcctctctttttggctttccatcttccaaaatacaattgtcaacttttgtctgatgtctcctctacagctctctttgtccttgggagtttacacctttttaaatccccttactgtcattttcaataggtttctccagagagtatatataaatgtttgtctttaattttcaatgtttaatttgaatcataactactttgtaaagccagaataccatcatgtgactactgtggctaaaatctgttcttagaacttcaatcctacagcatgagttctaacccataagcatgcaagatctttcacgatttaactcttggtagcttttctaaccttaataaaacaacccagacaaaggattttgttttgtttgctatttttcaaatattcctactctttcttgttttcaaggctatgcatagactttccattacatggaatctacttgtcttcttcctatgaaacacctactgattcttcatcttttctatgaagcattctttgacttctctagatcagagtaagtctcttcttgtatgttcatatagcaaaaataataataattataataataataaaaaatataaatataaatataaatataaaatttttattttatagttatatttttataattttataatataattttataatataaaatttgatttttattttataaaaataaaaatataattattattataataaaaaatacttctttaaaaacaactatattttcccaatcccacagtggagaatttaggtgtagtattttgcagttccacaatggaggactgctgcacaaaatattgccctcaatggctacgattgtgtcctattcttccttgacttttctagcacttagcaaagtgtctgtcatatctcagccattcagtatatattttatgaatgaatgaatatggaagatataatctgagacctcttgggtgctgcaaaacaattgcatcaaaaggtaaaaccttcaccctggagccaggatttccaggtcctgatttttgcctcagttgagcttgcaggatataacctggcataacccactgtcacttttctgctcttgaatttactcacttgtgcaataggaatatctctcagaatgttatcttcccctccccccctttttttttgactcaagagtctcaatttgttacccaggataaagtgcaatagtacaatcatagctcatcgaagcctctacctcctgtgctcaagtgatcctcccacctcagtctcctgggtagctgagactacaagcatatgccaccacacccagataatgaaaaagcaataccctagagatagggtcagttgcccaggcgtcataagttttaaagacaggttaaaaaattgctttgagttccaaagtcccttagaccagttatttcaaactctgtaactgaattgttttcctaattgttctagataagtttgcttctcccaaacaccaagaaggcaaggacaccaccattgggaaatgccccacatctaggcatgataagctacccaccacaccatggctttgttgttctcattagcaatggctaatgagcaaggctctttaaaagatgcaccctttttgtctgaccttgtctgctcgacactggcctcagatgagcctacactcaagatccaccccacagctgtctccttggtaatcatgtcgtgggccaggatttgttttgtaaaagatccagctgtatggaaagtcccaacaactgcaaatagtcaatagaatagaatctttaactctgttgctgagacttccaggtgggaaaacctgtgaaagattggttcctctcaggaaacttcatctccacactggtgcacctttcctgagaacagtcggacaagcacatttttcatttagagcatcaaccctggaggcagccagacatgggattctgcttttttttgctgtctgacctcagcaggtcttatctatttgaactattgactgtgctgttgttaaatggaagtgtcaccactcgcctcaaagggctgggtgtaagaattcaacaacatcatgtgtgtaaggcactagcacccagcaggcatccccttccagtatttttcctcccagaaaggaagtcaccattctgctctgtagatttttactttttttccttttactgttggtactttttaaattttttggccagtcttttattgttccacccattatatcatcgttcatttttccttatttaggtaatatgtttgtagtttaaaatttaaatttaaaagtatacatttcataaattttagttaaatgttggtcatatctctcacatctgctttgtgatgatttccatcttttttactttattttctttctcattttttgtcacattgtgttctcttagtttgttggcttgaagagtaatcccagatagcgtttgggagtgttttattcaggcatccatcttcacagttggaaggaatagagaaccaggagagcccactcagtagaggtgagggtagtttggagggagagttgggagtgatggttgtggttgaggggcggggagtgatggttacaaaacaaagaagagtcacaggaatttgaaaacaagaaatgaaatagcatgggaactcatgggacttggaatcttgccaggaaccaaagccactcttttttttttttttttttttttgagatggagtttcactctgtctcccaggctggagtgcactggtgtaatctcggctcactgcagcctccacctcctgggttcaaacaattctctgcctcagcctcctgagtagatgggattacaggcacccaccaccacacctggctaatttttgtatttttagtagagacggggtttcaccatcttggccaggctggtcttgaactcctgacctcatgatccatccgccttggactcccaaagtgctgggattacaggtgtgagccaccatgctgggcccaaagccactcattttaggggtattcccctttcctctctgccccctttctccccctttctctacatctgctctgtgctcttgtcatatagaacatgtctcatgatggctagcccagcttcccagtctacatgaccttccatttgtcttcttacagctaagaagttagtctctcagtttctcaagtccaaaattttaaagaaagtaatccaattggcccggctcagtttttctcttttctcactggcctgcttatggatgagttagcattgatcaatgtccatcctagtccaactggatattgcctgggagaatagcattgcttggaatttctgtgactttctgggtatgcccctcccagctggagcatgaatgtcttagaagatagtttgaccagaattcccagctccaaacacagcagtgcactggattggatcaaaattacaaatattgggatgtggccaggcatagtggctcacacctgtaatcccagcactttgggaggccgaggtgggtggatcacctgaggtcaggattttgagaccagcctggacaacatggtgaaaccccatctccactaaaaacacattaaaaaattagccgagtgtggtggtgtgcgcctgtaatcccagctactcaagaggctgaggcaggagaatcccttgaacctgggaggcagaggttgtagtgagctgagattgcaccattgcactccagtctgggcaataagagtgagactctatctcaaaacaaacaaacaaacaaaaagaaaacaaaacaaatattgggatgcttattctaaatgagaaaatccccccgccccccacaaaaacaactaatgtgtcagaaaaagacttatcctatgatgtagagtgtttttggaattttctctattaaaaatttaggtacctgagtgatcactctccttcttttggaaactttcttttatgtggaagctgtttgcaaataattctaaagtgacatcgttccaaactttaaaatctcacctctggaaactcctaagatgtagcaccacttgtttcttcactagctcatttaagagggggcgaccaaggggcacatgccacaactgagccagcttacctggctacagagttagataggaacctggcattcaggcatgtcacctgcatacatctcacacataggcacaagtgggcttgatgtgggaggtcctgagggatagggtcaagagggatctctcccatgaggcgaggaacctggcccttgttcatctgggtgaccaagcccaattgttaaaacacaaacaatctattccctgaaattttcttttttcagagtgaatctcccatgttctagtttatacctaaaattattctacacatattcagaggcaacatagtaaaatctcacaagcttttctgagttactctcctaacctagttgtctcagcaatctctctcttttcatctcttcactctctttttctcctctcccacaaccctccactcctaccaggttgtgctctccacctctccttaacgtggttttaggagtaacctttaggaagatctgactagtggagtcaaattgccataaaacatctgagctctcattctgacaatatgggaatacagctgtaaggccaaagtgacaccatccctcagctgaagtattgaaaatgctctactctgcctctcctcctttccttcccatcttctcgaagccagcttttgtaaagggtggatgactgtgcacagggaatttgcttcttatcaaaagcatgaaaactggtacataaacctttattactttcccctatccattttcactgcttaaatctgaaatgtttcactttgctttcctaccaagttcaatggtttctttaggaaacaagagtgtaggcctggcacagtggctcatgcctgtaatcccagcactttgggaggccaaggcgggtggatcacgaggtcaggagtttgaggccagcctggccaatatggtgaaaccccgtctcttctaaaaaatacaaaaattagccaggcatgcacctgtaattccagctacttggaaggctgaggcaggagaatcgcttgaacccaggaggtggaggttgcagtgagctgagattgcaccactgcactccagcctgggtgatagaatgagactttgtctcaaaaaaaaaaaaaaaaaagaaaagaaaaaaaaaacgaaacaagagcgtaatgtacctctaccattgatgacagagaattatttttctacactttaatttataaacgatataacttacccaaaaggacagtatttaaacaagctagggaacaaatatcaggcagagaagggagttatttattgttattaccaacttttctcctttctaacgagaactctttgaaagaaatgggtcaatgccatgcctctattggaaaatatccccccaaacagtgctagttagtgtttctgtctgttttctacatagagtgcttcgtgaaagacacgcccaaatagcataagaccagagcttgggaacctcagtctgttccagaaaccagagttcccacataactacataatgtgctgctatcaggttaccagctcaccacaattgcctaatgtgacagtgagtttggggtgctgctgtggggaggtagaattaccaggggggatgacttaggctgagtggttgcagtattaacgtgcacagctcataagcaggccaatgctccacctaaatatttaatcctaggccaaggatatccaggattaaacttctcaagatcttttcctccactttgagataatattgtgtattagctattgtttctatgacacaagagtcaagcaaaggacagcatttaattgcactgctggtcttgttttcatgcctctatttcagagtatgttttgatttcagaatcccccaaatgatttctgacaaggtttctggtttttcctttgcagtgcaaaaaattgcttgttgacttttttataacaggttcaggatggtgatgatgatgatggtggcttgtgactaaatgtattttgatttttttttaagagatgagaacttgctacgttgcctaggctgaagtacaatggctattcacaggtacaatcatagagtagtacagctttggctttctaagtttaagagaccctcctgcctcagccccaagtagttgggaccacaggtgtgcaccatcacacctggcttaaatgtagtcatttttatatcaaatttcagcctgcatctgttcttgttgctaatcattacccggtcccagagcctgacctggaatgggctaggctcactagtggaatttatggagtttatccaatttagggagatgacagggttgaatgttgacttcacacattcatggaaatgacaggtaaaagtggaatgtttaaaagacaagatccagtcctgtttaatgtggttggtagcgtttctagtggtgcatcaaagctcccaggagtaaagcctaacctgggtcctaggatttaatagaattctggcataggatccaagtctggaacttgatcccctacattcacttctcagttcctacacactacacacattccctgaagaggtcctgcttggctcggagttcccactatcacagccttggtgggccaccttttctgaccctggatgaccaaatccccatgacttctaatcccatgtcttaagcatgatcatcactccaccccctagctcccatgtgacagtctagatcactgtttacctctcctgatggtaaattccttggctgaaaattatccagatgtcctgcacaactaaacaggcaagaggttaaatagtcctgtataatgacgaattgcaaagatttttcctaagtagcaaaatattcttcaacttaaatcttatgcagatgtccaatatctaagacaggtgaaagtggtactgcagggatgttccaccatgatgtcgtgttgaccctaaggaaacttcacaaacttgaccctaaggctccccagaacatggactggaaaccactactgtacaggattctgaaatgggatgaagaaatcaaaaagtttgcagctcatttcaacagtttcttcacttagcaattatagcttctgttccatgacctgcctctgaacccaagcctcttggattctattcagagccagggaatggggtgacctataataaagcaagcttcccactcccttgttcaatttcttctccaagtttttcaccaaattcctgctcttgtatgtcctgcaggtctctagtcaaaggatctagattctaattccggttctgctttttccagctgtatgtaaggatcatttgaactccctaggacctgatttccttctggactgatggtgataataaaacctactttacctgtcatgaggataaagattaatataagctaactgtataaaagtattatataaattaggcattatacatactttggaagttgttattaatacatacactagagtactggagacaagagatacattaccaaagatttatggttaaactgtaatcactgttcttaacctggatagctctggaggcacacacagaggatacagatgttggagaaaaatgacctgctttttttttttttttttttttttttagcatcctcccggtgctatgaatgaggagttgacctgtgatgtagagtcacaaatctcagtgtatgctagcaggagatttaagggagatggacatctcccctggtgaagtgtcatagagcagaagatgatcgccaaactcagacttttggcagcaccgggaaaatgatgaatttgttgacaaccagcatagggtgtttgaccaagcacctatgtgaggctgcaggcaaagcaaggcaagtttcagcatttgtcctgcgtcatccatgagaaagtagccatggagccaatgactgcttccatgcattcacgcagaagtgctcaggatcctggagagaaggacaatgaagaccgacagtggcaaagaggaaccctattaggagtagcctaaggcaggtcactgctgtaatctctcacatattatagtattctagagtgtgaaaaaaggaatttagagattatttggtgcagaagtcagaaacccatggcacttataccatggcagacaccactaagcaagactcactgtgagactccttaatcataaaatggattaataatgacacaatttatgtagatcacttagaatagtgactttcacagaatactcaaaaattgctatttttcacaatgacccatgttagcattttcccacttactcatgatgtagtctcagaatccctttccagacacaacactctaggaagccacctccaagatgtgagaagaaactaaggagccgtttccaatgattcctagttcaattcctcctcctagccttgcccccaccaccattttgtgatgaaggaaactgacgctaagggagaaggagtgctgcctgtccactgtactgtacaccctgtaaagactgatcatggttggaaacaccggtcattgtatctgctttctggaatgttactgtacagcatctcacctccattttaaatagcccttcataagcgagacatcgtcttctaagattttggtaactccctctccccatgtcagtgtcaccaatgacttagtcatattactgtgagacaaggcgaggtgaagggaggctcaagttctgtgcagagtgacattaagcaaaggaatcacagagttttagaggaaaagaaaatgaatgacttcacagtccatgtgaatgacaagacaagatggaatccatagggctgaaaagagactagtataacattaatcatgttatgctggcaacaatagctggccctacccttagtattttaaccacttcttaatttgctaagcttcttgatgagctcaagtagtcgtaccaaccaggggctgcgaagcaaatctgcctgagaggcggtgagtcactcctctgaggctgccccggtgtgcagctatctggacttgcgccatgcttgcttttcccccactacctccctcctcctccccatttctccccagacagattgtgaagtctctttgcttggtccactccctgcctgtctccaatcctctgattgcttcaccttcccccggctgccattatctgtcgcgacccaccctttcggcatccagtcctcggtccacacccagtgtcacttttctgttcatcagcctctttctctgctctcactcccactctctttgctgtagcccatttctttccattcttctcacttattagtttcctgagctccacccttccttattcatcccagttcttatcttttatgtctatttctctagacattcttttctttttaaacatcacagtgctgagatttaaactcagaggaaagtgtgttttgacctatactacccttcatagcacattttctcaagggtttgacatttctcatcatgatctgcattcaaactattcattctcttttgtctactgatagactttcttcaataccatgtagctataaagtcccatcgatttttttttttcttgttatgttactggaggcggacaggaggctgaaagagcaatgagcacaagaacgtagaagggattggattggattggatgacttccagcatcttcatgagctctgcagccctggaagctagattttacttcaccatttgtactcattctctccatatcatttctaagaatatattcactcctttatgcacagaaaacctggactggggtagagagattggtctccctgataaaaatcttggacaaattactatttgctttatcaagtgaggggaagaaaagggatagggatagaagggagcagaaatagtataatccctctctctttctctcatccccttctgtcaacctgcaaatgaagaactggcagctaaaccatggaaattggactagtttaatctggttttcaaagatggagttgaattggatcccttggtagctataaagtaggcaaagttagtttgctctgccagaacaatttgggtttcatagattcacagatctcttccatctggagacacagagctgagctagcagtcgggacccatttttgaaagttagggcttgtgtgcatgaagtgggacctcagctactccaggtgtttctggacatcccccggggtgcctcatatgtgctcccacccagttctcacagtcattcactccagccctctcacaggtatttgctgccccaaagtcacagaacaccttgccccaaccctgtaagaatcccaccagctccctccacatggtattatttcctggtgatctcaaagctgaaaccctggagatgcaaaaatgacagcagcttcccctagatcctgacagcactggagcatcttgtgttccctgtgggcctggtagaaggcagtgatatctgtcacaactgtcatccaggccccaaagcctgtctgctcatggcctctggctctgtggagctcagagaagaaacagaaatatggaaaagatctcagctcccttgcacctgcccccaagcacctttgaacagcaccctatcaagaactcccttcctctctcatccccaccctcctctggtgaaaatcagcactaaaaaatagcccaatcaactcacagattgacttaaaaccctttgcctttgatatggtttggctttgtgtccccacccaaatctcatcttgtagctccataattcccatgtgttgtaggagggacccagtgggagatgactgaatcatgggggcaggtgtttcctgtgctgttctgatgatagtgaatgtatctcatgagatctgatggttttaaaaatgggagtttctctgcactagctctcactttgcctcctgccatccgtgtaagatgtgacttgttcctccttgcctttgaccatgattgcgaggcctccccagccatgtggatctgtaagtccattaagcctctttcttttgtagattgcccagcctcaagtatgtctttatcagcagtgtaaaaatggactaatacagtaaacttgtaccagtagagtggggtgctgctgaaaagatacctgaaaatgtggaagcaactttggaactgggtaacaggcagaggttggaacagtttggagggctcagaagaagacaggaaaatgtgggacaatttggaacctcctagagacctgttgaacggctttgactaaaatgctgaaaatgatatggacaatgaaatccaggctgaggtggtctcagatggagatgagtaacttgttgggaaccggagcaaaggtgactcttgctatgtttgagtgaaggtgactcttgttatgttttagtgaagagactgcaacattttgcccctgccctagagatttgtagaactttgaatttgagacagatgatttaggatatctggcagaagaaatttctaagcagcaaagcattcaataattgacttgggtgctattaaaggcactcagttttaaaagggaaacagagtataaaagtttagaaaatttgcagcctcacaatatgatagaaaagaaaatcccattttctttaggagaaattcaagccagctgcagaaattcacaaaagtaataaagagtcaaatgttaattcccaagacaatgggaaaaatgtctccagggcatgttagaggtcttcacagcagcccttcccatcacaggcatggaggcccaggaggaaaaagtggtttcgtgggctgggcccagggtcctcattctgtgtgcagcctagggacttggtgccctgtgtcccagctgctccagccatggctgaaaggggccaatgtagagctcaggccatggcttcggagggtggaagctccaagccctggcagcttccatgtggtgttgagcctgtgagtgcacggaagtcaagaattgaggttttggaacctctgcctagatttcagaagatgtatggaaacacttggatgcccaggcagaagtttgctataggggtggtgtcctcatggaaaacctctgctagggcaatgcagaagggaaatgtggggtgggagcccccacacagagtccctactggggcaccacctagtagaactgtgagaggagggccaccatcctccagaccccagaatgatagatccactgacagcttgcactgtgcacctggaaaaacttcagacactcaacaccagccagtgaaggtagcaaggagggaggctgtaccctgcaaagccacaggggtggagctgcccaagactctaggaacccacctcttgcatcagtgcgacctggatgtgagacacggagtcaaaggagatcattttgaagctttaggatttgactgtcctgctggatttgggacttgcatggggcctctagcccctttgttttggccaatttctcccatttggaatggctgtatttacccaatgcctgtacccccattgtatccaggaagtaactaacttgcttttatttcacaggcttatagacagaaggagcttgccttgtctcagatgagacgttggactgtgtggacttttgagttaatgctgaaatgagttaaggctttgggggactgttaggaaggtgtgattggttttgagatgtgaggacatgagatatgggaggggccaggaacagaatcctatggtttggctctgtatcctcacccaaatctcatcttgtagctcccataattcccatgtgttgtggtagatgactgagtcttgggggcaggtctttcctgtgctgttttcatgatagtgaatgggttttacaagatctgatggttttaaaaacgggagtttctctgcacaagctctctctttgccagttgccatccatgtaagatgtgatttgctcctccttgccttccgccatgattgtgaggcctccccagccatgtggaactgtaagtccagtgaaacctctttcttttgtaaattgcccagtctcagctacatctttatcagcagcatgaaaacagactaatacagccttttttctgaatattgatataaatctgagtagtgatggatgtgtgttatttacagtcacctttgtagccaatggaagaacaaaaagtaacaatgtaaccattaaagatcaggaggataagggggagggaaagaaaatattctttctggttgttgcccttcttcttccccttatttcttctccatctcctctctccgtttcactgactctctcacttctatttctcggactcccatcggcccctgactttttgttccaaccaaaaggctcagttcctgcatgcttgaaactcttgtatattagaaagcacctgtgccttccaggtctacgaacagaagtcagcactttcaggcactgcagactgaaaagagattgttaaatgaggcaagaatctatcatctgtgagagaacagtttccatgagttgctggggtcaggagtcaaaattgaaaggttttttgaaattgcactttttaatttttgataaaactttaaggaaatatgttgatgaaaatgtactcaattttacctgtgaaaattgttttgcagctgagtgtgaggcagagggctgaggattttgagtcttgaattctggtaaactgtccaggaagtgtaaggccaaaataaagctctttctcgacaagcaagggtatccttgcttgaaattaggtaaggatgcacttcagaaaaagtaaatgagaatgaaagtcaaggaagaagcagcataggattctggaaacagaaggttcaacccaaaagtacaaaaaaggcaggtctcagaggtcagtcacgaaacgggaggatgcactgcttggagaggaaggcttgcatttgacagcacgactaaggggatgagaaaacttgaggaaatcataaaagcacattattgttttgtcaaaaaaaggcaaagtgcaggacagttctctgggtggccctggacagacccagttctcaactctttctcactttttgttttcaagaatagctgtagaatgttctgggaaggcaacatcctgagatagggagggactggccagaacagcctgggttctgtcccagtccagctacctgcaggacagaacatccttcagtgcttcatcccacagggtcctgttaccccagattataaaactcagaatgggttagttttagagtctcagctgtggtgcaagtagggcatgcacagttgagacttcatctgccctgtgtagctttcctgagtcctggggaactggcttacaatgaattctgggattctgcaatctcttgctacatatctgtaagtaataaatttgcttcatgtaacttgttgcatatgagtgtgttctgtctcaccagactcaggcaagttggtaatcaatgcacagtgaactacttcacacaaagcacattaaaagtgtcaggaaaaacaataatcaggacagaaaatcttggtctgaatatagagtaaataataaaggggtatgattttaagcaatttgataatatataagaaaagggaatctgtttggccttgatgctataaacattttccttacatatcccagaagacctttgagaagaaaatgcaattctaacatgctacttgggtcagcattgagcaagatttactcagtcacagaaatacaaatgctctgtattcacttctaccttctaaaattaatcaatagacaaagtacagatgcctgacagctaagcataaataaatgttaactgctatggttatgcaaaaactatgtctatatttgtaatttactctacaaaaaaaggagttgagatattgaccaaggttgatggaggatgaaatagtgtataaatgtgttatttaaagtcacgaaggcagtcagtgaaaaaactgaaaaatagtaacagaactattaaagatcagaagcataaggaggagggaaggtgaaggatgatgtaaagagctaaattgacattttaagagtaaattgatatccttaagtgctaatagatcaagaaatagaaatctacacctattatccagtactgtggatgtcagtgtttgcctcagggtatggcatgggtggtagggaaaggtatagagaaagactattattttaaagctcttctccattttttttcttaaaccatgtgtatttgttcgttctcacgctgctagtaaagacatatccaagactgggtaatttatgaaggaaagaagattaattgactcacagttccacatggctgggaaggcctcaggaaacttacaatcatggcagaagaggaaccaagatgtccttcttcacacggcagcagagagaacaagaaggagaactgagccaagtgggaagccccttataaaaccatcagctcttttgagaacttattgtcatcagaatagcatgggggaactgccccgatgattcaattacctcccactgggtccctccatgacacctggggattgtgggaactacaattcaagatgagatttgggtggggacactgccatatcgtcatgcttattcttatattcatacaatatgaacttaaattatgccccactttatttgtacctattcaggacagggagaacccagcaaccaccagggatcaggctttttcaaatgttcatcatacactatgcattcattttcatttttcaccctcatatcccccacaataaaataggtgaggtgctgacccctgcactgatgtcatttcttcggaaacaaacatcactgtttccaagcttgtctatttactaggcttggtgaggctgagaatggacagcagggcaggaagcattgtccccaatgcccataagcctttgttttcttttcttagaggatgacacttagaacattctgttttcacaggtggcctccttgctgaaatgtgaaaggaaaattgtgaacagcaattttcaacctgtttaccaatgttttcctgacatagtactcttgtagctctgcctgcctggaggggaaaacaggaaggaagcagtgatgattccttccctcttttcactcccagtggccaccttggaaggatatgaggtgagactctctagctggccattgagtgctggccttagcttagtcactcagaaaccattgaggagcatcatacagccctacaaccctcccaggccacataaattcatatgtgaacacactgcagaacatttccccgttgggtatgtccatagttcaagtgaattgagagtcacctgcccatttaattgaagcagcaagatgaactctgagcatgggtgaagccttttgaagccaggggcaggcagagggcaggtaagcacttttccaaaatccaaagccaaaatgtagttattggtactgtggtagctctaaagtgttaacatcccttctgcaaattcctaacttcctctaagggaattgtttctacacttagttcaatatttcaagagaaatgcaaaattaagtaaacgaatctttttttttttttcctttttgaagccatcacaaacttctgggtcacctcatattgacaaatatttgttggtcaaagaacttagaataccatagactaaattttatatcaagtgaattcagacctttatagttaaacccattctcagagaagatgagaaacaagataccagaccctatgcttgaattggaagactaaaggttattaaaaaaaaaaaatctatctaaagtggttaccatagtgcctcacccaaagtagattctcataattgtaagagtgttatcattactactactactactactaaggttctactttttataaaatagcataaggatgtgtatgctgaaaaatttcttagtgattataacaattaggatgcttttgacagcaagtaacaaaagacctatgcaactcaacatggcttacatgataaaaatatttatgatccatatgagaagtctagtggtaaaacagttcctgaatgggttaattcagcacttcctttatgtaataaggaacgtaattctttccatcttgtctggcctgccaggctgactgtgtcaggttttgttttttcctctaacggtcctatggctgagactctaaatattgcattctcacacacgtatatctaagtctggaagacagaagcctccttccctatgtctctttttaagagtgagaaaaactttcccagaaacctcattgcagacttcactttcatctcagtggccggaattgtatggcatgcccatttccaaaccaaggaaggacaaaggactatataatgctcataactggtctgggggaagaggccaatacttcctgaagcccatgtactcctgatacccgaacaacatcaggtgaattcaggttgaagaaatggggaatggtcattgggtgcacaaccaacagtaacagccacagtgttggagctttatgttaatgtaatcaacctgatttcagcctatacttttcacaggtctaactttagactctttgagatagcaatgaaatcttatttgtcattagattctccccaaaatgcttaacattaaatgattttgtagctcaataaagtaagacaattacatatcttttccatagttatgttttgttttcattatgagaactgagagctcaactaattaataaaaacaggatttccggttgttatttttcccctggtgacttttccttttacgtttatcctgagttaagaaagtctgaaactgtcttcattagggttgaacattaccatgagaatagagagtagaaagctaagaaaagcgtgccatcagaaatttcttttttctaggtttcatctctattcttatcaaaatttcaaatgtaatggaggtagtgggaagaatgaatatttttgtttgatggaatcaaaataccaaatttttcattgaactgaaatgattaaaactaatttttatgagaaaaacaaatataagttgctaaatcaaatccaaaaaccaattactaaagtgcaaaaaggaggtatgggagaatgtgtgagtggtaaatctgaccctgcatgaaaaaacacttagacattgatttggaaaagcgttatactgcaaaagcaatcccaaaatcttgtgcacaatgcaataacagtttatttttcactcaagcaaattgtgctgcatgtctgggcagcgtgctagggctgctgtcctccatgtgttggctcagcattccagcttgattcaatctatgacaactctgtatcaacacatgggttgacaatagtcaggatgggcaaagagatgcctggaaagatgagaataagcacttaagtgcctgaacctggaactgacatgtgatactctactcatttcctattggccacagctggtaacatgactatttaaaaaactgtttttctctattctcacaacacttctaacactaaatttgtggggatttttctcacaccaaccaatttttccaattttcaactaggtgtcctacaatttaactcatttctgacactatctgcccagagttggtgccgaccccacaggttgaggcctcagtcctacaagaatgcaccactaaaggatcccgagcacagaagtttctgtctccatggaatttggggtgctccatcttcccagcatgtggatgcattcttgttcaccaacctggaagctcttcaaacccctttgcttaatttttttaggaaggcttcatgatataggcatgattgattaaatcactggccattgatgatcaactcaacctctagcccctcgcccctcccagaaaggcagagggtgtgaaaccaagttccaatcctctaatcacatggttggttcttttagcaaccagttcctatcctgaagccatccaggaaccccagccaccagtcatctcattagcatacaaaatacacttatcatttgggagattctaaggattttaggaactgtattccaggaaagaagggcagagacaaaatatatattttgcattctgtcacaatgaccatagctatcttcaagaggcaggggagtgtactacttccatgtgctcagagagtagagcagaactggtgattggtgaccaagggcgtggcctagtcaaaaattctagtgggaagtaaattaattatgagttcaaaataccacaggctttaagaaacagataaataggaaacaaagtcaatagaagtaaaatctcagaatgaagaaactgataatggtgttggttcctctccctgaacagaatatacattgagtgctgtgttcatatgagggactgaacttcaagaggtcctccggaggtgttcagagggaagtaactagatgcagaatagttaagaattcttatggtttagactagagaaatctgaggacaaaatagccattcattctcgaatatatgaatatttgacttgctttaaggaactgtgtgttgtaatttacaaagagacagactctttaagaaagagtattttgcagtcacactgcattagttgccttggggagctctccttctcaaagggtggggctccaagcatgggatgaacgtcctctggcacaaagaggaaaagagggaattcaggcatcatatggctcattggattagatgatccttaaagatgcttttactctcaaatttgatagcttggtgggataggtgcccacaattcccatttgggtgattgccccaggacctccaaaactactggcacttgcttggacttcctctcagatcctggggccatacattgctaggatctggctacacaaattagaagctgatgactcatatcccaaaggtgaaaagatagggtgtggttctgagtcctgagttgctgtattttatccagaattgaattcacaaggcggcttcgagtcattccaaagctaatgtggaaacacacaagaagccgcacaccctattgtcttcctgcagtgaagttgggttgaactcatgcaaaccaaagttgatttaaacaacaacaacaaaaatcaaattcttgtcaggcaaagtcttttgacgttgttttattcttgagtgaatatttacagctgagttggaaactctatcaaataggaattagaactttgccaactcctgatgtacatcttagccagggtatgcagggtatgcacgcagcctcttcagagctgctctgcttcactgaccaggggttgactgagttcttcactctgtaaccatttcctgacatcctctgcatggacactcttgcacagacatttttttttttttaatctaggagttgcactttcttggttactatggctgcaaattgtttatactggattcatagtcaggtttttatttccttttgtaatttttcccgtgaactaataagccacagtggagttaaaagtgcgagtaaatgtgaactctacacaaagcatttttatgttctattgccattcccttcctacccttaatcatttagagctgttaacataaaaaaaaataaaagtgttcagcctcctctctactcccctcctttgccctctcatttcccaagcatcagaggggaagaaccaccacccatttcccatcaggactgtttgcagagtaacacatgtcctcaattactgggatcagaaactgaaggcaccttgggttggtgatagatgactggttggcctctgctggatatgcgtcatggatgccacaataggaatggcttagcagggcaacagttttctctcctatgattcacttcagcttttagcctgggccatccacccagtactcattggatatgggcccagtttcagcttatatgtgaaccactctatgagagaatgcaagctgagagcccatcttaggggagaaagatctcaaactgaatcaagagggggaaatgcttaagagttacctttcagccaggtgcagtggctcacgcctgtaatctcagcagtttgggaggccgaggcaggcagatcacaagttcaggagacggagaccagcctggctaacatggtgaaaccccatctctactaaaaatacaaaaaattagctgggcatggcggcacgtgcctgtagtcccagctactcgtgaggctgaggcaggagaatcgcttgaacccgggaggcggaggttgcagtgagccgagattgggcactgcactccagcctgggtgacagagcgagactccacctcaaaaaaaaaaaaaaaaaaagtgacctttcataataggaagagacaaggctctagataaaactgcctgggtttgaaacttggatctaccacttgccagttgcatgacttttcgccaagccacataatttctcagccacagtttttttcatctgggaaaaggaaattaagaatgataatccctaactcatggagttgtcatgaaggttcaagcacactgcatggcattgattaaatgctcaataagagctaacaattatcccagtcaagaactttttcgtagcaatggaccaaacacttctcacaacagcttaagcacagaaaggcagtgattgattcatatgagatatggatggtccagggagtcaagaagtgtcaataagactcagtctctgctccccttggttctgctggtgtggtagccagcctaccaggtgactgccaatgatccctaccttctgacaatgtcacccttgtgaagttccctccggcagtgcaccagggtgggtctatgtgaccaatatagtatgaaagaaaaaatagtatgttgcttccatgtttaagttataaaagacaccatggcttccatttggcctctatctctgtctctgtctccctcccattattcacgctggggaagccaggtgctatgttgtactcagcactacagagaggcccatatggtaatgagctgaagtctcctgccaatagccacatgaggccattttggaagtgggtcctccagccctagtcaagacttcaaatgactgaagtccctgctgacaacttgactgtaacctcatgagagaccctcagtgaaaactatccagctaagccactcctgggtgctatccagctaagtcacacttgaccctcagaagttgtgtgagataatacagatagccttaattgactatggttctatttaaatgattttttcagccttataatggtgtgaaagcaatatgcattcggtataaccatacatcaagtacctatacaaccatccaatttttcaccttcagtacagtattcaacaaattacatgagatattcaacaatttgttataaaatagtctttgtgttagatgattttgcccaactgtaggctaatgtaagtgctctgagcaagtgtgaaatgggtaccatttctatctctattctatgaggagtagaggatcagaaaatttaagtaactttcccaaagtcacacagctagtaagtgatcaagctagaatttgaaccaagacactttagttctaaggtccatggtcacaaccacactgctaaaacaccaatactatgaagtatcacaacctgttgagttttgatttcaggtattttgtcctcttatgtctcagttttactttctttcttttttgttttttgaaaaggagtctcactctgtagcccaggctggagtgcagtggtgcaatactggttcattgcaacctccacctcctgggttcaagtgattctcctacctcagcctcctgagtagctgggattacaggcacctgacaccatgcccggctaatttttgtattgttagtagagacagggtttcactatgttggccaggctggtcttgaactcctgacctcaagtgatccgcccacctcggtctcccaaaatgtcgggattacagacatcaatttttcatttatggagtatgtgtctctactgaattagaaatggagatggcttggccttaactctgaagtactggacagatgcagttaaataccagtgtggggggaatgtataaacactttctagtgatgtgcatccagagttctactgtaagcacctcctgactgacagaccattcacacaaaggcaccctctcttccaacactaaacaccagtgatggacaagtggacatttaaaaagtcatggatcttctgagtgaatattcatgtagagaggtacctttaatataagccatttaatattggctataacccatttacattcctatgtttatatttgttccaatcaattgcacaacaaccttcctcatctggccatattagtaggaaatttattgttttcttctgaagccttggctcccaacttaaattgtacagaaacctggtgacttgttcagtgcagatgggttagtttggctcccaagctttaggctgtttgggcagttaatgccctagtgtggtttgcagggtgccctgcatgttgtctgctgtggcaatgggccctcatgagtcctgcactggctctgaattaacctcaccttcaggcttcaagatgtaggctctcttcagttatatgcagaaggttatttatagcctcccaaacataaataccacagcagggtggctggtcttggctgagcatgcaggagtccagcccaggctacactcctggaaccagctcttcctataaacccgtggccttgttcattgatccagactcctgcttcctgcctgtgaagttcttctctgggccccttgatgtcccggggaacttctgttaggactgtctcgatccatcagagaggctttcattctgtagaactgcacaaacaccccagcagttctgaacctggagtgtgtaacacacccttcttcctggagagtggccaagtctgcataacctagaccatccaagtgttgtagggaaacatcgagtatcatctttcccaggatgactttctgcatcttcctaaacacaaaagctcttggcaaattttctttctaaaaatgtattgaagttatacttggctggacatcctgctagagaaatttaacaacttcccagtgtattagaatcttgggcatactctcagatggagccggcctttctagccccatgtctttaataaatctacttgattagagaagagacaattccctaaagagagggcactaccattcccagaaaaagagagggctgttgggcagacagaccaaaggtgacaaatacattgaacaatgtgtctgtgtctggctagctttgtgcttgagaaaggggaagacacaaactttttgattctagctggtcctattcttactgcaataaactaggtattgttcaccacttatgacattttagtagaaaaattaattttgagctaatgaaaatttgagacaagtatatgaattcagaggtaacagggagatggggagtagttactaagtagattgttgttattgcctcaggatcttgacactctattcattttctatgccccaattccattgggaataagagggtagcaattttatcagttaaaaatacacaggtaattacatagtgggcagtttcatctcaaaaataagaaggcaccgagcaaagcaccaggaaataccaaaactatttggatgatcaatgttgaaaggaaagaactcaccatttcttctctcctctcctctcccctgccttctccacctcctttctttgagtgagcaacttgctacggattaagaatccttggcaaaagcatgtcccttttgaggcaaggggaaattaatatttgggggtgaaagagagaaggattgggagaggtgtaagcaagaagccaggtgccgatgatttccctggaaacctaagactttctaattaaaacctggcagccccaccgaacagcttgcaccatgtgggaaagaaaagcctgaaaggttgggacaaggaggcctgatgtaattacattccactgagtgaggatcctttcctgtgggtcagtattgtcctgggaatatcatattctgttcctaataaatttcaacaggcaaagacatggacacatcacctaaaagaggtcttcaaatgattatggttcctaaaagtcaggaaataggtctgatttcccattaaagtaggtttttctgttcagcagggttcccaggtcgctgtcatataaaagttatttgctgactcatcttgaaattggagaattttcaattttccattgtgcatagttctgtctctttccagagttttctttttaaataattttgtgcaatatatgtgaactatgtttccctgttttatatcctaacaagaaatgttacttgttcttgattccgataaagatgggagaaacacggttttttcaggacttctcaatttagtgtgtaaaaaagcataagacatggaaaattagtggcctcatattttgagacaaactattgaaaaatgtgtcttttatttaagtctttccacattttagtaagactttaaaaaattattgcacttaagaagtttttttttttttttttttttcttttggtcactcctttgacgcttatttacatatatggccaaataaactagcttaaaaaaacaaacaaacctttgtttgtttgtttgtttcagtaggaaagaacatggcttccagtaactcttcagttacttttaaacaaatactatctctccgttctggtacagggtcctactcttcctgtcttgagtcctggccctggctaggtgactgcatcctgagatttggggaatggaaagaattttggagaccctctattttgtatcacaactagtaaggggttccatccacaccctcgtccctctcaattaggcctctgcttgtacattcaggggtgtctctattttgtgaggctttttcctggaggagataaactcattttcaaagttgggcagggcagaaagactggatacattcaaattcatttgttaattcatgcattaatttattcctttgacaaatatttaatgagcacccttgtgctaggcaggctttgtgttggcactgaggacagagatcaacaaagcagacgtgttctctgccttcctggaggtcccaataggggtgatagacattgaccaagtaagtgcagggacaactaattgccaactaattgcacattttgcaattatgataagtggcatgaaggacaagtagaaaggatgatagggctaatcatagggagagatagcttagactagggggtcagttggaactattaactaacactcttttcatttttctcttatcacccaaagaaagccgggagtatgaaagtatgggttagaattccttaaaataactacttattagaaagggcaagaagtatcataaatgaaacagtattgatacaacctagaagtcattgataagggaatagttaactactttataatatacattattcagcaatattatttagccttaaaactaacttagaaaggagttgttatgggtttcagaaaattcttatgctctagcattgagaaaaattgcaaatgcagcgattatctcaaatatactatatatatacatatgtctagcaaatatctgaaaaccatatcaacatgttttccatttttatttgtattattaaggatgttacaagtatgtagctaaaacatatttttcatgaatacatgtaaagcaaacatctgtgtaaccacagctagatcaagacatagaacactgccaccatccacaggccgccctttcctccctttccccttgaacagcttgtatcataattctgtcttctcacctaaaggtaaacactatcctgatttttgtgataatcattttatatatatatatatatatatatatatatatatatatatatatatatatatatacacatacacatacacacacacacacacataacattttaatatacatatattatgtatatatatatacagttttatcacctatatgtattcataagtaatgtaagttagtttagctcaatttcaaacttaatatatatagaattatactttccttgtgttttaactcaaccttgtttgtggaattcatccttgccattgtgtatagctgtggttaattaatttcattgctttggtgtccctaggtatgaatgaatgtaacacagtttatttatccattctactatgagtggatatttgagtagtctccagcttgggccttttacagatagtattgctgccaaccttcttgtccatgcacattgtacacagtgcattgagcctctttactgtacaaagctcaagtggacttgctgggtcataggaggtgctggttattttcggtttctacccttccgccctaatccattctttgcctttctgtgccttgctctgtgtttctttatgtaccatattactagagtaccttgccttcagcttttagttaggtttgggcaatgggaggtaacagtgtgagtttagggggtgggaaaaagagtttggagcattctctgatttcctcttggccttcccacagttctggcagtggccgcaccgcgttttctcttaggttctagctcttacaagactctggtaacattctttcctcctcttgttgtttcaggcttaacaggctttccccactttctgtcccattattctcattgccagtggcaaggagccaagaaccttcttgtctctgcagcatagaacagagacagagcctcctgcccagccttccaggaagcccgagttctcatcttaattcccataccctgtttctctgggttcaggctaaggttacttctctgttcactaaagctgcatttattttctgggtttttctctgatccacttccagagactatgactccaagagcaaagcagtctgttcacgaaatagatcattccctctcagtgcccagattctgttgacctaataatcaatcaggccttctcatctcctttctctcttccgtcaacttctgcttcccacacaaacggtcctggtactcctgtagctgctcttcgccctctccggggatgttcgggtctcctgtggatctagacaggcattagtggtgaatgcaggtttggcgtcagagtgcctgggctcaaatccctgtcctgctatttattagctgtgaacccttgaagagggtaccactcaatttctagtagggcttctttctagtctgtaaaatggtgataatgtaagaataaaatgaattactcatataaacttcttaattgtgtctggtacctggtacattcttaataaatgttagctataattgtggttattatctgatacttatataaaaacccatcatgtcataaaagccttctgtcatgaaaaagatatatatatatatatatatatatttaggttcatgtagtagtaaagtgtttactcctcgaaaaagcccaaaggcaagcagatatatgagaaaaagcattgtcatataaactgctttatatcatgatgaccaatcctctcttccaacacttctcaaacccaaatcctttagggtctaatttggaagtggagagggcagaggtgcatggaaacagaagcggcgctggtggggtgctgtgtttcatgcctaggttatggtgcacgacagacaccacacactggaaagtagaagcttaccagaggagatggcaattacaaacgccctcaggaattcatagaaaccagggggagagttttacatttccacaggctggtggggttggggtagggggtgatgatagaattcaagcccatcttactctgatctaaggggcaaagacaccccatctgagttattcaagtagagcccagaatggatcactggcaccatctcccccagttgttgacagttgagcaaggagccgggcgttctcccctcccctcctcctgctgtgctctgtcttggccgccttccttatggataggccatatgggccgttttggagcctgtgtttgctttggcttggtggttcgcagcttacttcctgttaacattcctccacctctcaccccacattatgggtctctctctcagagccacctgctctttctgttctctgtgcccataacctcagctctctgatttctccattcattgcttggctcttaactgggactcaaatctcacttctgtttaagtattttccatgccagcttcttgtttggaccagatagtgtttcaccatgatgggcctttattaggagacaaaggggtgatcggggtggtaccggaaaaggcaagttcatgtatccaaatgactgtcaagtgagaccagaaaaagcccttcttcccatgagtttttgtccaaaaagcatcagacctagtatagaggcgattatggccaaaaaggcgagcgctgagtttgaggccaaaaaaaacagcctaggagtggagggaggcacaaaactggcacacgtgcctgtagattctctcacatttaccctcctgggtctccttaacccaggcccttggcctagtaagagtgccaggccaggccacagtccaaggccaacatgtgtacgaaactaccacaccccgcatgtggcatgacttgttctggctactcacaaacgactcgatgttcatctcctctagtggagttcagataaggcctttcagcttggctgtctccatctggttcttcccattgagcccaggtccagtggctccacagagaaacaccttaacctgcctcaagaacctcttcccttgacttcaactcaggtggatgtcccagccaagaatgctttggcaggatgaaaccgtgctgtgaagagcgtgttcagggtgtgggtttaagtctcacttcaaccaggtcttagctgtgtgaccttgagcaagtcccttcacatcattctacctgtttcctcttttgtgagatggagctaattatgcaaagaggtgtgagaattcaaaaagatcacccacgaataataaggtgggacaattccctgaaaagcacaccaggcctactgagacaggaaataggcttggtgttgtgtatggagaggtagaccttctttgccatttaggggatgagatccatagcacagtaggaagtatggtgggtagctgagtctggaaaacaactgtgtgtgtgaatgcagaggactgcatataaagtgccagagctgtgcctggcacttgttgtttgccagccaagggtccctgagttgagaacacacacaccaaggacagtggagaagagcagatgccatccttacatgtgcagtgtttttggccttgctcccattctgaaagtgcctgtctgaagggatctggctcctggaatgggcaggggtttttgtcatctgtttcgctgggaggaagtccacagtcagggattttgtagaatcttaatggtgaccgccaggcagtggcaactatagccaaaaacaatgaggctccttggtacactaaggaaggcttcgggtttaatgccttagggcaatactcatctggaccgactttttagactgaagaagccttcctggggtcttggggtttttacatagacataacaggggtgccaaggcatttagtgtacacatttgaaagattgtgactgcatttttatcccaagcttatgaagcagctacatttgtgaagtggttagcaggctgcctggcatattttaagggtttcataaatgatgctcattattattaagcacgcgtgtcacagcagccagagcactgagcagcgctccttggcagctgcagctccccaaggggagggcggtgccttacaagttgggagaagacagtggaatcattaagcagctgacacatacccagtcactccaaggaatctcccatccctgttcagaagtctgacccaatttgctcagcttttctcctgagactctcttgttccagccacaaatctgagctgggagcacccttcctcttagccacctgtgactgggaggcagcgggggtggcccagagctcaccctagttgggagacttgagcagtagctcctctcctccagcattccctggtgggggtgtggaaggctgtgagtaagggaagagagagggtgtggggcacctcacatggtcagggagggctcccctcccttggaactcacagcagccaggtcatgggctcactggggttgtttatcatcctcagtcttggggagaacaggctcacatgacagcgctttgcaaatcggtaagtttttttccaaacatacaaaaacctaggcctggggtttaggacttctagaacttcagagcacacggtcctgtgtcatgactctcaaacggggacacacatcacttaagtcaagtggaggtggagctgtcacgttagtcactgcagtttgcaaggcttgggtgccagattcttgtcagatacctctctgtatccctatggaaaccagaagaatggagagtgacttgtgatgggctgtcccaggcattgagtctcacagaatcagagagctgggagcacagggggtatgggagtgggaacagaggagggagatggggggcaggcagatgtgggaggtcacccaggacagctttcaggcagagcagtatcatctgccttttacagatgtggcaactgaggcaaaaaaagactcactggcttcccagacccaccacgacccactgcctcttcctgctgccgcgccagatatcctccttttttcatgaaagcaactgagttcatggtgttcctgtgaacttagcaattgtagaatgtggttttgcctggtggctggaaaagatcaggaacctatataagaagtaaacccttttcaacttgtacaagtccagaaggataaagggaggtacaatctaatgtggcaggaagaggcgttgggcccatggtgggtcagggcgagtgatttctgtgggggtccagaaaggttcctggcaagaataaggaaaccaagcgaggttccccagctgcagaggctaatgtgctctccacctcagcctgtcctatgcaccaccagctcatactcccttcaccttctttttttgtttgtttttatttaaaaaaaaaacaactgttggtgggactgtaaactagttcaaccattgtggaagtcagtgtggcgattcctcagggatctagaactagaaataccatttgacccagccatctcattactgggcatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaccaaacactgcatattctcactcataggtgggaattgaacaatgagaacacatggacacaggaaggggaacatcacactctggggactgttgtggggtggggggaggggggagggatagctttaggagatatacctaatgctaaatgatgagttaatgggtgcagcacaccagcatggcacatgtatacatatgtaactaacctgcacattgtgcacatgtaccctaaaacttaaagtataataaaataaaataaaacaaagtttttaaacatgctctttaacttttagttttccttgatcactataactccatctcctcagtgttcatttttaggggactaggtaaaggtggaaaaactaagaccaggagagaagtgactttccccaggccactgggcagtagagcaggggcaggccctcttaactcatgcattgcttccttccactttctgagccaccacattgtgagatgccgccctgtgtggactcgcacaggatttcattctttccacaaaggattgagacagacacagcccctgcactcatgcctgaatgtgcaatgggataggtgggcattggccaagtgactgtaaatgagcaatgcaaaagagagttcagagactttctgaattgttccaccaccccagtctctgggcttcccagacatatcctgtgcactcctgctggattactcctccgaatgttcccaaagctgcccgctgtattccaaattactctagacaggcattctggcccctctacgaccacacctcctaacctacttcctttacacacggtgcctgccagctggcctgtggcccactgcactgcccttactcgggatatcctctctctgaaaaagcccagcctggctgtctgatctccaagaagctttccccaacacctctgatggcaaggatctttcagcacctccattacataccccccatactaaattttaggaattcgttttgtggaaaatacatgtaatgcgattcaagaaatttacaactcccttcaggtaatgaaaagcccaatagtagacaaaatgaaactggaagaccttgaactagccatctctcagcacattttttctttttttttttttttttttgagacagggtcttcctccatccccccggctggagtgtagtgctgtgatcatagttcactgcaggctcaaactcatgggctcaagcaatcctcctacctcacccatccaaataagtgggactacaggcctgcaccacaacatttagctattttttaatttttttgtagagatggggggtctcactatgtcgcccaggctggtctcaagctcctggcttcaagtgatcctcctgcctcagcctcccaaagtgctaggattccaggcatgagccacttgcgcctggccactctcagcacatttttctaaagcccactcttacccatagaccactcacaacacatcttttctgagcaactgtcaagttctgggtattgaataacagaatacaacatacaaaacagggtccccagcctccgtgatcttacattttgagaaatccctggaaaggctgcagtctacatcagctgaaaagcatttactaagctccattttttttttttttagagtgctgccctcccctaggagctcaaccggtgatatatatcattgcatgtgatacgtctcataatatatctcacagcaccactgtgagacatccttaccttcccaattctgcatgtttactctggttcttctcagccagaaatgtcttcttcatatccacttttcagcaccctaatcgggtttccttctttgtgctccaaccttatgatctctgaatcctttgatcttctttccggacttgtaatttggcaccatacagtttagctgttcctcctacatgattcagaagcagtgaggtttggtggccttggagtctgtggcagagaaagctaggatatttgctctccttccattaggttaggttgtttctgggaaacagctatctggccacttcatttctcaacccctctgtatcttattggggccatgtaactaattatggaccatgaaataaaagtgatttatctcattttggggtaagagttgttgcagtatctaatgtgccatcatcattcagtcttcctcttctttgatgacctgaatgccacctgttggaaatagcagagcttcaagatggaaaggactggattcctgagtcaccacttggagaatcacctcccagaagagcccagccagccaggaacacctgcagaggatattgggcaacaaatacacttgtatcaggtcaagccactggaggttttcttgaccaaaacaaagttagataagtttaggattgagtcccatctctgccacttgacagccctgtcatgttgggaagattactcacccttcctgagcctcatattctccttcaataagaagagctcagtgatacccaaccttgcaggatggtcgtgaggagtaaataagatatttctgaactacttgaaacattgtagaaacccaataatttgtatatctttatgtgtttgtgagggtgtatgtgcatccacatagtgagtggcttcatatgtggtactcttgctgctgaattgtaaataagtggtttaatgttgtaaacctgtattctttctaaagcctagcacagtgcaaagcaaatggaagatctcagttaatatttactaagaagcaaaaaaaattggcttaaaatataaggaaaactaatttgctgtgctacctccttataatatccccctgtgcaatgggaggagtttacagccctctcccgctggggcagtgcttcccttggcttcccactgatcctgtcttctaaagtggatttctgtgtatacttgctgctcagtatgtgagtaaatgggtgtatttatttggataaaagtgcttttgtggtttgtgacaaaggagtagaagccagacagggaagggagggggcagattattgaattctttggaaatagatggtgaggaaaccatgctagaagggaccttgttttatatttttgcaagcgagctgtagacacgagctgtgtgatgaaatctctgagttgaaagatatcattaagcattcctgcccagtataaaatatcaaattgatgatgatcaaccatctcatcagattggtatgttgagattttggtaatcatgtcaatgtgtttttaaaaagaggacacatatttgaagaataagagcaatgaaggaataatggattatctgaggtcatcttaagccagcacagtttagtttatcttttaaaaacaaatcagacttgtcctccactattgaagaagcagttgaagctccttttacgcctgttcattttgatatgccctttgcatgttaatcccctgacaaaagctctctaaaaaagcaaagtaacaccaataagtattctgattatgctagatagagaataaatgcccaaccaagggaaagcaaaatgtttttgcttcaaggaccattcaaaaagttttttttaaggtggctcaggcttgtaatcccagcactttgggaggccaaggcgggcgggtctctaggtcagaagatcgagaccatcctggctaacatggtgaaaccccgtctctactaaaaaaatacaaaaaattagccgggcgtggtggtgggcacctgtagtcccagctactcaggaggctgaggcaggagaatggcgtgaactgggaggcggagcttgcggtgagccgagatcttgccgctgcactccagcctgggcaacagagccagactcagtctcaaaaaaaaaaaaagtataaacttcattttaaaagagtatagactgggcatggtggctcacacctatgatcccaacactttgggaggccgatgtgggaggccaggagttcaagaccagcctggccaacacagtgagacttcatctctacaaaaaaataaaaaaaattagccaggcgtaatgttgcacacctgtagtcatagctactcaggaggctgaggcaggaggattgattgagaccagaagttcaaggctgtggtgagctatgatcacaccactgtactccagcgtgggtgacacagcaagaccttgtctcaaaaataaaaaaaaaagaggatgtacggtatacacacatacatgcatgcacacatacaccatcaagaaatgcagcatccataattgcagtgaagcatgctaaatattatttctctttcatagaaagagtttcattcaggaggagctgaaatttcagaaacaacatatgcacaattagcacacatggcagtgtcttcttaaaattcggggtctttgaacacattttatgtataataagaaccagtggtatggagaggaggcaggctggggggattgaaattggattgaatgcaaagagaagtgcaaatcaatcacagagcaaggacaacagccaagagccattccactagcatctcactcctggaagtgtggtccacaggccacacccaggacctgggctaaggcaaggtaagtggggcactcttccagaacaacctcagcacctataataaataatattttatgcaatattttaaaaattcaaactgcaaactgtaactgtggtctggtggcctgtttttgtaaacagagttctattggagcagtatgagcatcccatgggtgtttgttagaaatgcagaatcttgggccctataccagcccttcagactcaaaatttgcattttaataacattcgcaactggtgtgtgtgcacattaaagtctgggaaacactgctccagcagactttaaggcaggctagactgacgtatggttgctctaggcaggacagtaatttgttgcccttcaaggtggatactctttaaacattgattacttagcatttatttaataaggacaggaataaattaaaatagatttctttcttcacatttaacacagagaatttattgcatgcattggaagaaacgtaatatttaaacttacttggaatgactttttaatttcacatctttctactgtgtataattgcacagcgttagtccctcacacatgaagtacacaaaaatataattgaactttcttattcaaaatatattttaaagttcctttttctgactctcatattggcaacaacatcctacttttctgtagctgatttgtcttcaatttttcttttgtggttttctgaatcagaaaacttctagggaggcatatgaaaggtttaaatttgaggtaacagaatgcatcgcccctgccatgctttaactttagcatttcaagatcagttcacttgagcctggaggttggtgagcatgctggttggcagctcagcctgtatcccatcactgcacacttttagcagaaactgatagcttcttgaaaagaaaaagcttctattttcactccagaggactatttttttcaaaagaattaatttctattttccagttttgtaaaaagtgatatgagacagcttcagttaactgggccctgtttctgatttgtatattttagggagtttttcagtattttgctgtggacagatttcacattggacacgctgactccctgggaactacccagtgtggaggcaagaattataatcttgccccaaggctagcgtgagaggagtcaggtagctggttaatgcaggaaaccacctggcagcatccacgcctcactgctgcttaattcttgtctactgatgacatgccgcaaaactccagtaaaaacacagctcacagagtcaggaaatggcatggttaatattgttaggtgataacacaatgtcctgcagactgcggtaacaatagtggaagggcacataccagaattaaatggtggatttccccaagaaaacaccctcatctgtgttatctaaagatttagaaaagtgtttcttaaccatggctgcaaattgcagtcaactggagagcttttaaaactgataatggctgaacctcaaatccagattctgaattaattggtctggggtgcagtcaggacactgggattctttttaaaagcatcctaagcagttctaacatgcaaccaagtttgagaaccgttgctgtggattccttatagtgaaaaagtggagaatatttatttatttattatttatttgtatgagggtaattaatatagctggtacaacaaggagtccccagatatcaatggtttactacgagaaagtttatttcttgtgagtgtggatgattgcataagtgttttctcagctagacctgaaaatggtatacatcacacctcctgacatcccgctggttagaatcacatcacccagctccaacctaactgcagaagaagttaggatatgccatctttctgcggcccaggagaaaaaatacagggttggtgagcttgtagtccattcctgccacatataaatatcataaaaatgcttataacttcctaatttaagaaccaaaggcttagagtttaagtaccaatatttaaaaataactttatatggcctggcacagtggctcaagcctgtaatcacagcactatgggaggccaagatgggtggatcacctgaggtcgggagttcgagaccagcctgaccaacatgaaaaaaccccgtctctactaaaagtacaaaattagctgggcgtggtggcgggcacctgtaatcccagctacttgggaggctgaggcaggagaatcgcttgaaacccagaggcagaggtggcagtgagctgagattgtgccatttcaatccagcctgggcaacaagagtgaaattccatctcaaaaaatgaaaaaagttaactttatatattatttttctcttctattcgtagaatcaatcatacatatacattttatatgtatattgtttttacatatatatgtatatatatacatacacacacacttatattcgaaataaaagggtcctttatggccgggcacggtggctcacacctgtaatcccagcactttgggaagccaagtctggcggatcacgaggtcaggagatcaagactatcctggctaacacggtgaaaccccgtctctaccaaaaatacaaaaaattagccgggcgcagtggtgggcacctgtagtcccagctactcgggaggctgaggcaagagaatggcgtgaacccgggaggcggagcttgcagtgagccgagatggtgccactgcactccggcctgggcgaaagagcgagactccatctcaaaaaaaaaaaaaaaaaaaaaaaaaagggtcctttacagtatgaaatatgtctgcccaggccggagtgcagtggtgtgatcatgactcactgcagccttggccttccaggctcaagtaatcctcctgccttggcctccccaacagctgggactacaggcatgtgccaccatacctggctaatttgggtattttttgtagagacagggtctccctatgttgcccagactgggctcaagcaatctacctgcctcagcctcccaaagtgctgaaatcacaggcatgagcccacacactctgttataatttttaataagaattgtcttggaggcagtgagtgtctccaggttgcctagcttggctttaacccacgaagccctgcttatattttatgtattggatttcagagtaagtttcatttaaatatagaaatttaactttaaaaatgaactcaccactgaaaatcaccattttatgtgaaaactaccacagcattacatgggggagataggttagaagggtgttttaatttcagtgattcataaggatctagacacggggctttacagatgtcagaaggaacatagtacagaagcatagcttgcctcctggcttctaggaccaaggcactgaagatcatacaccctgctacttccttcaagagcctcaaaggctcacatcccctctgactatagctgggagagaactgctctgctaccccttatttgaaagtacctctgcgttaggaacttggcttcattcatctttgtctctactgcttcatgcagatggctcaaggcaagtgctcagaaaatatttttttcagaaaaacgaagggagggagatgaagaggaagagatagaagaaataggttgctcttctgcagagatttttcctattttccttctcctaatctcagtcattgatcctttcaacacatattaagtgcctgctatgtgccaggcactgagctgggtgataaagctacgaggacaaagcaggcctagtccttgtcatcagaggcctcgtatggcagcagcgggttacaggggccatgaagagatttactgaggggcgagggaggggagcaagcagagaagcaagaggactgacaacggtatggcccactctctccttggccttctcttggtttctagaagagcagagagaagcctagatcttgaatcacaatataatttgtagcttacagattcctattttactttcttgtgttacattttattcattcttctggcaagcacagtgaactgggtatgcactgtgttgtcagaagatctggagtttttattctcagttccaactctttagggtgagagacctttggcaagagaccccaacttgtgcatgattaggatgataaaaatctaggattgaggtgaggattgaggatcagaggtcacagttcacaagtgcttgttaaaactgtgaagttctacagaagtattagacttttatatatagtgggtaataatggtccagcaaggacatagggaaggtgttactattatccacaataataaggctcagagacatcaaggagttgccctgggtggaataactagaaagggatggaactaagatttgagcacagctttctgaccccagatgtcctgcagtatcaggactctcaggcaggcactcctcaggagcaaaatgagctctcagtgaactttctttgcagctcacggaaaggtcaaagctctgtaaatgaagaatcactgacgctaggaaaaaaaaaaatcaaggctgaaagcatcagcctttaaggatggtgcacctggcttccgtgtcctctcctggtaggggtgaggcctgtgggggtgaacatgtgggcatgagatcgggagccattttctcctggggagctggttaaacagcacactgactccccagctggaggcaccacacctcctgtgaatgacccaccagagagcccacggaagccaagccacaaaggcgcaggaagcagcaggcctcagggaggagcttgccaccccgcctgatcatgggactgcccaaagagggataatctccatacagctgaagacagaaaggctaaacagcacatcgtgctgatttcatgtagttacaaaaatacacagacacaaacccaatctagtctgttgagccttggaaattctgatatattcaggtctcattaatcttttctgacaggtctggcctccatagcagagctggtggggccacgcagagcagagttcaccacgtagacacaactacaaaggcctgtgacctctgtcactgtctagtaggactgatgggatgtgtgattatcatcaggatgttttcaaatgtctccatttccaggagaagaaaaaggttgatcatgtaggtttgatttaattctccccaagagagtatttcagggtaaaaaggaaacagatctcttcttatttctgcaactcccagcacagctgcaaagaatacatcaggtgggatatgaaagttaggaaatgctcaatggagcagctgctttttgcttaaaatctccacctctgtgttgcttagatttgaacccaagctatggattccagaagtacttggaaggcttgatgccttctagctgacaccataaccaacccacagggggcacaggggagcacagagaggataattttgccttcatttatgaaatggggatggtcacaaagatcaaaaatcacaatgaagagatagcagagggtggagctagccagaaatcgcatccacttacctgctataacttggttcagtccttctaccatccaacagtaaaaaatgaaactgacatccatttgtagaagttataattcagattttttttttctttttcttttgagatggagtcttactcttccatgcaggctggagtgcagtggtgtaatctcagctcactgcaatctccgcctcctgggttcaagtaattctcctgcctcagcccctcgagtagctgggactacaggtgcgcaccatcatgcctgattacgttttgtgttttcagtagagatggggtttcaccatgttggctaggctggtctcaaactcctgacatcaagtgatctgcccaccttggcctcccaaagtgctgggattacaggcatcagccacagtgcccagccataattcaggtttgaatcaaggattcaaagcaacctatgtcctaaaacaaggtttatgactttgtttgaaaaaaagaaaccattttagatttattagcagttagttgaaacaacagattttgtgatttttgtcaggtcttgccaaatgcatgtcaaatgtacaagaccctcatgtttatgcagatatttgtgagaatgtctttaactgagatccaatcctgtgaataaaaccagtcatgaatatacatggaaatttgcaaagtcaagtgtacagcccttttctatctctccaaccctaacactcagaataatatagatcatcctttcctaactcatacgtaatgtcaggctcatactgggtttcaaaaaaagcataatgaagtaaattgttttttttttcttctctcttttttacaaagtgttattttaaattggcaaggggtaaatatctgtcttcagctataaatgtgaaactaatatttctgccagtaatgatcttctaactttaaaaacaatgtccttaaatcatttaataattacattcctaataattacatttctaatacagttctctaagaactacagttaaaaccagaataaaatatattctgtggaccaagttgatggtaattttaaaatccctaacatttatgggtatataacttttaaggatactaatgcagcatcaacccaattgtcctttattttggctcatctaatttacagacatgatttctgaagtttaacagtatttgtaatggcaatatccaaagtgattttggctgagtaaactgctatttgttgaacaaaaatgtagttgtttgtgcaagtttaaacatttcacaaggccagctgagttcatttcaaccctacttacaaaataattattggcaaatgaaatgggctgagggggtagagacaagatattttcaagcttctgagagatttacaaagccaagttcttcaactattgaaagtgaaattgaaaggtcacagacaattgaaaggtacaggtttaaatctcaggattaaaaagagttccaacaagaggaatatttacaatggaacaatgaggaaaatgttttgttacagtcagaaacatggaaaatatgctgttcaaaattgttggctcaggaataaataaaatccagacttggactattaaaaatatcaaagtgatccactgtgtgccaactccattttcccctgttgtttgttataaagaaaatccgttattgaatataatgcagttctggttaaattatcaaagacattttccatatgcaaactgttgtttaccatatgctatatattcttcgataacaattttaatacacctctatcacatggttccataggtgcagcgttagaaggaaattttgagttatattttaatctcttacccaaggtacaaaccccctttgtaacagccattcagctcattctgttgagcacctattataaacaaaattagagatacaaaaatacctttaagatgttaatggcctgttaggtggaagaaagcatctttgtccaatggttgccattaagcctagactgaaactcttctatcttgtgacagggagctcaccacaatgcaaggaaacccattctttcagtgagtagctctataattgggaccgtgtgtattaaactggggctgacatcagctgaccctggttttgccttccggaatagtatgagccaaatctactccatttttttcagctgagctcttcaaagatttttgagagcactttcctgtgtcctacctagtttctccgcccaccaccttcatgccatcttatttcctcttattttcactaccacgaaatgctttcctgcccttagggatttaaaaaattatttcatatcgacggattgagcctaacagctaaatactcaatattgcacttaaaataaaacagactttaaaaattatgacattaagaaaccaaaagttacagcaattggatacagtctgggattatccctttgtaattagatgagcattgactaacgaaagatgtttaggggaaaaaaaaatggaacagaacacctaaggcttgccaaaactgtgtatatttgagaggggggcatgataaatctattataatgaaattcatgtgctctaagacaatgactgaacttggtatttaagactatttaaaagtcacaagatgaattaggtcatgtttcagaaatgactctacaatctaaatttctcacaagcaagtcaggttaatgacaccagactctgctactttcaatggataaaacaagggatcgactcatatgttaaattttcttctagtggttatacatttggtactttcataagccataagtaagagacccaggataatttaaatccaggagactttatttagcctccggaatggcccctccaaccccaaatccatgcaagaacacaaagccaaggggtaaactaaaaaaaagaagagattgttttattgtgacatttatgacattgaccccttgttgacaggaatgaccgagggtaatcttggcatattgcacatgctgtgatgaaggatgcactggtgatcctctggccactgaggctgtttcctggtcctcccagacctctatgcacgtgtgggccagtcaccgaaatttcattaccacttggtgtatacatttaacaagtctttggtcttaataagcaccattacaaaccctcacattaagggcattattattctagtttataaatgtttcaatgataaaaaatagcacgattacagtatacacacacttaatttacatgtaatgtattatactcataactgagataagctactgaactaactttggttgattgaaattaatgaagtattggaactgaatacttgtaatttggtttctaagttgtgtacatattacagtgcatttataaatctagtttgaaaatttactagcaccaaataggtaccataaatggacaacctagtacttgtatttggagaagcaaagtttacaaatttgcaaaaaatagagtagtccatcaattgaaagcacattcccgtacgtttgctggaaggatggcatgtcagcataaatggccaacccccaatggaaatacacgtcccagttttcaagaatcaacacatatgacaaggtagcttagctacacacatgagaagcctgagaaagtggttgttttgaactagggtagtcacctgtaccttgctttggtaatacaaagaatagtgcttatttatacaaatttacttggtgaaagattgtacctatgatatgatgattctgattgggggaaaatatagttctacctatctatatttgtttttcttttaattatttggtctctggatggtgaattaatgaagcaaaacctggattttcatcttcagattatcacccagttcaccactgaggtagtctttgtcatatttgtcttctagttggttaagttctttctttttataaagtggagtactactgatttgtaatgaataggttccagccactggcttcttctttgtgaagtggaggtagctgatcccttccttttggttgattttaaagaagccatcttcatttccagattcgatcaagtatctgttgtgattcgtcagagttgtaagagctggaaggagttctaggattcgaaccttgttactgacgtgggaaatattgaaagcaaagatggctgtcttctcaacatcccaacttgcaagactcacattggcttctgtctcagactgatcctggaaagacacatggcaatatgttaaatacaatgtacatatgccacttagctctcatattaaagaaaaaatgactcaaatttcacactaatacaattttctgccttatgctgcatacacaatattgaaagcattttgtttagaccacaagtgtattaaattggcacatatttgtaatatttgaaaatattaactgatgtcaggaagaaaggcaggttgaaatcatttgtatctggaggtctcaaaatgtagtccctgaacaagctgcatcagcatcacctgggaatctgttagaaatgcaaattctcggcatcaccccagaactactgaatcagaaaccctgggatgtctcccaacaatcaattttaacaagacctagtaggtgattcagatgcatgctaaagtttgagaaccactgttttaatagattatgttctttccaaagacttatctcatttcttaaatgacagcagatgggttgcagcaccaatacgaagaaccagactatttcaatttgattcattgacgtaaaaccatcttctcctaaggacacacctatgagcctacttcctgactgtgatgatctgctaatattcaatgcttttcacctggcttcttacttgcctctctgggaccacatgtgctggattctatgggcccagagccagaggtctgggtgaatatctgtgcacttctgagttgactgaaaggctgcagcagccgtaggcaaaggaaaccaggctgcttcagctccacgttatttttgtctacaatccaagttccctcacactccacatggctcttttcagtagaggagcctctagctttcagaacttggcattcctatgtagggagcactatgtcacttcgctattctgcccacttgctgtcctggatctcagaccttatcctttcagcagactttgggtgggtatttgacttttttttggcgagacagaggaaatgagcaagtatgtgaaaaccttcaaatggccactcccgaaaagcagcaagaaactccagaaagccccacagcctcttgtaaaatacagcctagagctcagggaatgtctggagtttctccctggggagctttttcacactttggagcatccttggaggaaaccacaggaatctggaagggctttccaccacaggagacatcaggagaaactaacttctgacccacctcgatattggaggcatcagtttcgtttgtgcttctccgtttcctgccccgtttggggtagccattgatcttacactcgtaacaagcctctggggagagtgaattgtcatccatttcaccactgacaggtggctctgggtttcctcggcccatgcccattccagaaacacagtgcctgcagcagaaggggagcatagatgtttttcattagaatgggaagacaaggtaggtggtacaagagttctggtgaagcctgttccttgcagttgtgagatacagcccttgcttgtccactggaggatcagctagttctgagaactacattgaggtcctctgtttggcctctaattcccagttccctgaatgtattgatttccttctactgcctatcaagaccctgtcttggatatttatttatctcttcattcccaaacctaacatggaaagcattttgcagtacttatactggggaggagacacagagtggaaacaagagaatagtagatgagggaggccatgtaacttgggaggctaaataaaaatggcttctttttatgaaacaggctccatgggagtgagcaaggtgtgagacatcactgttgagtttcttgcattctcccacttccatcattacttttcctcactcaagctttggagcaattgctcctattccttgacgtttcacttttgcttatgctactgaggataagaagaaagctccggttgataatgaaggttaatttaataataaactatgaagatatgccgtatataaaatgcatgtatcagagtttgcccaactgtgggaaactgtttcaagtcattcaaaaccactagggccactggctccgactcatgtgaagatggataaacaaacccatgcccaagagagaactcgttcagctgtttttctttgcctttcagttatcaaagccaagttacggagggaggctcgaatgtttcacaagtaccttgttttgttattctgcttactatttcagaggccacttggaatgtgtatttatcaagctcctctttccaaatgtgttgaaacatttgaatggtccttaaaagaatctttatttgggggcagagtccattctagtgattcggagaggccaaaactgttttaaatgggtagatttctaacaatgggtcataatatagaccaaaaattatttatctgtttttctgtaatagctgatctgctctttagaactaattttcctatatacccttaggattcaaaatatgttgccaatgaacagaatatctgttgtatttcaaagcagtttataggttcctactgtttcccccaatcttgccagagtccaatacatttcctttcctctttatcttgcaacatgaaatatgtagaaacaatacaatggatgaagtgataaatgctcatcctgtgggtgtgtgcgcatgcgtatacattcacacaatgattaaattattaggaggtaaactgcaaatttgcaggctttggttcctttctcagaactcctttccagtattttcatatcccgggagcaccacttataagaagtgtgactacaaaatcccactggccaaaagccagtttagagtgtcacaatttttgctgggaagaaatggttctggcattaaactataaagaatgagtctactgagagccagacacaaacatctgggaatttgtgtctgattgctggcattctgtgtgcttcccacgaaacattcttctacctacccagatccaaaatgaatcacttgatgtttgtatgtcaagaaatcaaagactgctacattaataatttggtataagtgtggatgtgtgtgggggtgtgtgtgtacacgcatgtggaggagtacataatgtatatatatatttaatgtctatgtgttcctaattaaaaagttaaaatgtgcacttcctctcaggatagctaaaactaggtggacacccgagtccagattaattcagcaggaaaaaagatccaaactttgaaaacttaacactaaacttttaaatcactgggtaaaataaaaataggccttcccggccgggtacagtggctctcgcctgtaatctcagcactttgggaggtcaagacgggcagatcacgaggtccggagatcgagaccatcctggctaacacggtgaaaccccgtttctattaaaaatacaaaaaattagccgggcgtggtggcgggcacctgtagtcccagctactccagaggctgaggcaggagaatcgcgtgaacccgggaggcagagcttgcagtgagctgagattgcaccactgcactccagcctgggcgacagagcaagactccgtctaaaaaaaaaaaaaaaaggccttccctgccccaactctcacacagacacacctataatttggtgaagtgttttttttgtttttctttttttaaccaggaaaatacagtaagtgtttcaatgcacctttggtaaaatttaatgtaaattcaagtctgaaatgtaaaatataatttaaaaccctaaataattttcaacccaaagggatgtctttgacttattctaacaggagctagatacaaaggcattttaagtccagatagaatcctccctgccccaggagaagagtggatcagtcgtgtgcagggtgagcccagttctgtcatgggttggcagagaggtgtatttacagagagatgaatcacttcccaacaagatgtgaagatcaagagaataagatagagaagtcatatagcgagatatttacaatgtagtttcattactttgtttgacgtttccagaaatccagatgcttccttccaaataaaataacctaaaacttttgccaagctaactggaattaattttaggattacaaaaagcatggttctcctctgctaggacaggtaattttgagttcagtatacttaattatattacgaatgaaagaatctccaaccatgaccaggaagagcactgcttacccttggcctatgcggaagtaaccaggtggacagccacacaggtaaccgccctcggtattggaacagccatagctgcagggggcctgcgcagagccacattcattgatgtcttggcatcctccactgaactgttcatactggaagccggcgggacacatgcacttgtagctccccagggtgttgtgacaggaggctcctccgcagatgtgagcgctgaggcattcgttttcatctgcaggcaaaataagaagcggcatgtgtggcagcagccagagatttctattgaggacattggatctggccacttgctgccggccagctggccctcagctaggctctcaggaaggtaagacaggcagaggtggctgggtggggagagcaacagcagagaaagatgcgggcatggatgtggcttcttgctatgttgtgagtaaacatggaagatgaaacatggaagatgaagtcaaatgcaccaggcagagggcattagaggatggcattctgaggaccagcagactccagttctcatcagaagtcaacactggtatcttctgctccatgtaaacatccggtcatgaaccaacatggggctggtccgtagctaagatttagggttcaaggggggaggaaaggaatcttgcagttctctgcgtacttgcttcacaagtgcccagcgaggagacaaatctctcaaaagcagagaccaaccattttcccgcaggctgctttccctgtcagcctatttcaggatatgctgatctggcaaaggctgatatcctgccccaagtgtctgccccacgtgtctgccccacttggacttccttttcaaaattctgcaaaagcccccaggtacctgttctgggagatgaataatgccttctggtatgtctgctcccatcaccgaatcggccccctccttattcaaaccagcctcctgcccagagtgtctgagccctgtctaaaactaagtgtggctggaagagatttggtgcagacttcacaagcagtaattggggaaaacccacaagtgagacagaagctgcagggctggctacccacagggacctgccaagtctgatgctaagaagcaggaaaaagaaatcttactttaaaaaaatcagctagaagggggaaaaccatgagtttctcattatttctgatttataatttttggaagtctctaatatatttttgtagatctgcctttgcagggcaggttggaaagttgctggtaagacatttcttaactgccatagtccattttcaggcatacgttcatttgaatgtagatagattggccttctcttcacttagcgaataaccacttcctatggaagagaggaaggggaagggaatgaatgtttattagatacctattttatgatagataggatacaggtattgaccatttccttagctttcctaacaatcctgagaaagaggtattatattctctgttttacagctgaagaaagtgaggctcagaaagctcttccaagatctcacagccagcagcagcagggcagaaattcacagccaggtctgttggactgcaaaggccatccatgcgctttcctttataccacagtgcctctcaagagacgctccacatttaagctggtgcttcctttctcctgtaattagtttaccttctttgctaaggcacattcatttataaagaaaaataatgtttctcaacaaatctattttttctttttttttaaattagaaaacaggtggataaaagtggtggggaaggatgctcacttgtatatacttagtatatattcacatttcctacctgcctgcctgcctgccttccctccttccatgtctccttccctcctaccttctttccttctctccttccctttcttccttccttccttcccccctcccctcccctccctcctttccttccttccttccttcctttccttccttccttccttctctcctcccctccttccttctctctttccctccttcccttcagctacaggtctttgatcttaactgcctgtctgaaaatcttttgtatccaaagaccttcaagtcttcacccaaggtcacttaggctccagggctcttaaaatataaataataattttatctttctcattcttccctttctctttctgtgctcaacacgttatctgtgttctttctccttattttaaattgaggacgaagtgtgcaatagagagcaacagaaaccactggcaccaagctccatgtcaaacaaagaatgaagaacgaagcatatttacttcattggagagaacacccctgggctgatgtcttcttgctcctccacgtccatcctccatcctctccacttgctcttggccccaggtggctgatctatggagcatgagcaagctctgctcccctgtccctcacttttggttggcctcagccatctgcttcttgctgggaccctgactaataaaacctgcaaggcgtgggtatatgagggggaagacttgtcattctatagcttagatttattctgtgttttttcctccaaagagcagaagtaggaccaatggtgagaaattagagggaggagaaatgattttttttatagcaaaaaaagacatttctaagtattaaaagctgtctatacatagattgggctatcttgggagaaagtgggcacccttcaaggtggtatttaagccaaactgggataagcaaggaagttagagaaggatttatatattaggaaagagagaaggctagatctctaaggttctttttaactttgagcatctatctgtgttactacaactatcaagagttctccccctctcctttcacattcttttaaattttattttacattttctcccttccctgagaatttaataaagtttaaattaaacttgcttatctaggttggagaggtaggatggagtagagcacagattaaaataagaaattggcaaatattcagtgtttacagtttgaaaacagcatgtttgtgcactcgccctttttatcaatatacaaacaccacgatttggttaacatgttttgcacttttcctgacctttttcatcctctgcactctggagcaaatgactccacaaggaatttttttacactccaaaatatttgttttattcttccagttggtacttagattggtgagggttttgtttgttttataaaaagagacaattcgaattttaccaaaatagcattaaagtctgaaaactactccttaaaagtggattgaaacccaccactctgtcctctaaaatcaaaggtttcagcatccagcttgcactgttcatgttagctgtggccttaagggagtaccgataggaaacttcacaaatgcaggatgggctttcttttactcattttctctaggggaaaatgggtcaactctatctatctgcaagctgaattttttgaaatttacttctagaaagcaatgaaattagtggccctcttaccccaaagagtgaacttccagccacctgggagtgaggatccagggagggctggtctaagagatctgctctgtttcttgtggttctggggaagctattttagcccacggcaatgctcattctagataactctaattctcaagattgatgagagcaatttggcatttggagacattaagaaccccaaacttcttctgacttctaaatcaacttgtttttttagagtgtccagccaggagatgatcttcacgagaccagagcagaatctccaggacactagtgcatggcctggtcgcctctaccatcctcagactgatggtaggaggaggaggataaggtacaggagcgacatacctttcctctcttatgtttttttcacttagctccagtgttattaaaatgacctaaataatgagaacagacaggctcataaactgggtgttgaatcaacaaagttcactctggaagttctgtgaacaatgtcagaaactggtgattaaaatcaaagacctccctgagctgctaatgaacaaagacatttttattaaaaccagatagctagccagagactcacgcagtcgaaactcctatagcacaggggtcacttcagtcaaccctacatgccactgcaaaactgtcttgtgtagaatcaaactagatgacagagatgattttgataaatgaaaacacaccaaatatgtcttcatctgcatgaaagtgaacccctgcaatgcagagcctgcacccgggaagcagtaattctttgagtttttgctaaggagggctctgtacagaataatgtggcaactagaacaggttaccaaagcaccaagcttgcagtggcacttcacagacgcttgctgaatgaacataaacaagtgaatgtgacacttgaaaggcagctctacatcagaaagttaagagttgtgggttctagttccaagcatgtcacaaaagaactgggcaaggaaatattaccgtccctttctggacttctaggtccttatctgtaaaacaaagtgcctgagctaagtggcttctggtatccctccaaactcacaatgttttgattctctgatgtgcattaagagttattttcccatgacattgtagaatcaaagatgacatcatttcaatttaatgagagagtcagtagatctcccttaattatcaaaagaatttagcaatcttgaaaaacaaaacaaaacaaaacaaaacacacaaaaaaacacaaccttgctgtgtttcctgcttgcgctctgtctcaaaatgtgtagagctgaacagaactactttggcatcttcaggccaaaagccactcaaaatagcctttggctggctgatatttttcagtcataagtaagattttttgacccctgatatgaacataactcaagtgtgggctgatgactagcagtgcagcgggagggtggaggatattgcgcttcaagaaattctgggggcatttcatttcagatgctctcaaagcaccctcaattataattttttttcttagtttgctgttttgcaaagactgttacttacctcgggtttcaaccaggttagggcaattttaaatgagtatttgttgcttcaataacacatttacagcttcagaaagcaagcagtgttttgcttcataggacctgatagccatgcatcttgagagtgaggaaaagttacttgccaacacactggttccactggtagtgctggaggtagccctgggggcagctgcacctgtagcccccaatgatgttctggcagccatgctggcagcggtggttaccctcacactcgtccacgtctgaaaaagaagcagagccaccatgatgccaactcaacatctctctctgaagccagatggattctaataagaaatctggcccctacacatcctacacattattctaccaccaaaaacttcaagaatctctcttctggaactgctgctaagtccaaggagaaaatcattcagagagccctggcaaagtctacaaataaaaattgtcaggaaattagtgcaaagcccaaagcactctctgggacagctctgtaagttataagttatttgtgtttgctcttttttttttttatttttggtgccacaattagaaaccaaaacgtgtcaaagccacagtcaacttctaaaaatatcatttaaacttctaattaaatgtcatcagaagagctattcctcatatgtttagtccacatgggggaaatccctttatggctctggacccagtgaccagaaaattaatgaatcaaaatcaagtatatttttcttgactgagttattccctattaggttaaattaaaaacttagcagaaaaagtcttgatatacttaggaaaggcatgtgtgttagacacaatcaagcatgaaacaaaacacgactctctaagatacaggacctgtgcacactattttagctgagtgcccccctgggctcagatctgctatctcatagaggctgatgatgaaggtgccaatagccacacaggccacctccacaaggattcaccagctggatcgcagctgaagtctccacccaccttcacagctggagccggtctgatcaagtgagaatccccgctggcattcacaggtgaagcttccaggagtgttctggcaaatgcccttagacccgcacagattgatgtcagaggtgcattcattgttatctatgagaagcagtgggggcaaagaggggttaaaattccccaaagctctctttgtatcatttaaaagaaaattagaaggataactcggaaaaggccaaataaggccaacaacgcttcacatacatgtacaggtgtgctcacacatacatgcactcatatatttctttgagcttttattttcttatcccaacagcagaggaaatagaaaataatcccttaaaagaatcgctacaatccatgtaggattttttcctctcctactcaccaatgcaggacgtatggtgttgggtaaatccgggaggacatttgcatgtgaagccgccaatggtgttaacacataggaactggcagttgtgttgcttggttgcacactcatcaagatctacaagaaaatgcaagagaggcatttgagtcaagccaacaaaacaggatcagggaagctgaccctatgaagcagctccacgtttgatttggaggtctcaaatgaccctgactagaaagaagccacagcaaaaggcaaggagagacacagggggtaaagatctgaaagataaaacaaggtgtcaatttagaccctcctcccctcaaaaaaatataaagagatctttaggggatccaagaaaacacaattctaattggagaaatgcaggaattcctcaacaaaggaatttcaaataaatcatgacattttaaacaaatttttaaatgaagcgaaagatgaatgattctgcaaattttccagagctttgaaaagatctatttaagttaaaacataaagagaaatgttgaagctggaaatgaatttgctggcttagttctcttctgtttgctgtttttaatctactcaaatgaagtcatcaaaaacaaaatctgatttctttagtcgtgattcttcttaggataaaccaaaattgagcaatcaggaaggaaacaaagcaaaggaaaaattcattttaatagctaaaggcacttttaataaaactgcctccaggccaagcgtggtggctcatgcctgtattcccagcactttgggaggccaaggcaggctgatcactttgagctcacgagtttgagaccagcctgggcaacatggcaaaacctgtctctagtgaatatacaaaaattagctgggtgtggtggtgtgtgcatgtaatcccagctacctgggaggcagaggttgcagtgagctgagatcgcaccactgcactccagcctgggcaacagagtgaaacttcgtctcaaaacaaaaacaaaaacaaaaacaaaaaacaaaaaacaaaaaaaacaaaaatccaaaactgacaactgcctgcagtgtttatccaacattgtttcccacatctcaataaaaccctctgctttgaccaggcctcttttctcaacgcctcaacttctaagttgcattctcaactccaatgttatttcaaaataccaagagatgaaatgttgtgttctagcttctagctaaactttaatgataattttaaaattgtcgcatattcaggaaaaaacattagtgactttattttatcacaaattcaaccactatgccctcaccatctgcacaactgctttggagctgcagatcagtgccagctttgccagtgactgcttccactccacagggccagttcctggctagagtaacatctggagtggacctacactgagagaccctcccgagacctgtcctagttccggcttctcttataatgctgcctgtcctgtgctctttccactgctgagatcttgactgatatgcactctctgttcagctttctcagagtctgtggactggtttcccctgtctatggcccaaggagcttggctggagcatcatgacacatttgctgaagctcacctgcaacaggtgaggaagatgactcagtgatttctcctaacaccatttcatgagtacaacacatgaagaacagcagcacttgctgctcttgcctccaagatgcccttcctcctcttctcccctctaatctgcattctacccatctctcactggggatgtgctgctcccacggccacccttctggcttcctccttctcagtgactgtggtgcaactatctgcactattcatttgatatttagttatatataccaagtaagtggaagaatttgaaccttatgggaaaaaacaggaaaagggacaagttgtgagtggacatgtaaaaattacagttgctctttgcactcctaaagccataaagagaactttattgatgcattttcatttttcatcttttaattgctggaaacttttgagaattttctgcccccagaggttagaaaaaatgctataaatttgttttgcttgttacagataatatatacaatgagagatattttccccttgaatttggttcttcatttatatgaataaatttatggctctgagttatagcttcacattgcctagaactcacagtgaccccagatgtaaaataagttccacatttgagaagaacaaagctatgagcgacttcatttaagatgtttagaatgtgtaagtaggtctctcaacttcctctccccaaactacaggattatacaggctttgtgctgcacaggaaggcctcaggcacttgcccatgatgtcatccactattacatgtctcttaactctccctttcagcagacacaggaaagaggtcaagagcccaacttctctctgctctccacttctctcctctcctctcctccaatctggatcctccgtggggatgtgctggtcccaccctccacccttctagcctcttctcagttcagtggtacacacagctgcatcattcatttgatatttagttatatataccaagtaagtggaagaacttaagctttatgagaaaaaataggaaaaagactccactctatcctttaccttccttacttctgtatgtttctataaatttccttcaaagtttcatggcatgacatgatatctcttgctctaccacttggtctatcttttcttctccaaatctctgatttcccaaattattgttaagtatgactcactagtgctattcactaaatataatgttcttattgtggaggaagatgtttacaggagtaaaattaaaccaaaaaaattttgcaaaggataacttctggttgagaagggatttctgcccagagcttttctggttcttaattctgtgtgatatttatgtctcagggaagctcctacagggcagaaatagactttttctgcagaacaaaaatctggacacagcatctaattcattaggcacaatgtcctctacgatcatggcactgattattccgaggcaggaccttcctggaaacctgaactatatagctataaagaataaatacaaaaaacagaaagcagagaggaggtcaccaattaagaatctgccccaccagagccattgaagctggccctgctatctctgagacagtcatggatggccaccatggatgcccagggggcatgcagcaaggacagctgcttcctccacaatctccctggctttagcctccttccctccagcacaggaggtaggtcccatggaggcattaaccccagggaagcacctcctgcctgtagagcaggtctttcggcttgcctgtggagttcttacaggcaaaggaatgcagccatgtgtcaggagctaggtgaggggcaatggtcaattctactttacctttgcagctccttccatcctcttgcagaatgtagcctttcgggcatgaacactggtaactcccttctgtgtttttgcagataaaattgcagggtttgggagcctggttgcactcgttcagatctatgatcaaagaaatacagcgtgactgtgcatctaaaaatgatgtgtacacgctcaatttccacagggtctaacgaagaattttagtttcggggaaagaaaaaggaaactctgtgtagactttgatgattgtcctgtgctttcctatgaaactgcacagactttttagatttttagctttgggtttttttttttccataatctaaaatttccacttgaggataagccatcagaaatagacacttacctacacaggaagtcccagttatatctggagtgtacccagttttacaaatgcaatgatatgatcctctgtcattgacacattccccatttcggcaaacatcgtgaataaccttgcattcatcgatatctgtaatttaacaaatataaattaagaaatatatcataaaattgacaacattaatatgtagggggtcacttcagtgtaaatactaataaattgtgttactatattttgggcctaagaaattaaaccagtaagatgacagcataaatttaatatgtaacagtagctatatcaaaaggtaaacaaataacttcattagactacaattgataaaataattcagccacagaaaaactttaaaaacaactggtcttctaaatgtatatttttctcttctggatccatagaacagccaccccatctagacatatttggctttttgtgtcatctcatgccattaagcttgcctcctgctgacatctaataaatgaatcacagaagcagatccttttgatgaggaaaccccatttccaccccctagtattgcatgctcaaaataagtaaggttttttgttttttgtttttacattatttttgttgtctttgtggttaatcctgaaaaagttcaaattacataatattggggaaatgagatgaacttctgtcctctggtgaggggggaaactaaccagggctctgaggtggatgacagtgctgggtttttgcagcctgctaaggaagggagaccctcactcatggctgtaccacagagagaaagactgggtcaatatgcactgttgagcattaaaaccactgtcttccacatcttgacccattttacctccttactgcttggcgaagtgccgatacaagcactttctacatgggttctcagcccttgactgccaaataaccattttataccaacagctgggtgtatctgacctttacaagtctactctgaagtgcaatttagcacactcttattggtctccagaagtgagttttttcggctatcttattgctacatcctccaaagaatcataaattgcttttggtcactccatcttacctttctaggtctgttttttctttttttttaaatcacatccagttccattattctgccttcagccacatctttccaatacaaacacaaatccttcttaacctccttcttcccctttcacttctaattccctcccaagaagctcaaaaaagctctcaccttttctcagtccttttatgaactaaaaaccaattgtagttacagttgataaacacaggaatcatattggtgacaggcctagatatctctagagttgccttagacagtctgacacttcctcatcctgctctagttaaggagcttgtgcttttccagatgcaattgtgtctaattgccaggatatcagcatgatttatacttcttttatgcaatacagtttggccagttttaggagttccacatcttggtggactggtttgcacatttaataatcatttatttcaaagtttatctaaaaaatttaaaaattatattctgagtagccaattgacttatagtaaacggtttaaaaagttgaagactcgctggaatgcagagggagggtcctaagcacacacagcttaatcaagtggaccaaggccactttggcagcatgacctcaaatgtctaaaactccataatgaagaatttttgttggcctcagctgtgcaattcaacctaggcacatattgcaaactccatattttcatctgtgtttcacacaaaaaacaaataaatagattccctgcaagtatttttggactataaatgaagtacctgctccattggtcatgaatcctcggccatggggacagagtttcttgaaagccacagtcccctggaaagggcagatctcacagtggggaccccagcctctccctccgtcacagcagcattccgatttggtgacggggttcctgttgctggagccgatctgacacatgttttgtagcacctctgtgaagcagtacccttcccgattgtctggaagggacattatatggcaaaggggatgtcaggaaattttaagagcaaacaaaatattaaaaatttggtcagatataaaaaccaaaaaaggatgtaacactttaccctgggtgagaagaagcaagaggggaaagctggagacagcagtaaaagagaaaggatgacgtctgagggaaacaaataagacattcagtaagtaggcagaaagacattggcctagacaagcttataactctctctgctcccagaaatacaggggaatagccatgcttacagacagaggggcagagaaacatacggaagtggatcctgatcaccaagggcttcaaaggcagccaagaaattccaaacaagtgattcaggatccaattagcaaaggaagaatttagctgcagggtggtgctgagcccaatggacaatcacagtcattacggcatctccaaaatatgaacattttttatccttcctcagattttgacattttcttgtattttaaataagaagtctgggtttccagcatcccagtgtggaggctgaggttaggaaagtgcggtgccaactgtactcaccaaggcactcgtcctggttggggctggcggtaaacccatcattacactcacaggtgtagctcccacgggtgttgaggcagcgcccattctcacagatccctggcttcgtctgacattcattctcatctgtttgattttattgaaggaccaaaaacaagaagagtcatctgaccattttatagaggatggagctccttccttcgttccttccttcctccctccctccttccctccctttgttcctttctcctttccttcctcccttccctccctctcaccttccttccctctctcacatctttccttcttaacttagcttttgaatcactaatctgttcacatggctcaaaatttaaaaggtataaaagagacttcaattcattcttaactgtttggtttcattgaaagactgaaaacagaaagagccatctgaatcttttatagaagaatagattttcttctttcctatatagtttgtaaatagcttatctcttcacatggttcaaaattaaaaaggtacaaaaggagattcagcaaaagtacccccttcatttcctatttcccagacaccaaactcccctcctgaaaagcaaccaattctggggccgatttctaatgtatccttccagagctggattatgcatataaaagcaaatacatacataatatgtgtatgtgtgtgtgcacttcagatcttttaaaagcctaactgatagcattttatatacttaaacatagatggtagcattttatgcacacttacatttttcacttagtaaaatttaaatcttttcatattaggacataaaaaggactctcaaagtgttatttcaagtgaaggagggaaaaatgtgaatatcagcatatgaaagaaatattttaatacatgttagaataatatctgtaatggtcaatattgatctgggggagtttgtctagattaatcttcagattaacctagattatatctccaatataggttgcatttattgtaatatttcaacaatattattaagaaatcataaactacaactcagtttcccaggtttaaaaaaacattaaaatatctacagattcttagaattatctgatgattatttagaaagatcaaaaataatttgctgaggtgcttcccttcctttgagaatagttcagggtccctcagatggagctctcactaggaaagagagaaagttggaaggtgaatccagaacagtgttaaaacaggttcaaaaccccaatgcaatgccccagccacccccagaacaattcaatcagaatatctgaggttggacttgagctccccaaatgattccaaagtgcagcagaggttgagaattactgatccaggaggatccagtgtgtgacaattaatctacatattttctgattctgtgcttttagaatctgttctttaattcctgcttcaatctgtattgtacagagtaaaagggcaatgggattcttaatcttcttgaatgacaacataaaatatatctttataataccatttattattaaaaagaaagagaatgcgtgtgagaaggttttaataattttctcctgtaattattatctaagcagaggtcaggaaactttttgttagggtcaaataggaaatattttaggctttgtgggtcatatggtctcagttgcaaccacttagctctgccattgtggcatgaaagtagccatggacaatatgcaaatgaatggttatacctatgtttaataaaaccttatttataaaaacacacagtgggctggcaggctggaattagcctgtaggcagtttgccaactcctggtctaaggctgaagtcctcaatgttggatccctattagaatcagctgaggagctttaaaaaaatatcagtgcctggatgctactctagacaagaccagattttctggaggtagatcccaatggttttgagatattcctgattcagaggtacctggcatttgtagcaaagctaagtcaatagggaagcattccaatgtgatggggagaattgacccccaaatcaacaaaagagtatggaaagtaaaggaggagaatagagaaaaggcatgctgttcaaatcctggcagcaaatgggtcaagaaagcagacaaaggccagatcagagggacaatgacagtgctcttggaattcacaaatgatcacgaggcaagggaaccaccatggagagtcctgacatgcggttaagagaacaaaatgggtctcgccaagaacagtatcccaagaactcagagcccaggttccttctgtccactgtcacttctgatgcactcaaagctccttccacagggatcctcttacctacacagccttctccatcaggtctccgctgatacccgggtccacagatgcacatatatgtgccaatgaggttcttgcattccatttgtttttcagtacagtcatgttttccctcttcacactcatcctcatctgtaaaaaatgtacaatcacaaatttgtcaaagaaaatgcatatatctgccttaattacctgacttttaaacataaaatgttagtaagtaaccaattttcatctgttatttcactactggctgtatttccttctgctctgttgagtatgatctctaaagaatggaaaggaatcttctaaccacctttgaacttgaagaaattgctccctaatcaactgatgacctcttcaagaagcatgattctgatcatgccttttctctcttctccttcccttattttttatttatttttatttttatttatttatgtttttgaaagagtctctctctgttgcccaggctggagtgcagtggcccgatctcagctcacttcaacctctgcctcccgggttcaagtgattctcatacctcagtctcccaagtatctgggattacaggcatgcaccaccacgcctggctaattttttttgtatttttagtagagatggggtttcaccatgttgtccagtctggtctcaaactcctggcctcaagtgatccacccacctcagcctcccaaagtgctgggattacaggcatgagccatcgtgcctggctgtccctttatgttttatactcctttgttgaagcatgatttctaattcttgttgactaattgaactaaaagggcctcatgtaattataatataatggatatatcttaatataacaataattataacagcattataatcacaatatatgataaggcaataattataatagtactacaatcataatggattgtaagagtaacaaaccaaagcttacattatgcaataattataataataacacaatatattataatatgatattattatttttttgagatggagtctcactccgtcatccagtctggagtgcagtggcatgatctcagctcactgcaacctccacctccggggttcaagcaattcttctgcctcagcctcccaagtaggtgagattacaagaatgcgccatcacgccagctaattttttgtatttttagtagagacagggtttcactatgttggtcaggctggtctcaaactcctgacctctggttatccacccacctcggcctcccaaagtgctgggattacaggcataagccaccgtgcctggccaatatgacattatttttatatgataatattagtaaacaggatataatagtaaatgactattttatattatatatctcaaatatcttattctctactggttcttccctccttcatttccttttctggacttggttgggccttcctcagtctttactttctgtcctattgtacttctttatttttctatctttcccgtttacatgctctgagctgagaaatttgaaatttattctgcatatgattaggacctttcatttaggaaatttccccacccttaagcaaaattatatttacgccatcttgagagaacaggtgtctgttcatttaagatattgacaggagcaaatcagagctcttcaagagcaaactctatgattactgcagtttgtgaaatagagcctagttcagtgcttaggaaattgcaggtgttcaggaggtatttttaatggagatggtttagctaaagtagattccacgtgttaccccattcttgaaatagaatatcctttggtgttctcagagcattttgtatatataatcaccatagcatttatcacactgtattatgagaacgtatttatatctgtctcaatctcttcatattgggttttttgaacgtggggaaatgtctttttctttctattcccatatcttgtagaaatactggcgtgttgtgagcatgcgatgcacagtgagacctaataaaggatgtgcagtgcagtcctcaacttggcttgatgatgcttccagctacaatttagggggaaacgtggcagtgacaacccccgtattgtccacggactatttatattccaattcccagccttctcctactaagggaagctttgagggacatctcccctcacagataaagcttcctggcttagatgaccttgaacacgatgactcacctttgcacatcctacggtcttctctgagcacatatcccacgggacatttgcattcatatgacccataagtgttcacacatcggaaggcacagagcagaggattctgggcacattcatttatatctgcagcagaggagagtaagtaaataagggatcatggacagcaacaaaagggaacctaccaattgaactaaaactctaaaactttaccaaaagttgcaatgcttcattgtcataaacatggatggatcaagtggtctcccatttcccggaaattataaaatgggttgattattttatatttggtataaacagagtgactctccatcccggttctcccagcacagtcccagtttatgtttgttgtcctggtataattattaatgattatttaggtggatgggaaattacaggccacccaacatttgaggggctcttctgaaattttggcttagaaggctcaggttgaccatttgtcactcccaacagttacatggcgtgggaatcagttttgccccattccgccaaaacaattgtggtcagaacagaaaccaactcctccaatattgttaaccacctctctttcccccaaacaaagaggctcctgtgaaataacagcaattcttctgcccaagcaaatagtgttccagatcattttatactgacagagacactcagtttacacagatgcccatgttcaaaccttaaatagatgggaatgagtttactgttaatggaaaaaaagtcatttctgcagactgcagagtttggaaccatcagaatgtgttttggaaaagcaggattaaaatagaccatctcaactatcatgttgctccccaaggccagtgctgactaagaacacgagtgagagcccagatcatgacttagtcacaacctttaaagatttaccacaactctgacaatgggcatttgatagatcatatctgatgaagagctctctttgctaccaactttattctctgccttcacctctccttcattctttccttaggccagtgaatccctacttgagagtgtatcagatcacctagagggctgctgggctccaccccactctcggagtttctgatttaggaggtcttggatgaggcctcacaatgtgcatttctaataagttcccaggtgatgctgatacagctgctcctgggaaccaccctttgagagccactgctctagacactccctccctttccttctttccatacattccaccaggcttacggatggacacttttcagatgcttatatattacaggcaaccgcttttgctgtgattgcctccaaatggctacaggatgatggtgggtatcttagtgtgcagtgctcctagaaatagaaaagaagagaaaaagagaaaagaaaaagaaagggagtatgagagacagaaagaaggagaaagtgagagtaagaaagaaggtattaaacaacacggaagcatctaaatataagtggtagggaaacaccaatgagaactctctgtgatatacagtgtagatgtgccatgaacacacaactgtatcattcttggatatctctctttccctacagagaagaggccacaaaagaagaatgatcaaatggcccatcaggcctagatgatctttattatatacaccctgagttgtatttaatattaagacttgtaatcaaccaattgttcccaggatcagtacacgtaatcaactgttctctgtttaagagatgtaccttcacatgtcatcattggaccgggctcaaatccctcctcgcaggtgcattcaaaacctccaatcacattcttgcaggttccatttccacaaggattgccaacagaacattcatcagtatctgcaagaaaccaggaatgtgtccaaaacatgatgaattgagataataccttttattctatcagaggattttaaactgtaattttgttgttgttgttgttttgagacagagtctcactttgacatccagactgcagtgctgtggcgcgatttcagctcatgcaaactctgcctctcaggttcaagtgaatctcatgcctcagcctcctgagtagctggaattatgggtgcacatcaccacgctcaggtaatttttgtatttttagtagagacagggtttcgccatgttggccaggctggtcttgaactcttgacctcaagcaatctgcccacctcggcatcccaaagtgctgagattaaaggtgtgagccaccaagcccagcctgatctgtaatgtttaattctcattctgttcttgcaaaaagggagtgtgcatgtcttattatctcaggtttatagccgtgaaattcgacttgctcagtggcagtggcaatgacagtgagaatgacagtgcctggacatatagcccttacagtgctcttctccatgagtttctccagcctcccacattataaactaaatcttctacttggagtagatgctctaagggttaaaaaaaaaaaggcccctatcactcgtcaaaagtttctgcttgtttaaagcagaaatacatccacagtttggccttacattacatcactccccaagaagccttaaacatgatggatttttgccagatataaaataaaagactaaacttacgtaaaataaaagaccagaggttaagtaaaattaatacatcaaataaaatcaagattcaagtagattgtgttgattctgttgaaaccagatggtttacattaggaagaggaaaggctagaaaaaaatatgtttaggttatgaccgctctaaaacacaggcggagagaacaaatctttgaccagagacctaaaatgtgtgtgtgtgtgtgtgtgtgtgcatgtgtgtgtgtatatatatgtgtgtatatatatgtgtatatatatgtgtgtatatatatgtgtgtatatatatgtgtatatgtgtgtgtgtgtgtgtgtgtgtgtgtgtgtgtgtgtgtatatatgccttctaacccatccacctagaatactcaccattcttattctgacacatcccttggggagaatatctccccttaggaaagaaataattttgagaaataacattgatattttagctatctaaggcacagaagagtaatggctcttgtcaacagttgtttcttgtgctgaggttcttaagtcaaaagtaaaggcaagaggctatggtggggagctcctaggcgaagaggctcatttcatatgcacatattagcactaactgaagattctgaggagaaaacattgaaatatttgcttttgttctactataatattcaattactgtcaagaatattatttctgtttcaagttaataaaaatcccgataccattgatctttagagctgcaaaggtaattagaaatgttattttacttgcataatattatattctaaggcctagaaaagctaaaaaaactgcttaaactcccacagccatagctggagctgaaatcttcataacctgatttcttgtatggaaaaagtactttctaattcacacagacaaactctcagcatttatgctagtattaattatgttatattgaatcactctggaattcttagataactaaatatgatccttggatttaagttagagttagtgttgattaagggtcaaaggccagccagaggagccattatttgacattttaaaaacagggttacaaaaaaaagattgtgtactggttatatagcctttcatcttactaaatgtaaaagaatccagataaaatttttatttgataagggaataagattatgaccattaacaatttttaaaaaatttcacaaagactttcattatgatgttgtcctttctagtatctcttctgatatgtccagtgtctgccttcaccattaggctgtaaggtccatgaaaggaaggaacttgtctttgtggttcagtgctgcagctccagagcctagcacagtgcctgggacctgatggtgactcactagtattctaaatgaatgatgtatgagtggatggataaaacttatttcagtgccatcttggtacctatattcatggctatacagtgaatactgtatagcttaatttttaatttgtaaagttcctatggaagaaaacttattactcacctacacattcattccctgctagaatataaccaaagggacactcgcagcgataggaaccatctgtattgatgcactgtccatgtttacagacatcgggttctttgcattcgtccatatcttaagcaagagaaaaaaaatagtgaataacaaggtattttttaaacgtgaagataaattatgatcatttcagtgtttaatcaaaagattatctaataatgcaataatataattgctatctaaatgaagggacaaaaaagtagcacttaattttccaagatagatggagaaaaataagaataactagagaagaagcagattgagaatactgagaaatgctgagaatccagcacaggcaactgaccaactgctgaatcatcaggtcccacgatgatcccacttccataaggacatatctggcggaaggcctctgtggtggagacactcattaatagatagaacaatagcaattcattacaagcttctccacaagtattttgaggtagaaaattgctacatgctgtgcatattgataaatgatggaaaaaacaagcccagaaaccagaggaagttatttaacgagactccctaagatgttgtgtctactccttgggcatctgtgattcatgacataattaaaaagaaaataactaccaagctcctgagataaaataatttttaatgaacattctaattagacttacaattaaattaaattgtgttactgtctttaaggcctacagtcttacttacatcatggccagtctgcaccctgcatggcccagagagaaatgcagatgacagacataccatcaggttccgtggggcagagctcgcaggggtctccccagccttctcccttcaaggcacagcagcattcctgcttggagtgatttctggatttgggtgatgaacactttcctccttcaaacttcgcataacagtagctcattcgcaaatctgcagcataaatttatgacacccttcagttgctttcctactgagtccgtattgcaccatagcaaataaagaacaacccactatgttatatatgttctcctctcaggaccacagcaatactccttacgtgattctaatggtaactgagctgagattgttaaagtcatgggtatcttttgtatagtgagatctgatgaacaactctatgaacttaaatttattacttctcattttagtcactatttcaaagtaacccgatgtgaatccaataaaatccaaaactgacagttttcaaaactgacatctgtcagtgacttcaggattggaaagtccacagaaggaatcattcacaagattccttcattgatagctctgcttgcaatatcatgtttaatgagcacactagagtaagagaatcctcttagttctaatatttactgtgatatcacactttgtggtttattctgtgtcccctaaactctggaactaaaataaaatcccagatcacaggcacagaacaaatacagaagtggcaactttgtagatgggcaaaaatacaacacaagggttggtcactgaagcagatactcccggagatgctggctacaaaatgcaagtggggctttttgtagattttacacacacacacatatgcagagctgtgtcaatgttaaatttttaaaagaagcttgtttagctcaacacagagagggaaggaagaggagggcagggctgtgggtgggtgggaacagaatagtctttctttgaaagaatatatttcaatattgattattgctttgatgactccaacaaagaagatgggatctacttcctataaaattctccaacattgcttgacataattttggaaacgggcttttccatttctcatacaacacattgactccaaaaagtgagctcaaccagaggtatggactgtgttttccctcgaacttgacttcttaaagccttccaaaactcctctcattacacagaggccacaatctgcaggtttaaaagaaatgctttcatacccatattgtactattcttctttctttatatctgaccacctctgcctttttcattcacttccatcactgtttttcaatcccaggaaccatactatcataaccacctaagcacttctgttaagacagtctcaccagcttttatttcatgacaaagaagacaatgtaggaataacagagttgccagagataacaaaggaaaggttttcatgaattaaagtttctatctatctatctattatatttaccaagttatgtaaatcaaattcaggtagcctccccagtaaacctgctcaacctttcatggctaccaactcatccagataaatcatctctctaatttctattccacttccccatctgttgtggcaaggacctggcaagcacctttcaatgaattatccttctgaaggtcaagagcaataaaagtcaatcctgcggcatctctgccacccaaatgtttgctttgctgagaaacttcaagactgaacaaattcttgtttcttggagaacacttttgatctcttttattcttcaagttctttgtcacatataatgttttgtatttatcagtcttgtttttgttatttatgcctccaactacctttagatataattcagtgactactcacaaaaatgtctcaacaaatatatgaaaacttaactctgctttgtcttccagtttgtagtgtttctttaaatatgtatgttgtaatattggtgtattaaaattctcattctcttttcctttaatagctgacttcgtcccagaccccagctctatctcccccacaccactccaccccgaaaaaaaaaaatcttggcattagacagagactcaaatgcacgaagtcttgagtcagtctaagtggcaaattctcttcgttgaactttgcaagtgggagtggctcatttacacctgtggtcttttgtgccaggctctgtccacctgagtcccatggcattcgctttttaaaaaacattatccacggttctgtggaattttctcatttcatgagcaatagaagtctgactcctaatttgtcatcttacaagaaaaacccagctctcaatttcctggctccagcaaaatctgtgctctgtaggagacttactttagcttgtggtgattctctagaattggcttattaatcaagggtgtcttgcattggggaagagagctgtgcttgcccacatacttcaggactcactgggatgcctgtttaccagtccatctgcaaagagcccttaatgacctcgaaatttcatcagaactacaaaagtcactttccctgcttgcattcctcagttctggctctgcctcctggagctgagcatgtggcagggctgctcacagctgggctgattcttcctgcagcgttagcttgctctgtgatgggccagtgcaaattgaattaatagcctaggagtttcctctggcctgccacatcggcagattcacacctggtttctcactgctttctttccaaattcaggccaagccaaaggcacacaaaaacaagggagtaggagttagaatttatctgactggtctgtaccatgcagaatatctgttcgaattaagcaccaccctgaaatccacacagaccactgacaactaccaacaagctgaaatcaaccggagaactctcaaccctctccttcttacttcccaaataactagttgaaaagtaaaaagttaatcagatcattagaataacaacaagagtctacaaaggactcagaaactaacaaagctttgtcacagtaaggctggttgggcagatattattgttgtttaaaatgaggaaattgagcttccaaaagattaaatgacttgctctagactaaatatggcagggctgggaccccaaactcaattttttgaaccttaaatgatatccagtgcctcttccatatttggtaatacggaagcaaaaccaaaaaaccatgaaaaaaaaaaaaaacccaactcaacatcaaaacaacagtaacaaccaaacaacaaaagctacaagtggaaaaaaaagaaatacatgtgtttgtttcatctcccttccccggaattcatgaaactagtttgtgtatgtagatatccatacacaactgtattgtttagaaaagtctaaacagttttctgggacttaagtacatactgtgttatgccaaagttcaggatccttttgatttttgtttaaaatttgaaagtcattggcaaacccttgaaaatctttactcaaatagttgacaagtattattcctaaaaatgaacaatggcccagcaagaatcctgatcagtttaaatttatttttgttttcttggagaatttgtgatataagggatggttaccatattgtgggggcaaatgggttaatgtgcagtttttcagtctcaagtctaactttggacccacatttttcagcttatctcttcagaggtaggggatatgtagctcaacttcccccaggctttgctgtttcggtggctcaaggtgtttccccactgatgggcctatcagcatttgtgttcttagtgggagagaggtttatgtgtcagtacaattgtataagcaaccataacttgatggatgagtttttaaccttaaaagtgaaaatgaaccttctgacatatggttatcattagacctctgggtgaatgaaaactctccatcttcctgttcacaaagaaacagagctttgccatgtttgaaaaataagaccaccacaaataaacatgcagcattgaaagcccaaagccttcaaagacacttaccttggcaccttcttccactggaggacaaggaaaacccttctggacacagacatttgaagctgccttcagtgttactgcatgtgcccagggcacaaatttctggctcttcgacacactcatcaatatctaaaagaatcacatgagtcaaacaaagtcaaaacacgatggagacatcatcaggtaccaaacacacaatgtggacacacaaagggcaactgagtttccaaactcttacaataataaaggtatttttctgtaccataacactgtggactggacttctaggttgtcatgacttcaaaagaattagttttgacagttattgatataaaaatggaatgtgcaactgccttctaaggggtgcagtgacaaacgtctcttacccagactgagttgcttggctaactagaaaagtcagagtaatttcatagtaccctaggccaggaaagaagcatgaaattctagagtcacactgcaccattgttcaggaagcagaaatgctgagactttaagcacattgctagtgactcactcaatgtgagatctaggcctttgatccaaatttactcccctccaaccacccacagaacttttcccaataccctatgctatagccctaaaactgtgaattttacaagaacactaagactcatgaaaataagtataatcctatgaagtgcaaactaacgatatcatagaagatgacgctcctgatttgtgggttaatctttctgaagacacaaaaatacctttcttgtacaggctttttctttcatcatatagacaataggaaactgtacacttagaattgtggcatgttttctttagtatattatacatcttagctcctgtacagtggtagttaagagtagccaataagaagtttgaatggcttgagtaaccatatgtcctagtttgcctgggggagccccagctcatgccagttggcctgactttattgttaatagtgcccttttctactttcaaaattggcttgggttggtcaataaaacatacgattacctatggaaaaatatgcccactctattccaacaaactcacttatctttcctcctgactttcagcaggaatttttagtgaacaaagtggtaagtcttaattctgagccatgctacttttatgagaatacttttttattttttcaacaaaacacaaaatatccttgtatcctgggctctttatttttatatttgtgcaaaggtttctactcacaccaaaatgtacttgcattatacaactttattctcaagaggcccaactaaggaaaagttgagaaattaaccttattatcttgacttaatattgtaaataccacacaataaatattctagaaatgtgcaatgccaagtgattctctttctgtgcaacgcaaaatcagcttctccatcatgccatgttattgggttgcatttatacctgtgttatgttccctgtggtttattaatgaatctgatcttctattgccgattgaattactccattctgacactccttccacccctatatccaaccttttcttaatataaaagttaacttttgtgaaaatgctcaaatgttttcagttgtttttaattattactatgactatttatattatggtagaaattagcctgtacatgccaacttattaggatagggccaaatattgtagaatgggcacattcattgactgtgcagttatttttctttctatatatattctgttcaatttagcgaacttatgtattgataataaagccaatttttaataaaagtaaaataacatgcttaaaaaatttgcatctagacaatttcaataaggtgtttccattttaaatatcaccacttgattgttacttaaattggatatataataaaatttctaattgacgatattaaaagtagagaaaattctcattgtggattagatgcagacctgtttaaagtcaggggtgtgaactaggtgacttcttgaaaatcctttcaaccctacttatttatgaaattctagcaattaatgtccttcacttaatgatatgacatatttgttgaggttaaaggaaggcccttgggaggctgaggaaggaggatcatttgaggccaggagtttgaggccagcctggcaacatagggaggccccatctctacaaagaattaaaaaatcagccaggcatggtggcacatgcctgtagtcccagctactccagaggctgagacaggatgatcacttgagcccaggagttcaagcttacagtgagctatactcgtgccactgtacttcaacctggtgacagagtaagaccctgtctccattaaaaacaaacaaacaaaaaggaatgtaatactgtaaaatttgctgagaatttatttgaaataagacatttccactgctctataggtaaaaacaaaatagacaaacgatataaccacattcatccaaccttgaatgtggtcatttaaagtttttaaatggaatcaggagctatttttagctgcaaagaatcgccacttaaaaaatgtagttcggaaatactgggagtaggacacagcattcctaacaaatgtgtgaaagcacagtggaaaagagtcaggatcatatgatcagtcatatgcacagaacaaaataacttcattagagattagcatgataattagtgcttcttgtcttgccagaaggatgagaccatgtcatacctatgcccttgcatttgtttctgataaagtattccaaaatgaagacgtcattacaaaaattctcattctgctaagtccagtggacacccgacactcctcatttgctacaactgatagctttcctaccttcacacttctcattttgaagactgtatccaggtgggcaaatgcatctgtaggacccatccaagttttgacaggtacctggtgcacattttctgggttctagaagacattcattgatatctgcaaagaaaagggaaaaataaggaagaggttcccactggcatgacttccatcaaacaattaaaattcaaaaaaactagaatgaatcaaagaaatacataaagcaaattaaagttcataaaattccaccatggagaaaaataagcaataataaaaataagctttatcagctttcaaaaatgtatagcataacaaccatattttattttacctgcatcaaattaaatgtttccagaaaattgtagcatgtgaaaagtcagtgagtatatagattttaaggatactcaaaagatatgagagcttactacaaaagtattttaaagaaaaatatttaagaagggaaatcacaattgcttacagagcaatttagcaatttcactgtttaatagtttgagtattcttggtgagtacaatagcttaatttttaaaataagggaaaaagtgattatatatatatatacacatatatatatatacacacacacatatatatatacatatatatatacacacatatatatatgtatatatatatacatatatatatgtgtatatatacttaaataaaaacaagcctttatagggaggattaatataattctactctgacttttcctccaggtttccagaaagaagcattagaacagagactgcatgattccttgagtggtctctggaagcattctttccaggtctttctaagtcctgtacttacccacacaggtcctcccatctggagccacctcatagccttcattgcactggcactggaaagaccccactgtattaatgcattggccatttctgcaaagattcccatttccacttgcacattcatcaacatctgcagaaaaatccccaacaatcctttaatatattccaaagatgtcataatcccagcaataatcaaaacttctaaaagaaaaaatactttttctgaattttagtggcctttgctggcttagccaaacaagaaatgccaatgaagatctagtttgcaacaacagaactggctttaagcacctatacacatttaacaataagattacattattatattagagactgacaatttacattcaaatttcctatcagtttttccttgattttcctttagattttatttttaaattttagatttaaaaattttttgatttaaaaaataaaatcctaatacacaattcagctaagggcattcctttgtattcttgcaattagatttaaattagcctatagcacaataaaatttaaagaatttggcttattactcttgcctagtatgttttagaaggagattctgtagattcaatgatttatttaagagaggctacatgaaacatctagaccagaaggttcatagtcctgaatcatataatttctatacaaagaatcacttttgtatatttaaaaattttttggcttaatctaattccatttattttgaaatttatttaatttacagcaaagtagacataaaaattatagctgctaataagcattttaataaaagtaatggatatagttacagtggttccctcttatctatggttttgctttctgggggttcagttatccaaggtcagctgctacccaaaaataggtgagtatagtacaataaaatattttgagagagagagagacagtgcacaagaaagtacagtcatataacttttattacagtatactgttataattgttctattttcttattagttattgatgttaatctattaccatgcctaatttataaattaaactttaggtatgtatgtgtaggaaaaaacatggtatatagagggttcagtactatctgtggtttcaggcatctgctgggggtctcagaatgtatccctcacggataaggggagacttctgtaatatatttcatgttgagcacattgtatttgacaagtcccataaccaattgttatgcataagatagcatacatttttaaaagacagctggaacactagagatgatgctaattacaaagaacacatataaaactgacttcctttgctgatgcacaattttgcacacgcacctatacagtcattgttgtgagaaaggatgaaaccatgattgcagcggcagttgaaggaaccaattgtgttccggcaagttccattcccacaggcatctctttcacattcatttatgtctagtaggaagaaaggccataaagaaacataattataagtagaaaaagtggttacacggttacagtggctaaagagcattttagggttcaccaggcctcatccataggctgagaacttcttgatgttggtatcagctccagcagcagtcatccctgcaagataccaggcagcggcaaagctctaaatcttgggaataaatggtttccttggctggccagtgaaaggaggcaagctaaggacatgagacctgaacaagaattattttattctatttacttctagaattctccacccttgccacttttctcaaatattttcacttgaaaatggaaaaaactctgtgtgcatctgggtcttgaggtgttgccacctttggcaaacttcaaccttcaagattctcactccagtttaccaaaaagcagtgactcacctggcattaccccacaatcagcaacaaaataactcagctttctagctcacctgtcatttcagacaacttttcctttttccctacacccataaaaacatagaacaacttccaccaatgatgacttctctcacttttctaaactaccccaaagagatggcacttaatttgttcttttcatacatgcttgcattcttattcgccttttgattggtccgtacttttctctgatgattttgtaaagctactctgacatcttatatgtctttgcatctcatcacagcagctagcatatttcttataaagagtagatgcacattatattaaggaggaagtaataaaaaatttaatgaaagaaagttgttactgctggtttgaaagaatgaggcaccatgaagagggacaaggatgaaatgagagagagagagagtggaaggtaacaacggagaatagcaaaatgtaatgattagagctaggattccctttcttttcacattttggacatgaagataaatgatctgtgattcctgaatcaggaagctattgctaacccaaagggactctaatgtgtgtctgtggttgaagactacacccagatgagtcattgctagtaatcaagaatttttgccttgattcatttttagccaaactggtgaagttctttggttgggaaggttctatgttagggggctccagaaaattcagatgagagatgtagaaagaaagttgggcaggatcatcatagcttttacacaggttagctgcccagtgatgagtagggctgtcagtgctcttgtcattactctggagaagatacaactttatgagaaatgttcccaaatggatgaacccagtcatagccaaagtcaaggacttaaacattactatattaattgttctttcagctgtgaatctgatttatgttcttaatgtcccaaaaagacttaatggtattgctttaaagtagaaaaataaaggaaggaaaagaagaaaatgattcattacacactgaagtttattctaaatcagcatcctgataatagagaaatcaggaaagagatttaaaatcctgagctctttttcctctagaaaaatgattaacttttctttgcctttgtaggatttataaatttgcctttgagaatctggtacacactataaacccttccaaaaaaatggtcatctcacactcaaaaactcaaaagaaaatccacatcaatattacatatgaataatagcctattaacattaatatttttgtattaatatctttttcaatttaccccttagtcaattttttctaaactgacagccaaatgaataacaaaggaagaggtttatcatgttcagattgccaaagattaaataggatatcactgctgcatatctgtctgtgtttttattttgtatatagcaaaaatactactaaaagacttagtattaaattttatccatatttagaatcaaatgaagctttcaacagcatatgaaaaaaataataataattgcatacttacccaagcacatggtttggtcatcatttgttttaaaaccagtgtggcaaaggcaataaaagcttccaactgtgtcaatgcactgcccatgactgcatatattggggatttcttgacattcattacgatctgtaaataagaagcatcttaagtgagaacttagaagacaaaatataattgaataacttacttctagctatcattctcaggagtaatcctagctctaaactaagttagtgaaacagatatatttatttttgcatcaaaatggattaaaacttactctcatttaccaggcatagtcagagtatgttaacaatacttgacacaataaaaaataagggtaagtaatcaaaaaatattctgaaagatgagaaaacttagaagtaaaatggggggattcaagccgggaggattttctgtttgattatcggcctacgcagcaccacagactgtggaattaattgaagtattttgtctagttaagatttggtgccttaagtcatggatagttcatggcttcctttgtaaatttatatcaaagtcaaatcctatgactaagattaagtttttcttgatggacaacctacatggctgcttgttcaagttgcatctctttgttttgtcttatgcctgtaactttttgttccatcttcaccaagtattcacgtctacacagggctccttttagcatgtgacaacctgaacactgtctctttctttttactctcatccattcaaaaggaagccctctcatcttgcttctgccagtctttaagttctaaattatatttatcatcaactgaatctttgttgctttcctgaaatctgattatctgaggggcagaatttaatgcatgaattcacatatgacataattatatgccaacttacgtctctaattttttaaagctctatgtttagagtaaatgtactttgaagagcactgtgccattctgattttcctactgtcacagaagaaagcaaatggagtgtcatctttgctgcagatgctgtagggcagatggcatttcgctcttagttaaataatccagacttgccgtttgcctgcaatgtctactcagaacacagtaatcatgaatggacactttttgctgcacacagcaaccctccctgtgccagaatcatggacatctcctccatttcatgtgtccgggatgccactgttatggttatctcctatttagtagatgaatcatcataccatttagaagttccaagtgaagtggagtatatcattatgaggggaaattgaaatagagcagcttaggaactactactagcctatgcagaaatgctatttaacaaattatgattattcccttttgagaaaatgaatttaaagtgagccaactgcttcccagtataggcagaggagactgatttccgatcttgaggaagggtgtctcaggtcctaccatagttggcccaaaactttggcaccttcaggtaggactggacctggaggtatgcaggggacgaggtctgtctcatatctgagttccacaaggaaatggagagccttaaggatcttattagaaagggatccccaattaggaatttcctttcatctactgccctatttcatgatggtttaaataaatgaaaaatgaaacatggggagtactttggagttctactggtaaaactagagcagaaatctaggtttccacaagcaccagaatttgaactcttagatgatcatatttgaggttgggataggaggtctgaacaggctactgtggaaagaaacccaaatagtcaacagagaaagagaggaaaccacaaggaagtagctgggaagaaactgttccttgtcttttgtggggcaagacatttcagaagggggttgcatttgttctaactatccagcttctgctgtcagactagcatcctgagctcagatatctaattattctctcagctctctcagcaataatgtgggtgctatggccaggtgtgatttgggatttgaaataatgtgcttatgaattcaaataaggatctcatgatggagagaaagttttagttattttcattttaaacagatgcacaaaggagtactttgcagcatgcctgaaaaaaaaaatgccaagtatagaatagcatttaaagatattttaaaagtaagacataaataaagacatttctagaatgaggtcttcaacccaacaggctgaatggttgcaaaactcaagttaattccctttcttctgaggatttcaatgaataaaggaaatcaagcttttggctgcaaatgatgctcactcacaacacttatggctggctgcattttatgtatgatagtctcctacaagaaaacagtaaatgacttaagctccagcaggctatggctgaatgtcttatcttgatctataaatagctctgtcccacttcttacctgagtgtgaaatggtgtgaaatgactcattctatattatcagcaattctttattttgactggaattatttcatccagttctaaagaaatataaattatgagcaaaatgcagggaagtggtatcaatgccaagtttctctagggtattgtggttcatatcagagacgtccctgcttttcctgtcctgtatttttaatacatggatagcaacagctctgttgacaaaatgctaaatacttacacattttcctttaaactcaacaaaacaagtcttgattctcaatgcgatttttttgtttggcaattacaccctcttcccaccaaggtctcataaaacaatgcaaaataccctaaagagaacagtgcacttcctaccacttaatcactggtaggcaaggaaatccaaggaaaatctgaccacgttcccctgtgttgtttcattcacaaatgcataaaatatccaggaaaccccccgtgaaatgaaccgtgagcaaaataacacattcttcctgactaatatacaatgatttgctttgctaaatatacagtgatttttgctaaatatacagattcagaattacttaaaaacttacaagaaaatcattctgagatattattttgtttctgggctgaaacagcagtcttttaaattttcacaccactggctacaagataccatcagatactgaataacttcaccgtacactgaagttgataacatgccaacgtgcttcctatttctatcacatccctgacaaaagtgaacaccaaaaaaatctaatctctaggggtcatgggaataaatagctaataaaggctgttgatgtttgctgccttcagtgagtgaccctttccctgtaagatgactgggaagaaaagcgatggctttgtttgttctgtttctgcagattaatctgacccagctcaggagagcttcactgtctagatttggggtatgcagccaagatggtgaaaacctcacctttctgagagggattctgtggaaggaaaaaaatcatttggtcctaaatgttgcttaggggaatgtgtgtatgcataattgtgtgtgtgtgtaatgtgtgggggtgagtgtttgcaggcagggcagcagacaggcaaatacgaaatctatgtatgcgaatgatttacttcttgttttgaaaatatctcatccagaaagaggattaaaaagctaagtgtttagatattttgacaatatccctttttccaatttagtttaatattagagttcatcaatctaaatcttaactcatatattcttcagcttaactatctgaaaataaatccagatatctgaagcttcatgaagacaaactcttgggtaggcatgtccagcctgtggggcactacataccattgcactgtcctgtggaggtgaagcggtagccgggcttacagtcacagcggtagctgcctgcagtgttgatgcattcggcgttgcgctggcacactgggccgttctgacactcgtcaatatctacgagcagaagagaactgaatttgaaggagaacagaatctggtgtccagtcaacaaagcctctcacatgaaaacaaatttatattttattttgatctgttctattgaaaagacaacatagatgtgtacagcagctttatttattgccagaatttggaagcaaccaagatgtccttcgataggtgaattaacaaataaactgtggtacattcagacaatggaatgttacttagcactaaaaagaaatgagctatcaagccatgaaaagacatggaagaaaattaaatatggccaggtgcggttgctcacacctgtaatcctagcactttgggaagctaaggcgggcggatcacctgaggtcaggagtttgagaccagcctgaccaacatggtgaaaccccgtctctactaaaaatacaaagttagctgggcatggtggcgggcacctgcaatcccagctacttgggaagctggggcaggagaaccgtttgagcctgggagatggaggtagcagcgagccaagatcatgccattgcattccagcctgggcaacaagtgcaaaactccaagtccaaaacaaacaaacaaacaaacaaaaaataaaacaaacaaaaaaaaaacacacacaaaaaaaaaggaaaaaaaaaggaaaaagaaaaagaagaaaaaagaaaattaaatgtatattactaagcgaatcagaagccaatctggaaaggcgacataatgtatgattccaaccatataacattctggaaaaggcaaaactctggagacagtaaaaaatcagtggttgccaggggttaggggagattaggggatacacaggcaaagcacagagaatttttagggcaatgagattattctatgaatagttatggaatggtggatacatgtcattataaatttttccaaacccatagaatgtacaacaccaagagcgagctctaatgtaaatcatcagagtggactctgagtgataatgatgtcaacggagattcaattgtaacaaatgcaccactctgatggaggatgctgatgatgggggaggctgtgcatgtgtaggggtagggaatatatgataaatctttgtgccttcttctcaatatcgctgtggacctaaaactgcactagaaaataaagtctattaaaaaaaaaagaaagaaagaaaggaagaccgaaagtccattatctaaactttcccacttagtaatatttataaatgcaaggcttgatttatgaccacatatggactctaatgatgctcacatctaaaaaaaagtcatgaaacttggctgctagggccagcacttgacatgggtatagattaatatcctaggaagccttgtatttactcaaagatctggattttatgattcaataaggttgctattgtctgaaaggctgcaagagcagaatgtctcaaatcttaaagtccacatgaatcacttgggatcttgctaaaatgcagattctgacttggcatgtctggaaaatggcctgagagtctgaatttctaataagttcccagctgatgcaggtgctcctggtctgtagagagtgctttgaggtacagggctgtaaagacacctgctcaaattactaccacaaggcaatcaaatcaagaaaacctaacatgggagttatcataaaactactgaaaacaaaccaactctcattaaaacagaaaagattttggataatggatattgtgtgttccagagttttgactttgcttagggggttgtctgtctacaaaacaaaacaacaacaacaaacaacaacaacaaaaaacagatactaatatagttcaaattcatggcatcacaaaagttactacatgtccatgctatatcatggggcaaaatacatgtttccctcttccctgctccagtggaacaatctaatttacagactaagtccaataaaggggatggcctataacacaggtgaaggttggcccttagtaccagttctgggcttttacacagaagttggctcgaccaaagaagttcctacaagggggtggcaaatacatcagccgatgcctcttgggcgtgattctgtggtggaaaaccctcaggactgtcagtcagtcagtgggggttcctgtctaaggcaggtggattgtgcctctctgggcaacagacacaggagcaggagtgtgtctgccttgggttacaagggacccagcaccacctcactcaccaggtctgccctgctttgtattcaggatgtatagaaacacagggggcagattgcgccactggagaaactgagtagtgtcacagagaagcacttctatgatgtggcatctgataatgtggctacttggcaagagcagaggcgtggaagctccctaaatcacctctacaatccattccaatttcagcattgctgaggcatgtatgcactcaaccttcattttcctattctaagagctaagagtatgctaggaagcagctgaccctggattaaacattcaccctgaagacggatattctgtgaaatggaaatcagaagttggagcacttagttatctcaatatccacagaatgctaccctgacagcaaaatgccttgcattggtacagttgcatgtgtttaatctcatggatctagcaaggtctaagttgacttggtggtcatgggtggtcttgtctatgggttctggccaaggcctgcagcttcagcaaatataagtggttaaaaggtacctgggtacagtcatcatcaaagccatctctgaggggaagggtggggaggaaaatgccacaggcaggtggcaggcatgctgagcatgtttgagagggggaaaagtgcggctgtgagggaggcagccaactctagcactgtaagatcatctgccgtgggttccctctcccacatccatgcttcctctccaggtacctgatccttgatggcttcccagagcccagggacttgggccaaggtctgaactggctatcttcttaggaaggctcggaagggctattaccccattcccactaactcacacagcaggcagagtaagggacatgtgcccacttggacacagtaactgaaagcctggtgacaggaacttaacaagtatgtggttaggactataactttacttgtggtatataagttgtcttcagtatagacaaaaaagttttttttttaacattaaaatgttgacatatgtgctataatacgtgctctaaggggtaataaccctttctaacatgaataaaaattctgctagaggcctgaagtgtaagtattaaatagaaaattattccaactatcctgggcacatggtatatttaataaccagtaatgtcccttttactaaaatgtaagagaactatctttcccagatgcaggaaaaaatatgaagtgctataaggaatgctccgaatcacagtacatatacatggcaacaggaggtaatttgaaaatgaaaaaagtacatgtgcatgccaacattcttcatataaaatcaaatttgctgttcttgccatttggaattctctcatgcatttggaatatctgcattaaccttgttttcacttgggagtagcaaagtctctgtctggaagagaaatgattttgagagtcaactaggatgactgtccactcatactgattttccagcaatgtgaaacgaaagcaatctatgtgacacacccaggaactcaaagctttttcatatcagctgggaagtctaatattaacacactgtgtgttgggggaaaggggctgggaatgtgcctcctggtttttccactgaagttagtgaattttttttttttgcatgaaatttcatgttgttccacaccatgccctttactatttctagagcttaatgcatttctgaaatttcaatgttgtgaaattcgccaagtgtgtatcaagtagctcatcagttagctcttttctggatatgataaagtcatgatgccacttaccttcacaaaccaacaacttgtcattatagaagaatcccactggacattcacatcggaagctgccaaccatgttgatacacactccattttcacagacccctgggatctcccggcactcatcaatatctagagacagagtagtcattcatgagtgacaggacagcacatgatccctgtgcagggtaagacaagatggaaagtgcgtgcgtgtgtgtgtgtgtgtgtgtgtgtgtgtgcgtgcatgtgttggggtggtggtgatggcaatagggacatcaacgaatagcaaattgagataactaaaccactttccagacatgagtctaactggatttaaatatatgttctgggttttgcttcagaatgtcaattttgtacaggtaggagatatctttgtatcctctgggcactgtggatgcaccagatgagtagaatagagggatggtcaagggtaaacagcctctccacccaagtgtgcctatatttagggaaaaaggcagaggtgagctggtaaagaaccacagaggagcacatggtcatatggaactctgatctttcaaattccagtttaactcccccttcctacttcatgtggctttagaaaggaggtaagtcaggtgtggggatgtcagctgggctggggctgacaataaaaacgaggtcagcaccaaggaagaactgtcgcagtagaatgtgtgcttcctaagactgggagttgggcttggctctccaacactgtgttatggttccttagcactctacatgacaggtagtaagtgctcaattcaaatttgttcagttaagagcaagtgtctggcagtgtgttggtgagcactaaaacaggaccaagagtgagaacacagccaggatccaggctgctaaggcagggctggccagctatggatagagactttggacacctcaccagcttggccatgtccccagcctggagtggtcccatctctgtcttacccactctgaactcctgaccactgaagtgccctctaggataagagtagtaatagtagtaataatggtaatagtattaatagtgacagtatctcatttgctgcatgactggtacatttctcaagcattcaacctgtatttattggctgaattatcacagccaccccatgagatggtctcggtactatgactattctaactaagagatgaagcaagtgaggccaagccacaggatataacctgcccaagaccaagcagccaatgaaaggcagagtcaggatttgacactgggactcagttaacaggccatcctgcctcccttatcatataagggaagatcgtattatggtgatttcctgcatcaccctaatacaatcttcacagaactgtcatcaacacttttgttatcctggagggcccttccatcagccccttggctgggtttgatgaaacacctcagctgggaggtatgcaaagccttggtctacaatccaaagtcttccaattcactagtttctatgactgttgttgagatacgttgtttacttattatagtcaggagcctttgcaaggtacatactttgcttgcatacttgtgagaagatgatcacggactgaagtggagcctacaagagctgctgcaattttagaagaaccacactctataaccaatctgttttaaaggagaaatttgatgtcatagatttattttagaccctttttaaaaaagggcttgattttgtgtgaaggcaaaattgacctatttaatgaaaagaaacagcttagaatctcaaagggttcattgctattttgaatacacgcaattatgtctttagatctttcacacctttgtcattcatgtcatgaaaatgccatataaagttacatcacaactgtgtatcataagtaaacaaaaaacaaattcagatgccattcattcagtgtgggttagaacacgaaacatcatattcacattcgttttaaatataagtgatatattattatcaagtttaacaataacgggctgagtctaatttccagccattgttaggtataaaatagcaaaaggatatattaaaaattatattttcttttcctgtcaggattttatttgaacttcaacttagtgaagtttatattttaagacaagattgataaacatgctatagttttaaccctatatgaatggactccacatgccaacaatcataagatcttccaaaaggagagtataaagcttaaataaaacaaagtttttcagtcatctaaatattttgtcatgctggaatttggtaacaataagcatatagctaaataacagatgtccagttttcaagagctagaagcaaactaagccatgagtcaggactgtgttctggtcccagctctgttattaattagctgggtggccttgggtgagtcccttcccctctctgggcctctgtctcctcaaatatgaagcaaggcatttggactagatgaagtctgaagcctttccagctctcctagtggacaacgctaatgttctttctagtctttgcttactgccaaacttggagggcagccttgctggggtacatgcctggttggtccgtggagaaccactaccattacagaccacttatcttgtgatcacagattctagggaggttaaaagatctgttttgggaaggggaaaaacaaagcagctagggccaggtgttccatgccaatgtcatttagcagtttttctttccaaaccatgaagtttctttggacgtggacgagactgtggagccatatggatttggcactaagggagccaggctgattgctggaccagactcttgttttcttaaacaaggtcactggaaaggctgatgtggattttagtttacttattatgaataaggtggaataaagcaagtggtgatgtttgctactagacacaactgtgcagacttaagagggcatctaaggatgcatataaatcacaccagggaaaaactcagagaatgcaatagctttccatctacttttatgttatttggttttaaaccacaagggcattgcctgcactggctgagtgctgtgtaatacttctgattcttgcacaagcatctctcccaatgttgtgttctctgcttcatttaccaggcagggcctcagaccgaaaagatttttatttcacatctgaaattcccaaagcagatgacctgaggagattccatgtaagataaaattgatccacgaaaggactttatgtaaacaatctacacgtaaggattggtgtgaagtcacttaacctggtcttagtcagaaggaaggattgagaattacagttaaatcaaatgtcaactggccccactcccagaatctctccccatgttgatgcctaaggttggtgtaactatgcttgattgtaattttgggaaaagctttccaatccccttaatcatgaacaacaaatgttgttgccaattaggtggagctgcacagggtgtttgcacagtttgtttcaaactaagaatcagtgtttcaataaagtgaaaggcattgtttaatattttttttcctttaagaaaaaaatgggaactgaaaaaataatgctaacacaaaggcaaaaaaccagaaagttctgacaatgccgtcatgactcaccaacgggtaaaccggtataaatgtcgatgacaaagcctggcctttgacttccacagagtgtagcaaactcatctgcaatgattaaacaaaggtgggatgggaggataggggtcagcaaagaacaataattggactgaaaaaaattattttgtaagcattcttgaaaggtatttgtctgtagtttgaagaatttaaaataaaaagtaaacctgaaaattcctacagatataatcttgcctgtaagacaaatattgaagaaaaaaatgacctaatgttgacgtgataatgaaggagaagtagagatccccagatcacatgccactcattcacatgagtttacctgtaggagtttggatttcaatatggatgttattcagctctgaactcagggactggtaagagtgcctctctctactctgcatttagagatctagggtttgaggaacacgtataaaagccattttctcggtagattataggagaccatagcaaatctagccacattcttgacatcagatctattaatgactaatttgggtcaatcaaccaaccttcaccagtttttcagtttttggagctggatttcatttggtacagctctgtcatattctctccctctccctctctccttttctgtctctctctgtctttctctcacttgaattagtcaaatttaacagataataaaggatgaactaaattctatcagcagtcccttctaactgtgagattttgtgattccagatcatgactgtaactggtaaggtatggtatcaatctaagcttcagatggccattgccttattggtcacgctcagtgaaaatcagtaaaagatttctggaagtattttaatcaaaatacagcatgttattctccttgtgttttgtctccttaatctatgagtgttcacttccaacactgtaacgccagctgacattggtcacctaaagaaattacagggactcttaaaatatgtgcagatttcacagctaatgaaaagccatgactgaatttggtgaatatccaacatcaagaagaaatcttgcattttacacaagagtatgtagatattcaaaactcaggcaatcatttctaaaagtaaatgttagtctacattaagggtttccaaagtggtctccagaggaatatgcaataatccattaggataaaaaagaaaatgcgaggacttctatctatctttggaaaaatctaatctttaaaaaaattaattttgtgtacactttatattagaacagctcagaaaaataataaatgtatttttcaatataattgaaaacaaatacatatacacatacatagatatatatacatagacttttacatataaatgcacaccaggtgtgcataagcttcagattttttaccaacaggtaagtaccacctaaagttgtaaagaccattattcaagatcaagggtcagcaaactttttaataaagggacagagagtaaatatcttaggctttgcaggctgtacagtcagtcaaaactatttaatgttgccatgaaagcagtagtagacaatatggaaataaattagtgagctctaaaaaagttttatttatgggaaacaaaatctgaagttcatgtaactttcatattatgaaatacgattctcctgattttttccaaccatttaaaatgtagaaatccttcttagcttgcaggccattcaaaagtagatggtgggacagatttggcccatggggtgtattttgccaagccctggtctagaaacattttgcagggtggaggtaaatcagaattctaagtggtggttattatattatttctggagtaaacaatggatggaataatacattttactaaaaaacaattttctgttgcatgcaatgtcaggtagtaccaaacaacagatttaatattttatatatcactgtggaaaatggtgtaggattccctttatagaataccctaatcaattccttgcatgataatttcaactaacccaaatcataatcttggcaaatgatgtcatcatcatatacataatgcacagcatataccatatgatataagaacagtacactaatgtctttatttattcaaaggatgcaatttagccttttttttttaagacaaataacattatttagtttctttctccatgagaatataagaagaaatttatctcgatctcaatatcaagaaaagttgcactttcctttcattttgagttttctttatgctcattgagaattttgtacttgatcacatctcccttttcataggagctgctagaaagtttggggctaaaattattgcttatttcaggcaagtgtgtaga

SEQ ID NO: 26 - DNA, 166004 bp, Artificial Sequence
  Synthetic BAC sequence
gcttgtctctctctcttttttttttttaacagcattgactttgtatctttgtcaaaatagttgtacacatatgtgtggactcatttgtgtggacacatatgtgtggactcatttgtgtggacacatatgtgtggactcatttgtgtggacacatatgtgtggactcatttgtgtggacacatatgtgtggactcatttgtgtggacacatatgtgtggactcatttgtgtggacacatatgtgtggactcatttgtgtggacacatatgtgtggactcatttctggacccactgctcagttccattgttctattagtctgtctttttttttcactttttttttattttttacatatatatatatttttattatactttaagttctagggtacatgttcacaatgtgtaggcttgttacatatgtatacatgtgccatgttggtatgctgcacccattaactcgtcatttacattaggtatatctcctaatgctctcccttccccctcccccccaccccacaacaggcccgggtgtgtgatgttccccttcctgtgtccaggtgttctcattgttcaaagtaaactagttcaaccattgtggaagacagtgtggtgattcctcagggatctagaactagaaataccatttgacccagctatcccattactgggtatatacccaaaggaatataaatcatgctgctataaagacacatgcacacgtatgtttattgtggcactattgatctgtctttatgctgatgccgcactataacagctgttgataccagattgtgagacccctccaacctttttcttctttttcggagttgcttggcctttgcattttcatatgaatcttagagcttgtcagtttccacagtgaagacttttgtaatttggattgagattgcatttcatctgtagatcagtttaaggagaattgacgtcttaacattaatgaatctcctggtctatgagaaaggtatatctttcatttatttaaatttttttaactcctctaggtaatattttgcagttttcagtgaatataccttttgcatttctgtcaaatttattcctaagttcttcatattttgtatgccattgtaaatgttgttatttcaatttctgagcgttgattgctaatatttttccatttcatctaagttgttgaacccattggcataaagtcatttataatattcccctattatccctttaatatctgtggaatgtgtggttgggtcacttgcttctgatatttggaacttaggtctcttttttccctctctccttctcttcctccctccctcctgcccgatcactctggctagaagcttatcaatttgactgagcctcccaaaaaactaatttttactttcattggttttctctttttttctgtttcctatttcattgatttctgttttgatcttcattctttctcttttacttgggtttaatttgctcttctttcctcagtttcttaaggtaaaacttgaagccgttgctttgagacacttcttcttttacaatatagcagctagtgctatacttttttctttaatgaccagtttatcagcatcccacaaatttgcatgtgctgtgttgttacttttattcagttcaacaaattttctaatttgccttttgattttgtctttgatccatgagttatttagaagtctgttatttggcctattatttagttcttaatatttgggaattttccagagatatttttgttattgattcctaattctattctgttatggccaggtaatacatttggcatcacttgaattctgctgaatttagtaagacttattttatggcccagaatatgatctatctttataaatgccccacctgcacttgagaggagagtgtagtctgccgtcgttgggtggaatggcctataaatgtcaattggatcaaatttcttcacagcgctgtctacgtctactcaatccttactgagtttttctgcctgctcgttctcatagttatggagagggggtattgaaatctctgactgtaattatggttttgcttacttcttgcaatctcatcatgcatttggaagctatatgattaggtgcctaaatgtttaggatgcttatttcctcttgaagaattgacctctttatcattataaaatagccttcattatccttataatattctttcctccaaaacctcctttatctgaaatcaggatagtcactccagctttctttagacaagcattagcatgttgtaacttttttcattctttttcttttggcctatttgtgtctgtatatttaatgtaggcagcacacagtcaggccttgctttttaaacccaatttgacattttctacttgtaatgaggtttagaccatttgtatttcatgtgattattgatgtcattaggcttgaatcttctatcatcttcctatttgttttctatttgccacacttattctttattatttttcttctctgtcttcttctgaattgattgattttttttctcttttgagacagagtctcactctgtcacccaggctggagcgcagcagtgcgatctcagctcactgcagcctcaacctcccaggctcaagtgatccttcaacctcagcctcctgagtagcgggaactacagacacacgccactatgccatggctaattttttgtatttttggtagaaacagagtttcaccacgttgccctggctagtctcaaacttctgagttcaagggatacacccccccctcagcctcccaaagttctgggattacaggtgtgagccgctgcacccagcctgaatatttgtcatgatttcattttatctcttttgttgactttgtagctataacttcttgtttattttgttagtccctttagtatacattttaagcatcactctctacaatgtctcaccacgttacttatagggaagcaccttgcactcggacccttccacttcccctcagtcgttacgcagttcttgtcaagcattttacttttacgtatgttaaaaatctcataacacaccgttattattttttctagtctattaccttttaaagtgatttaaattatttttattgtttaaaaaaatttttgtgggtacacagtaggtatctatatttataaagtacatgagatgttttgatacaggcatgcaatgtgaaataagcacaacatggagaatggggtatccattccctcaggcatttatcctttgagttgcaaataatccaattacattctttattttaaaatatgtaattaagctattattgactatagtcaccctgttgtgctatcaaatagtaggtcttagtcattctctctatttttagtactcattaaccaccatccccaccttctcccaaccccgcttttaaagagttttcctttctttctttctttctttctcttttttttttttgagacggagtcttgctctgtcacccagactggagtgcagtggcgcgatctcggctcactgcaagctccgcctcccgggttcacgccattctcctgcctcagcctcccgagtagctgtgactatgggcacccgccaccacgcacggctaattttttgtacttttagtagagatgggtttcaccgtgctagccaggatggtctctatctcctgacctcgtgatccgcctgcctcggcctccaaagtgctgggattacaggcgtgagccaccgcgcccggccaaagagtttttttttttttttttttaacttttaagttcaggggaacatgtgcacgatgtgcaggtttgttacatacctaagtgtgtgtcatgggggtttgttgtacagattatttcatcacccaggtactaagcctagtatccattagttatttttccggatcctctcccttctcccaccctccacccttcaataagccccagtgtgcattgttccccatatctccacgtgttctcatcatgtagtttccacttataagtgagaacatgcggtatttggttttctgttcctgctttagtttgggaaggattatggcctccagttccattcatgtctctgcaaaggacatgaccccattccttttttttttttttaacatatctttttcattaatgagtaaattaaacagacgaaaaaagtcagtgaggatatagaaaatctacacaacgtcattaacaaatggacttaaacagaagacaaaaccctacactcacagcagcaacaatacatgcattattcaagcacacacagtatatttgtacaacttgatcagagacggagccattaagaaaatctccacacagtttaagggatttatagcacaaaaagtatgttttctgatcactttgttgctaagatggagatctgaaacaaaaatattattgaactcttgaaaggttgaaaattaagaagtcacttctaaatagtccagacctcattcctttttatggctgcagagtattccatggtgtatatataccacattttctttatctagtctgtctttttttttttttttttttttgagatggagtttacttcttgttgcctaggctagagtgcaatggtgcaatctggctcactgcaacttctgcctcccgggttcaagcgattctcctgcctcagcctcccaagtagctaggaccacaggtgcacaccaccacacctggctaattttgtatttttagtagagacggggtttcgctatgctggtcaggctggtctcgaagtcctggcttcacatgatccacccacctcggcctcccaaactgctgcgattacaggcatgagccaccgcgcccagcctatccagtctatcattgatgggcatttaggttgattccatgtccttgctattgtatagtgctgcaatggcgtgcatgtgtctttatgatagaatgacttatattcctctaggtatatacccagtaaaaggattgctgggttgaatggtagttctgtctctaggtgtctgaggagttaccatatcgtcttccacgatggctgaactaatttacacttccaccaacaagagaaaagcgttctttcttttccacaacctccccagcatctgttttttgactttttagtaataggcattctgactggtgtgagatggtatatccttgtgggttgttttgttttgttttgttttttgagacagagtctcgctctgttgcccaggctggagtgcagtggtgcgatcttggctcactgcaagctccgactcccgggttcaagcaattctcctgcctcagcctcctgagtagctgagattacaggcatgcgccacgacacctggctaatttttgtatttttagcagagacagggtttcaccacgttggttaggccgctctcaaactcctgacctcaagtgatccgcccacctcggcctcccaaagtgctgggattacaggcgagagccaccgcgcctggcctccttgtggttttgatttgcatctccaaagaaatttaaatgattttaaaatctcacgtgtttgcccatgtagttaccatttccagtagaatgtagatttctgtctgatttcacgccgcttcagcctgagtgaatttcttgaacgtcattcacggcacggttctgccggcgatggagcttcagcttttatatctccaaaatgttcttatttaaatttcgtttgtgaaggatgttttacccaggcatagcattctgatgctgatgggttctttttgtttcagcaatttaaaggtcttgctttcccgtcttcttgcattgcgtcttgtgggaaatctgcggccatccgttcctctgcacgtaccgtgttccttttgcctctagttgcttttaagattctcattttatcactagtttaaacaatttgattatgatgtaccttggcttggttttagtcctgtttcctgccctagggagtcattgagtttcttggtttatagttttcattaagtttggaaatgtttcagtcattatttcttcaaacatttttctttctccctcctgccccaaacatacacacatctctccttcaaggaagccaattatccatatattgggccacctggagttacaccagaactcatcgatgcagttaaaaacatttcttttgtctctctgtattttattttgaatggtttccatttctatgtcttcaaattcagtattcttttcttttgctgttaatctcatccagtgtattttttcatctcaggcatggtagtttttactttagaagttgtatttgagtcttttaaactatacttcatgtctttaacttcttgcagctgtggaacacagttaggaagctgtttcaatgtctttttctgataattttgtgtccgtctgcatcagtttcagttggctgatcttcctcattgtggggcatattttcctgccttttcgtgtgcttagtcatctttgattggttgttgtgcattgtgaattgtacctttttgggtgttcagcattttgtactcttatacattttgtttggactttgtcctgggctgcatgcagttcagttacttggaagcaggttgattctttcaggctttactttatgatttgtttgatgaccccaggcaggcacactcagggacggtgagagaatggagacggttgaacacactctgcgcagcagcctgctgcaccttcctgggaggggcatcccatcccaacatacaccggggtgggaactgggaggaggccagtgtttcagcgacactcacggcgagagtgagtccactccagggtgcaccaagaaaatgcacaagtgagcctgtagcccaggagaggcctgacctgaggaggggaggctggagaggtgggcaaccccaggagaacacagagcaggggccgctgcctcctcagtcggcactgctcagaaagcgcacgcagtggtaggaaagcgtccaccagactgagcaggaggcggagtgcagagactgaatgagcctgtaccataccatccaacacacccatgcacacacacacacacatatcacaccaccacacacacatcacacacgctcacatcacacacacatatactcacacacatcacacccatgcacacacacactcacacagatcacacccacacacacacacacgcagactcaaatcacacactcacacccaggggagaaagaacagaccttggaaccatgttgatcaggagcccgggaggaggcaagcctgccttggccttggggaggactgacacatggtctgccagtcagaggtgctcccaccgtgaccacctggaacctttccattcagtgaacgctccaggagggcgtcagggtctcgaggacacagctgaatgagtgggccgcgtcttcaaggcctggcaggggaagctgagcagcctgcaccccagatgcattgtgatggaagcttctgtgggccatgggcaagaagtaactgggagtgggaaggccctgtcacgacaccaggaggggcctggcctagaccaggcagtgggtggagcgggcagctgtgccggcctctgtgcctctggtccggggcagtccatgtaatttcatccaggggctctagaaatctcatgaagggttcagacaatgacaggatggccagaggggatcgggggtggcagtggggtggggaggcccagagacccaaggatgatgagatccagcccccgggcgtggtcagtgtggcagggcagggtgtgtggctgctgggtgacagaagggctcgaggctggtcgcctggagggcgttttgaagccagggtggacgctgatccatcctgagaccaggaatccagggcatgggagagacgacgcctgggtttggggcacctgaagggtaaccaaacacgtatcgtggccgagacttaggagtgaccatctggggtgatttccaagggctggggggcagaagccactatcgggggggacctggcagcccctcacccacactgacccaggctccagttgcttcttgagttcctatggcctcggagcaggacaccccacaccctgtgctcaccacaaagaagccaggatttgagggactggtggaagctacccagagactttgggtctccagggactgtaatgagagacacagctgtggcaaggtccagcctcctcctgactgggcccagccacccatgcagtgcacggatcagggctcagcagggccctgtgtgtgatggggagagccagactctgcaccagctccgggagcccacaagccaggggtccaggtgtgcctcccaagccaggcatcctgagcctttctgtgggacagtcctcatgccaggggactcagcaggtggacgggaaggcccttagcctcatttactcattgaacagacctgcgtggcgtctccggcacaggcggcctctcctcctccacttccactccaaggcccactgggactgcactggcaggcagtggcagatgaggaatgccaggggcggggtggcaggcgaggggtagggtcaggaaaggcctcacagagaaggtgacacctgagcatggacaaaaggaggtaaggacaagccctgcagtacctttccggaggttctgtgttcccctcgaacagggacaagcggccagtgcacatacaagagccacggggctggctacttaccgaggaatgcacgtcagaaccagtaggacagctgccatcccaaagccagaccacggcaagcgctgggcgtgggggagtcggagctgcctgtgctgctggggatgggccgtggtgccaacgctatggggccgtgggctcctcacacatgtaaacctacggttgccattccacccatcaagcccgctcctgggaatgtgcctacaggaaatgaaaccctaagtccacacgcaaatgcgtgcatgaacactcatagcactccatctcctttggccaaaaagggccaacagcccaaatgtctaccatctgatgacaggattaagcaaatggggtccatccatacaatggaacatgactcagccatgaaaaggaaggggatatggtttggatctgtgtccccacccaaatctcatgttgaattgtaacccccagtgttggaggtggggtctggtgggaggtgatttgatcacgggggtggatttctcatgaatggcttagcaccatcctcttggtgctgtctttgcaatactgagtgagttctccccagatccggttgtttaaaagtgtgtggcacctcccctgctgtgtctctctgattccgccatgtgagacaccagcttccccatcaccttctcaccttcctgaggcctccacggaagccgagtggatgcctggcgccatgttcccatacagcctgcggaactatgagccaattaaaccccctttttctaaattacccagtctcaggtatttctttatagcagtgcgagaatggagtaacacagagggaaattctggcacatgcgacaatgtggaggagccttgaagacactacgctcagtgaaagaagccagtccccggccaggcgcggcggctcatgcctgtcatcccagcactttgggaggctgaggtgagtggatcatctgaggtcaggagttcaagaccatcctggccaacatggtgaaaccttgtctctactaaaagtacaaaaattagctgggcgtggtggtgggcgcctgtagtcccagctacttgggaggctgaggcaggagaattgcttgaatccaggaggcggaggttgcagtgagccaagattgcgcctctgcactccagcctgggcttcagagagagactctgtctcaaaataaataaatacaaataaaaaagaaagaaaccagtcaccaaaggacaaacgccatgattccactcacacgagctttctagagtggtcaaagtcatagagacagaaagcgccaggggtaccaggggctaggggagggaatgcggagtcggtgttcgatgggggtgggggttcagtgtgggaaggtgagaaagttctggagatggatgccggtgacatctgcacgacgtcgtgaatgtacatagtgccacagaacagtgcacttaaacacggtgaagatgatcgaattcacagtgtgtctattttgccacaataaataaaggaatccatattttcctatctatttttagactatcatgtggggatttggcagtgatcaggttactcgatttggtgcagttagaaaagttcgtcactgtttaagcaaataggaaagccgtttatcctgcctagctgtgagaaaatcccctagcgtctttgaaactcttcgggagcgcccccctcccacacgcctccttcaggctccacccagtgccgggcatttgattctgctgcttcgtgcacaccagaccggcactgggcaccgggccgtcatctgcttctgttaataaagttttattgacactctgcccccatcatttttatgtatggcctaaggttgcttccaatggtggaactgagtcattacaacagagacctggagaccacaaaccctaaaataccacgtcagatccgcatgtggaacaccctattgccaaatatctgcttggagctgtgtacatttttcctcgatcccacgactaaaaccaattgtaataaaacacgataaaattaattttgaaaatccaaatgcttgatctaaaaaaaaatgtggccccaggatgtgggcctttgagcagaaagcctggccgcgcaaggaggggctgtggaggtgagggcagggctggtgggctagggctgagcggtttctggagtcccaggaggcctcaggagatgtggggagctgggcagtcggcccggagggcagggcagggaccacccagacatggaaggtgtggaggccagctctgaaaatggggtgggacagaaagggaagaaaggggcatgagccagcagccgggcagtcagagccaggggcccagggagcagtgtggtttgggtaacgggtgtttgcctgcatcaggcactgccctgtctggggaaaaacagagccaagaaaggactcgtgggtttggccacctagaggccaccagaggccttgaagagagctgctttggggaggtgggacagtcccgtggatgtggttcagaggaggtaggagaggagcacagcccagagcagaagcgctcgtcttcggagccagcaggtggaattaatggccgcaaaggtgtctgatcctcatctctgaatgtgacctaatgaggaagaagggtctgtgcaggtgtgaggaggtgaacggctttgagatggcaatccggtcctggaccatctgaacaccataaacgccaacacaaggtggttataagagggaggcagctggagatttgatgacagaggggcggaggaggcagtgtgaagacagaggcagagatgagaggaacgggaccacatagcatggaaccgcgggagcccccaggagctgagagatgcaggaagggttccgcctagagcctcagagagagctggccttagacacggtgaggtcttaagagagggtgtggtcttagagggggtgtggcctctagtgagggtgtggccttagagagggtgtggtttctagtgagggtgtggccttagagagggtgtggcctctagagaggctgtggcctctgtgccagcagattcactgctagagtgaatagatgggtgtataggatcctcatgtccccagctgacagttcaggccctcagatctgggaatcaaattaaagagtgttctgagtccagggtcccgaggaatgctaccacccgatgaggggcgagtgtaagggcagaggtgggttgggtcctggaagctgggcagtgactcatctggagcccccctaggcctggccagctgggcctgccaccctcatgccccaccctccaacacccccgatgctgctgctcagggccacctggaagctgagccccatctggctcctaaagtcagcatgaagaccccgaggccaccaagcatgccaaaaataattcagctaggggaggaaggtgaggggctaagttctaaatagggcacagccacaagcagcacaagcctcactgccctctgccccttgttgatgctgggccaacagaccctgtcgtaaggatgcctggtcctggactccctacccccgcatggcagggccaggcagacctgtggccagcagctgcctgagtttaaagggggctccagtcctcataaaggccatggggagggcgggcatggggtctgctcagcaggtaccccctgtcctgctggccacctggtagcctcctgacccctggcccctctcggctcacccaggagccaccacgccctacccactggattaactgggctttgcacatcatttccaaaagacactgggccacaaaactcccattcagccttgtgacgttatcggctctctgaccccagcctgcttcccggccccccggccccctccacaggcctgctcatctggctatgcagcctccaacatctggactgatgaaaagccaccgccactgccatccccacaggcaagtgcgcacagaggcaagcgggccgtgtctatgcgcacacttgtatgtccagggcttggctgtccagggctgagggcaggacaagagccacagcagctttgaagacatcggattctggggctgggctcagagtggccgccaccttgcagggtcccaccaagaccactgcagcctggaatttcctgctgacactggacgtaggaggcctggagggcctgcaggggtcagccagcgcctccaggaccctcactcaaaccttgtcccacgccttaccaccttgcacctggtcttcccacaccaggaaaagcccctcccatcctccagaccccaaaactctcaggcggcccccacactcttggaagcccatgacttgtcatatcttctggggagttttgggccccagtacagcccacagcacaacctcctgaggggcttggtttatttatatttttactgtaatgacttacttgaaattttgcttatttattatctttttatctctgacaccctgaggggcttgggaagggtgaacggagtgacactctggagggggccacaggctaacctgcaggcctcacatgtgggtggaggtggaagaaggggcttggattctgggtcctggctgcacagccccggtcggaggcctgtggggctgggggctggggagctggcccccaggctgtaattaccaggctcacctccacctgaagtggggtgtggtggcctcagccccaaattacagagcacagctgcatggtacagtgcgggcaggaaaacagggcctgctcctgtccggctcccaagcccttttcccagctggcttcgcctctgctgagcctggccaccccagaaccagcaggtgggctccagggaagccctgcagccaggccagccctgcccactcttgtgtccatgctctgacagcagccagaggggccctggcaaaggatgagcaagggctggagccccctctgctcccaccccacactctcatctcacccaggagtcctctgcatctgcgtcccctgtgggtgcaacacaggaccacaaactcggtggtttaaagcaacagaaatgggttctgtcccaattctggggggccagaatttagaaatgcaggtgtcagcagggctgggcttcctccaggagctacgggagggtccctcctgcctcttcccgcttccaggggctgctggagctcctgggcctgcgggtacatcactcgcctgtctctgccatcacagctggcactccacacccttactttgttcattcctgtcagcccacgggaatgtggacctcaagacaggagagccgggatctctgtcctctccctgctgcaccccagccaccagcatggctgcagagcccaagacagcagacggaggaggtagtgcggtgtgcgcctttggggccggtggctcgggaagggcaggcagagccctctacgggggactatgtcctttgtggatgggcagaacagtgcacagtgggagtgccttgcactaacagattggaaactgaggcacagaggggaaaagcgtccctggtcctccggcctggtggagcatgagaatctggcgcaactggctttgctgtggactgactagtggatgctctcaggcccagggtccggggtctgtgcctgccaagcacccaggtgatacgtgggatggttactgagagctgccagggctccaccgtgtgctgggtatgctgccaggggtccacacatgaggcccttcaccctcctagcaactatgagatgctcatcatttagaaggggaaactgaggctcatgttggagtattgaggaacgccttccagcaccactgtgcaagcggtaggcctgcctggggcagtggggagacagttcccggagggcagcagaagcagcaagcgcccagagtctggcccatgccaagccttggggcccctggaagaccagcctgatggcagaggctgaggcttccccgtgggctccaggggaggtgggaggccaggctggctttgacaagcccccactgtctccttccagcagccccagccggtcccagcccctgccttggggcttctcagcctaggactggctcatccccgcttgctgcccacatcagccccatctagtccctcctgcaagcccccgctccatcaaccctctttcctacaccccaaccattgcctggggtcctgccttccagctccatgctgactgcacaccctgagccctcgccagctgcccagggagctcctggggccagtgcaaagctatccatcccctctgcagccaccctggccctaagcaagcaagagctcccagccatgactggacaaggtcctgggtgaaggaacaaacaagggaagcttctggggaggctggggaggctcctggtcagcaggaggctgccaggtgcgggtagtaactgactcacccggtaagtcttctgaggaggcccgggccagtggaactcccaaccaggtccccggggaggaggctgcctggcaggctggatgggagccgaggccagagtgtgcctggagcagcccctggctcagccaggcagcagcttggggcctcgccaggtggtggctgccagcctccctgtgagagccgccgcctgtggtttgaggctttctggctcccaggctggcttcctgcccagtgggtggtgaggctgtgattgcagcacgtcccacctggcccctcctggggctgggccctgcaccagctcctgcctttaccggctgggtgatgaggaaagggggctgaaccccagcccagtcccctgacctgctgatgacagacccacctcgggtgggggctaaggaggtgctgtgtgggaggggcctagcatggtgcctactgaatcagatgccccgagatggactgaaaccacggaggagggaaaaaaatgagcccctgggaaggtctggaagttgtgtggaagaactgacatttgagctgggtacggaaatgcagcagggaggaaaggaggtggcgctcctcaccgagaagccagcccagctaaggcaaggtgtggccaggcgctacactttccagcatggcaggagcctgggtgtgtggatgtcagaggagagggccacgggagcaggcaggatggcgaggacccagagaaccaggccacagagcttggactgggaccaaaggtgctggggaaccctggggggtttggaacagagcagcgccccactcgccagcctggccatgaccaaacaatcagcaggaccccccatgcactcacccaagaggagcttcctgctggccacagtgacaagaattgcactcacccaagaagagggccctgccggccacagcgatgagactctgtctccaaaagctggcagtgccccatggactggcatgtggcttcacaagagagatgggggctctcagggaggtcatgtggcagagaggggaaggcagggtatgggcaaaaggcagagacaggaacatgcaggacgagtgcccaggacaaggaggaacccccggaccagaagcctgacttggccagggcctgaatgtcaggaatcgtcatcatggcctgacacgccgctggctgtagactcgtggagtccttgtggcacctggcccagaaagcttcccacgcacagcccagggcactctcctgggattatggtaagtgtctgtggcctctcaaagcctagtccccgagctgccaggcatggaggagggtggcagtggtgccccaggccagcctggatgctgggcggcacagccctgagctggatggcccgggaggctaaggccagctctgcccaggagaccccagcagctactggctccatgccaacatttgcgtgagggtcccgggggaaagctgggtgccatcgctagctaaaaactgctggcaaacaaaacggagggtttggttgtgcaatggaaaggtgaaaccgcaaaggagcccgtgtaacacttcccggggttcctgggctcttctgagactggcttggggctttgggtttggccgagggtgtaagatcccgggagcaggaggcaaggactagaggggtatgtgcacgccccagggcttggtcacaggcacggtccctgcgaacatgccatctgcacaggctgggatactccaggcccacctgtgccctggggcccctgggtggatggacatccccagaaggacgtggtccctaatcctgcctggtcagctcatcctgggaccccagggaccagaccagagcatgtcactaagtaggggacccccatcaggtggaggcggagcctctctattcctgccgctgtccctccccaggctcgaccccagggcctggtggcctaaagacaggccagaatggagctggagtcccactggacactgtacagagtggaaaactgaagcccgggagcagcttcccagggctccatgcccagcccctccccagggcccaggcacacagggatactccgtgcacccagggacaggtttccagtagggccgtctgtccaggccacctgggcacatactgggtcccccttccttgttcccagagtttcagaggtgcagccaggttgggacaggaaaaagcctgggggccaaagggccgcttggaccccactgtgccccgtgtggacaccacgtcaccctgtgggaggccaaggcccacctcaacctccctctccagcctctgtccccagcagcccatgctttctcatcccacaaggacccctcgcccaggcccgactggtcatccccagtgggatatggcacaactttgggggagcagccttggggttgtagcgttgggggtggaggggtaggtctaaggcacctaccccttaggtaggtaggagatgaccatgactgatggtcatccccatagaaccaccccaacacgctcttacacctcccagctcaacaaagaccttccagagccttctctggccagcccaggccagacaccaagaatgcagcggtcaataggacctgccctcaccaagtgcacacctatccgtgggtcctcactggccaagagctccttcctctcctcacccccatttctcatctcaccagccctgccccagctccctgcaggccctcgccctgcccacccctcttgtcccgacgggtctcagagtcctggccaccagaacccaaagatgtcaagacttccctctaacgaacctgatgtcttggattccttctagagaaggccaggtctcagccaacagcccagcggctccccaaggcttccatgtttctcctgacagcaagctcatccctccacagcacaacacttttcaaaggtgctggtggttagaaagttccaccttccagacccctcctcacaaaagcatctcccaggccccacaggtccggttactgggggaagtggcagcaccgattttgaaatccttttgaaaatgtttttcctttgttttgttttatttagaaatttcccaaatttttaccaagttaaagagacaaccacaagaatgtgtagccagggtgaacaattggcataaacaacccctcccccactgcccagcctccccccaaaccacggccccccaactcagcagcaaaaaatgccagacatgtataagaaaatagaagccgtgaggatagagctgggtgaggagcacaggccccatgcctgggctgcagcgtgcacacagggaccacgcacgtgcacccatgtacacacgcacctgcacacatgcacatacatgcttgcacatacgtacgcacgccagcatgcacatcacacacagggcctcagggtaaccttttccccagtcccggctgtgatattgcgaaaggagctcagggtggggggcgggctgctgggtccaggcccccaccgtcctgcctagcagtcatttggtttctctttgcctcagtttccctttctctgcccctcacacctcccaaagtcctttggagaatccgtgagatgggggggtgacaggccctgtatgtcagcacacacagccacgtgatgtgggaccccagcccgtgtcccgcagaggcccttgcagctggggacccagggcctgctccagggcacagtgggtcccctttggccatagcaaccctgccctggcctgccttagacctacccctgcaaccccaaggctacaaccccaaggctgcacccccaaagttgtgccacccaaggctgtaccagaggctgaacccccaaggcagcatgcccctcaagtctgtgcccccaggctgtctgccccacagcatccccagctcctccctagaccccttccatacccctccgtgaactgcccactccacaggaagctgccctgctcacgggcactgacagtcttcactgcctggggttctcccctggagaggcagattccttggcccagaatacgcagctttaagaaaccaagttgggatccgaatgcagggacttcctgctccaactgctggcccgagggcccgctctgaggctctgaggctcccagtctggggcacccgcacaccacggccctcccgcccacggtgaacgccccacccggccccaagaggcatcgggaggcgctgcttggcccagaggagaacagcactgatgcggaggcccagagagctggggaggccttgggggcgccaatgggagggtctaagagccccccgatctcccctcgggaagatgagctctggcactccacgaaggacaagctggtcttggggaatttcgctggcacagagacaggaaggagaggatcttggccttctaaaatgtttactacatcaggaaacgaacgcactacgcgcgggctcagtgatgaagaataaacacacacactcactcaggacacattgagtgcaggcccagccccgggcttcccgctgcgggggaggctgggagggttcaggcatgccgcagccacagaccatgagcttgggggtcaggcgggcgggggccaagggcagggccacgtcccagccctccccacccaggtccgggcgcctgcccgcccgccctggctgctctgatctggctgtcacggttacacaaggccagcctccatttcttcattaatgcctcaccaaggggggccgctaacccgcagcctcaggaatgtgcctttacagagcagaggatgcagccgctgaagggccgggcaagctgcaccggccggggctggaggtcctggcctggactgctcccccggccctccccactctggcccgtgctggtccaggccagggcagaaggaggtcaacttgtgcaatgcctctctgggtgagctctgcaccgggagctggtgatggggacagaggaggccctggaagaggggacgtgagttgagagagcagcacaaacccaggacatgcctccagcatctctgcctcccttcgtccacagagactgctgcggggtcaggcagcacagcttcttgcctgagctctgtggcctcgggcaaggaaggtccaggagtcaggtgctggtctgcaacatgggatcatctcgctctccagaaaggctgccaggggatcttaggggaggccctcactctcgtctctcccctgtagtcctgacacctgccgacctcacacatgggccctctgggcgcctgccctcccccctcgtccttgcatgcatgctgttccagccttcggaaatgctgttccctggtgaccactcctactccagccccctgtgccagtgtcttccaaaattttccttcatttctgaaaccaaaggagtgtctagtccagaaaggtcccctggagaaagggaaatgctgaccaagaaggggcctccaagggccagcactggaggcccctttgccctcccacgcataccccaaaccaaggatgcaaaccaatcacctgcctgggcacagaaccccacatgtgctgccggaagtcgcagagcgtccccccggctccagcagggccctgggatacaggcccagatttgagaggcaggaaggcccttctgggctgggtgcaggacagggcctttctgatgaagtcagggcacctggggaacctgaaagctgaaaattcaccttcacagaggtggactaactgccacgcgggggtgggtgaccctgtacctcttgtggcaggcacacactgggggtccctggtggacggtgggcaggggcaacccaggaccacgggcatcttgccaaggactggggcaggaggcaggggcatcaggcctcctgggagcaaggcttccaggtccagcaccaagctcaggagcgtcctgcccagtcctcatgccccttggcgccaccagcacccctcctggatcctgcccctccacggccatcatgacagacgagcattcacattgggtcggaccccctgcagggacctccccatcctcccggttgggatgcctcctcctcaccccacgcggttggccccatcctgtctgcttcagagtcgctccccttctagagtgagctccttgcaggtaggagccttatccctgaatgccccttgacaaagagggtgcgtcacagcctcctgcccggacagagcacctggagtggagaccggaccgcagggcgtctgaacatggccagaaatgcgggtccagctggggtggggacttcctcctctctcctcgaggctgtggccaagcttatcctgaacccagaactcccaccagtctcagcccacatcccttatcactcccccttctttcctggtgcctgctgcctgcccccacccagctcctgcagccctgagtaggtgatatgccggtgcccctcccctgctgtctcctgtcctggctggtgctgggcacagcaggccagctctgctctttttgatatccccaggttctaagaagcggcttggctgaccccagcccaccctcctgagggtcaaagctggcccagacacgctacagtgcccagcacctgctccctgggaccctccccatggccccctcccaccagggctcattgggatcctcaggaactgctgtccccacttgtggcgtgtccccaggtcttggccctcagcagacagctcctcagcctgccgcttcccttgtgaagtgtacgtaagtgaaacatccctatgctggccctgccagctggcacagggcagactctgatgaagagcagcgcctgggtgccagggggccctcgtggccaggctgctgggctgggtgcacccacacactcctctgcctgctcacctgctggccacgcctctcactgcagccctggtggaggatgccaagcgggagccgcacccccgccttgcctgacaacagtacccgtcacccgctctcagccgcagctccagcagctgctcccctgccctccccggccagcggaggagactggagtgggctacaaggaaggcaggccccacactcttggccctgcgcccgagtgcccttgccaggccaagtcagaccacaggacaggccacagtggtagcagggcctggaggacaggctgcctgaggctggcctgggtgggggcggggcagagtgggggctgggctgtgtgtgccaggggccctgcatcctgtcctcctctttggagaagcccaggctcctccggcctctcttgcctctaaatcatctgcttttcagcctcactaattcgtgcagggttccttggctcatccacacatttattgggcacctactgactgcacaccctgctgggcttcaggtcctgtgtgccccagtaagaacagctcagttctggcacagatcttagggggcgcaaggcagagccgcccctggggcctgccccgcctaggcctgcagacgtgttttcctcagccccaccggagctcactgcgagggtagcttttcaccgagccaaggtggcccctgtgcccagacagcccagattacagtgggcatacgctggggcagacgccggcagggccgccttgttatctcagacgctgacgtcacctgtctgcgggaggtgcaggggggccacttcccggggccaggcaggaagcccgcccagtgcagagagggaggtgcccaggcccatctcaagcttgctgggcccaggggaccagagcccctgggttccctgatgcaaccaggccccactctgcaccccggggcctcctaggctggcctggccctgcccctccgtctgcccttccccagcccaaagcccgcaggacaagtggacagcccaggccggttgcagtcctgcatgctctgctgagctccctgagtccaggttttggggggcagtggctttgggccagggttcaggggtttatttcacaggtccttccaggtgccccacagttgctgagtgggagactggcactggggactggtgacaagagacctcccgggcaggcccctggcacgggctgaaggacggaagctggaggcagggagaagccaagggcattgggtttgcagactccatggggcaggacaggagggactggatgcctggggaggttggggcaggactgtacccaagacaggggatcaagcctagtacagagccgagcagcgggagggaccaccctgccaggccaagggaggaagacccggggcctccagacacagtgtaccagaggagaacccttcccatccagcatggccaagcgggacccgtgtggcacttgaagctgggtccctggactcaccaccttccctcactggacccctcggcagccatgcaggtggggctcactcccctttctactcgccaccctgcagaggaagcttcttctcggccagctggcccacctgtgcccctccctcaggaaccccacctggcccaccccacagctcctgtgtgttcccaggggcatctgatccttcagcctggcccctctttcctctccagccacctgtgctgccattccagtgacagccaggccaaactccctgctgggtccccaaatgtcagggcgtctctctcacctctgttccctcctcctggaatgcccttcctgctgcctcatggcacgcttctcttgggccgtttcacaggtgtcgcttggggcttgaggatttcaacctcatgggtttttagattagagttagaaagaggggagaccttcacctggaggcaatgattcaaagacaggcagattacttctctccatcgacccgcacaaccatcttggcagcccattttacagagaagcctagaccaaaggaatgaggtgtctttcaaaggccacacagagccaggagagactcttccccacactgacgtccactgggaccccagccttagtgctccctgtgtgtgtctgtcactgtcattgtggaaaataaaaggtcctgaaaggacagtctcaggtcctggtcctggtcttagatgtgacttatgatgacttcaaatccataagacacagatgcagtgggtaaattgaggcagcctcttgtttcttagccaaagaacttgttcaagaagttttcttagcaatgggcttccaattatcaaacctggatgatatagaattgtggtggaaagggtggtagataggtgggtggatagatgggtgggtgaattgatggatggatgggtgagcggatggatggatggatggatggatggataaatggatggatggatggatgatcgatggatgggtaggtgggtgaatggatggaggttggaatggatggatggatggatgagtgaatatgtaggtgagtggaaggatgtgtgggatggatgggtggatgagtggatgggaaggtggtgtgtgaatggatgaatggatggttgagatggatggatgattaggatggatggatggatggacggatgaaaggatgagtgggtagaggaaaggatgaatggatgggtgagtgggggatgtggagacatgaggatgaatgtagacgtatgaataagtaggtggatgaatgaagagcaggtgggtagatggaagggtggatgaacagttggatggaggaatgaatggatcctcaaatagcactttctttggctaaggtgttgtaaccttgaatcatggagaatgattgccaggcaccctccactctgtgagtctctggttctctgccatgacccccagggccatagagcagtgtggcttctcaatccccaaataaggtggacaaagtccgcactggcaggcccagggagcaggaagtccgggtggggtgggaggccctgctcccggagctgaagtcagttccttcttttctaaacaatgaggcctggcctgatctttgccgcacctccaccctgctccacccaagctccctccacatctgatggggctctggggccctcagagctggatgcagggagctgggggctggagcaggagggccaaaaagagcaggacccacatagtttgcaaaaggctcagtcgtggaaatgctgccttccctgcagccaaggctcctggagccagtttcccccaagcttctttctgtagggagataggagctgggggtttgttggccaagacatgactttggtttcttgttttcgtctttcttcttcaagtccatagttggaaggccctgcatccccttctctctcctgtgtcctcttccttatggtcatcctgctctgtccccccacttccctttccttgcccctctctctgacccaccatggccagtctggcagaggaggagactggaagagtagagtaggaaggaaaaccaagtctgcccttgccagggcacggaggaccagactttccaacccaaccgtggctcccagtttcagtgaccaagctggggctcttaggcctaagcaggggctctcctctgctccagctctgtctcctgcattggcaggagagagcctctcccacagagctgtccctggaacagaaggacaagctgaaaaccagagaatctccccctctcgtgctaagggtagccagagtgttccacggccctggagacaccatccaccaccctcccagtgggcttcctggaaacccagagatggctccaggggctctgccctcctgggaagccacttagagcccaaagagcgctttccacatggaaataaggggtctcttctgagggtaggggtgctgcagtacagagcaggggcagggccgggaactggggacacaggcctgtgtggactcaaaatgaacgagggccgtcctgtgcgtgctccactccaaatcccatctgctcccacactgctggcccagggaaaatctgggtagtgacagtggccgtccctcacgccctccatggccaggtgccagtagcgtgttccacaagcatcaccttcgaaaccctgaaggagtcaggactgtcgctgttccagacaaggagactgaggatgagtctccattaagtggctttcccgcagacacacagtaagtggcacaagagtcaggagtttgagcccgggtcagcccagctccagccatggtcgcaggggctgcctgcaacccctgacgaggggcaccccggggaggcctggacccagcacctgcagcccaacctgggcagaggctgatccagcagctaggaagggcatgggtccaggagatggcagagcagggaacagagcgctgccgctcagggtactcccggggagctgtggttctcagtggaggccgctcccacactgacactcaggcaccctttcacctgctgatgcccagacactgctgaggccaacacaacagacccacagcctgggtcagcacggacaagggtgcttcctggctcctcctgaccattgctgaatgaatgatgggtgaatgaatgaattaacaaatgatggctgactgatgaaaagcaagaacacagatggaaccagagcttctggggcgcggaggcaggggcacaaccccctcccgtgccggagtgcgcacacacacacacaggggtacacacatgcacgcacagacacacatgcatacacacacatgcccacacatgcaaacacacattcatatacacacacgcccacacacacaaacacacattcatatacacacatgcccacacatgcaaacacacattcatatacacacgcacgcccacacatgcaaacacacattcatatacacacacgcgcagcaggcctccttggtcaaggcctccagagctttgtccttcctcacggttccagtggcccagaagactcaccatgttgccttgccccagcccagggccccaagtgagtgtatcaggatccctgagcccgccccgaaatccccaggtttccaccgctcccagcaggaagccgtgcttcatgcatgaggcctccctcacctgttaatttccgctgatcctgccaacccccaggtgagggcagccatggggaccccagtggcccagagctgggcccaggaaagggaccaaaggcccagggggccttgctcctggagccaactccactcaatgccagggcacagagggaaaccaggcactgtggccaggcccctgggaagggtcatgggtgcatgctcagcaaccctcggccatcatgtggctgcaggcccagcctgttgctaggattagtcccggattagcccactgaggtcccagaggctcgagtgtcctggtcaccagtgctatagaaacctggccagaggcagggggtggagactggttcctccttggtgggctcttccctccaggcccagtctgagccttaccctttcctgagccagctctggagtgcctggggcctgagctcccacccccagccctgcgggagcccttctccacagagctctgcacctagggaagttgtagctttccagaatcagctgttttccagatcccggaatgaaaacggatgaccgatcatgttgtgcctgatgtggaaaagcgaagcgtttgttctctcccttctcagatgctccttaatacagaaaacgtcagagctggttcaccctgctgccccaggagcaccctggagcttccctccccaggcccagcccaagcaccgcctcctgagaactctcctcccctcactgacccctgtcccatctgtctctgccctgaaggaacaccaagttggggctgtggggctgggaccaggcctcggagccaggtagcagcccattgggggacagctcaagaggctccgagagctccctgtgacatctgagaggccagcaggacgaaggccacagccagcagccaggacctgaccacttgcccaggctggtctgagctcctggccaggggcctcttggcaacatgacctggcaggtgctgtctgtccattattcccctctcacggatgtccccggcctctgtggacatgaccgcctagccctgaaactccaaatgtacctttctgcctctcctcttctctgtcaggtgatgccatccttcccaggggccttctgggctcttcactcctctaggccctcagcaaaggctctcactctgccctcagcacacaccagggtgcaaccaccctcactcctccaccagtccctcccagtcactcccttctgtgtgtatcccagcaggtgcctccacttctcctcttgcactctggtcactcagcagccacaggatcccttcactcctaagcagagacctccactagccccacttctctccaagaaaaagctgcatccccttcagggcttcctgatgccttcctgggcaagctccccttggtttctcaggtgtgtttctcaacaacccatgcttcctccctatccaccactcctcagagacgccacatcacctctctacaagccttgtacccgctgctcctgccatgagatgctctcccccagatgtccatgtgagtatgtggtgggggctagaaaggtatgtagatgggtaaatggttggctgggtagatggctggatgcgtgggtggatgcatggatccatggaaggaaggaaggaaggaaggaagagagggagggagggcaagaggaaagaaggaaggaaggaaggaaagaaggaaggaagagaagaagggagggagggaggatgaatgggtgcacagatgggtgcatggatgggtgcatggatgggtgcatggatgggtggatgaacagatggatggatgaacagatggatggatggataagtggatgcatggattcatggaagtaaggaaggaaggaaggaaggaaggaaggaaggaaaggaagatggatggatgcatggatgggtgcatggatggatggatggatgcatgcatggatggaaggaaggatggatgggtggatggatacatgaacaaatgagtgggtggatggatggatggatgaatgggtgggtggatgcatggatgggtggatgcatggatggatggaagatagatatatggataaataagtgggtgtatgaataggtgggtgaatggacggatgaatagatgcatagatgggtggatgcatggatggatggatggatagatagatagatacatgggtgaatgagtggatgtatgaatgagtgggtgaatggatggatgaatagatgcatagaggggtggatacatggatgggtggatagatagataaatacatggatgaatgagtgggtgtatgaatgggtggatgcatgcatggatggatggatagatggatggataaatggatacatgtaggagtgagtgaatagatgcttggatggatggatggaagaaaggatggatggatagatgaatacatggataatgactgggtgtataaatggatgggtggatggtgggtggatgaatgaatggatagatgcctggataaatggatggatagatgcatggatggatgaatggatgggtggatgccctttctctgaatgccagccaggaacgtagccaagtggaaaggcccaggtgggcagctgtcttcccagaccactcacactgacctgagaacaactgctgggccccaggtgttgaaagggcaaaaagagatgtacccagctggactgtgcaggtgctggctgcccgttgttttgagccatgctctgatttgttcctctgtgcctgctctggggacttggccactctgagccatctgcaggcttccctggtgtcccctgtacccataccacaagccaagttcctccaatgtcacccttgattgctgtcccttgtgtgactcacactggtcctccctgtgtgatcataggctattcgcctctgccacacaccacactcatcacccaggctaatctgggtgggaggcagacttgtccagcgctcacagctgctgagcctcagagccaggccagacccaaggccaggactcctgagctcccctccaactctccgtccttacaagccttccttgcaccagccttgtcccctctggtctagttgcatctatttcacccctgccagaagacggtgttcgttgcctatggctgcagaataaattagtccaaaacttaaaacaataaagacttaaagtgatggatatttatcatctcagtttctgtgggtcaggagtacaggagcagcttagcctggtggttgtggcttggcttggctgccaccccctgacaccccaagccaagccaccagccctgggccccagccatctgaaggtcctgctggactgaagtgtccccttcatgcctggcaacctagtgtggctgtcggagggatgctcagtccttccacacaaacctctgaggtttgcgcatcctcacaacatggcagccagctttccccagagggagtgaagggagagaggtgggggaagaagaaggatgctgcagtgtcaattatgacctggcctcagaagtcacccgccgtcattcccactgttggttacacaaatccatcctgttaatgtgaggggggccgcacagtggccgaattcctggaagtgcagatctaggcccatggctaccatgacctgcagctgacatgctcttctttcttccacaaatgacatgaagtgagagaagcagtgggcaaggtagccccagactgaccatcttcttgtggttccattgccgacacctggtgacctggcccagccaacacctccagccccctcctccttccccacaataggctcagctcaggccaccctgagcgccaggggcaaggtgtgcctggagctcttcagtgagacagtgactgtttctggggtagccctggaccctgaacccctccagtgctgagatagacgaggggtccctccttactgtccccttccctggccccatgactctgcagattccccagccacagggcaggaagggtagagccagcgttttgggtgggatagggaagggcccggctgggaggcagaacagctggtggagggtgggggaggcatcctgaggccctgggggacaccagggcaccgactgtacgttgttctccatccccagcctgggccaagagggcaacccagggagcccaggaccttgtccagcagctgaggcctctgaggggagagtgccagaaagagtgggggtgccagggctctgtcccccatctttcctggcttgggtttctgggagagggggcgggtgttgactcccggaggggctgccctggaagtcaggtggcctggcggttcccagacctgccagcccttgctgagggagcctgcaggctcttctccttcccaggcctccccggcatctgagaaccttctccccagcactgacccatggctgggagagggtcagggccctcagggagcccggctgagccagcacgggacgcaggggtcggctccttcagacccccccactttcgggcagcggtgcccacgcccagctgggcagggccgagtccatgagacccactgccctccccgggagctcccggccagccgcccactgcagcagcccgtgtaaaagtaacgcctgttatgccaggaacgtcacagggccctggggctgcagacaagctgggtctttttttttttttattattaaaaagcaaaacctaaaccaagaaaacaaagtgattaagtttctcctcagaacagcaggccccacagaaacgaggagcgaccgtcccactgggtgcttggaccctcacccaccactcgggaaaacagccgaattcttcacacaaacaggaagcagctggtcttccctgaacatgaggggagggctggggcctcagcatgcgggctgcctagaaggtggcgctgcagccaggccctcggctgggctgggcagtcccagccctccaggaaacggccaggctgcaactcccccgccaggaacccctgggcttcgcgcttgaccagtggagccgtgcaggtcagaggagggtgggctcccagcacacacccttctctgccacggtgggctcagctgctccacccaggctgccaagacccagcccagagcacacaaactagctgggcttctcatggggtacaatgggagtgggcaggagctggcagccatgctgggcaggtcaagggccttcaaagggctgccacagcccagctggggcgctgaggcctgcagaagctcactctggtggcattgagttggggaaggggtctctgtgagccaggttcagaaaggaagatgtgaggcaagttttaaagaaatgttttaaaatagaaggggcttaaagcagaaaagtttagcctgccagaagttagaacatgttctagagtaacaataattaaaacctcacggtactgatgcaaagatggagatataggctggggaggagaagtggaagtctggaagtggaaccagcaacctacacaaagaacattaaaactccagaaaaaaagaacgctacaatttaaaaccacagcgtaggatctcagaagcccttccagcagaggagcacagaggagctgcctcaggcattgtcttgagataatgtgttagtaatttgtaataaaattcaatcaaagagaacacttacatccacataaaaacctgctcacaagtatttatagcagttttattcataatcaccaaaaacttggaagcaactgagatctttcagtgcgtgagtgggtaaacacacagcggtacctctatgccgaggaatgttattcggtgctaaaaagaagttagctgtgagccgcaagaagacatggaggagcaccaaatgcatgatactaagtgagagaagccactctgcaaaggctacgcccgtaggattccacctctatgacgtcctcgaaaaggcaaagctatggagacagtgaaaagaccggtggctgccagcgtttgcaggaagagagggaggaagaggtgcagaaccatgactgtgggggcagtgaaactactctgtctgatagtctgatggtggatatagggcatgataacttgcgtccaaactcatagaatgcacaacccctagagtgagcctggacctcagtgtgtgctggtgctggctggtcaattctaagagaaggcccacatattgcaacatgtgaataacaggggaaactgtggtggacgcatgaggcaggaggtccatgggaactcactgtgctttccatgtgatttttctgtagtcctaacccagttttactcttgtccaaggaccgtctgtccatcactttttaatgccactctcagcagctccctttgtggagaacaaacccgagccaggctgtttacacgcgcatccggtgggagccccgtgctcaggtgctcgcttttgcacagggggacactgaggaacagaaaagcgaggcaacactccaggatttgaaacagtcaaaacacttgcccctctgctaattataagcacagctactggcccctaagcctgggctcttcgacctcggttctcaaatgttccggcctcagggcctcttgcattccccaaagttatgaacaagtccttaaagagagtgggttgatacggggtcacccctgctgatatttactgtcttagaagttacaactaagacattgaaatatttcaatatttaaaatattagaaattttaaaaataggttaaatgaattaatttaaaagtcacaacagaggctgggcatggtggctcatgcctgtaattccagcactttgggaggccaaggcgggaggatcacttgagcccaggagttcaagaccagcctgggctatgttgctatgttacccaggctggtcttgaactcatgggctcaagtgatcctcccaccttggcctcccaaagtgctggaattacaaggaggagtaatcaaaaagaaaatctacaagcacataaggccattaaaatatccttaattaaaaaaaaaagccaggtatagtggcacacaccagctactcgggaggctgaggcagaaggatcacttgggcctggaaggtcgaggctgcagtgagcctggattgtgccactgcactccggcctgggccacagagcaagaccctgactcaaaaccatatgaaacaaatgaacacaaaacagtaaaatcacaacagcaataataaactcactactacacattaacataaaatatttgtttacaaaagacaactaggcttttcaaaacaaagcaagttccgtgagaagagtgagatgtctttgcactttgcgaatctctgtggcttgctggaaggcagcggattcccatcacgcctctgcaggctttggccagcgcatgggaagaatgtagatgaggacatctacgaacatacgtggttgggagtggggggtggggggcgctggtactttaatggccttatgcgcttgtagattttctttttgctactacaccaaaacttgacaagtgtcatttcttcaagcttagctgcaatgcagaatctgaaacccatgacctttagagactccgtgatgttacagtccctcagtttaggaaacgacagaggcatcataaccaaatgcaccggggctgggcgtggtagtgcacgcctggaatcccagcactttgggaggccgaggcaggcagatcacctgaggtcaggagttcgagaccagcctggccaacatagtgaaaccctgtctctactaaaaatatgaaaattagctggacatggaggcaggcacctgtaatcccagttactaaggaggctgaggcaggagaatcacttgaacctgggaggtggaggttgcagtcagccaagattgcaccactatactccagcctgggcgacaagagtgaaactccatctcaatgtggccaggcacggtggctcacgcctgtaatctcagcactttgggaggccaaggtgggtggatcacgaggtcaggagattgagaccatcctggctaacatggtgaaatcccgtctctactaaaaatacagaaaattagccgggcgtggtggtgggcgcctgtagtcccagctactcgggaggctgaggcaggagaatggcatgaacccaggaggcggagcttgcagtgagccgggatcgtgccactgtactccagcctgggtgacagagtgagactccgcctcaaaaaaaaaaaaagaaaaaaagaaactccgtctcaaaacaaaacaaaaaaaaaaacaaaataaacaaatgcaccgtggaccctcaatgggatcctggaacagaaagaggatgtgaacagaaacattggtgaactccagatgaagcctgggttacattaataagtcgagaagcaatgtcacactcttaattgtcacaaccataccacagtcaggtgtgaccttaacaaagggggattgggcgaggggggctgtgtgtacaatccttgcaactcgtctgtcatcttgaaattgttccaaaataaaaggtgtattatggaacgagtcaactggtgtatcttgcactttccaaggatcttttcctcttttttgtttttatttttatttttgagacagggtcttgctctgtcatccaggctggattacagttgcatgatcatggctcactgcagcctcagcctccccaggctcaggggatcctcccacatcagcctccccagtagctgggaccataggcatgcaccaccacacccagctaattttaacattttttgtagagacagggtttcaccatgttgctcaggctggtcttgaactcctgggctcaagcgatccgcccgcctcggcctcaaggatcttttcctgtgtgtgcctctgtaacgttccgcattgatcgtttggaaaatatcaatctcacaatcaggcagctcttccaggagtggatgccattctttattgttatggaaaactacatttgtgactgtccccaccaggctcctcaggaaggtctttaaggattggaaaaccgtctggttcaagggggcagttgtaagtttctcaaaattctgctgtttgcatgaaagctccaaggtggtcaccaacagcaaaatccaggagttgtttttctctaagtggatctttttgttcttctctgaggaaacatccagccggtcgccggttcagtaaaagcggtgcacgcagcccattgagcctgcaactcaaaccactgtgcaggagcttttcctggggacgctggcatgcttccggctacagtgggagtgctttgagcgtgcctccgcgaatattaaaaagacacactccagggtcaagatttaatagaattaataaagtttaatgcttcatcaaggacattcttaagtgagactggcagctggcccacgtcccatgggctgggagacctgggctcagtcccacctcctgccccaaactcagccacaccaccctgtcaggaggctttggtgggatggttcccagccccgttcatagacctgccctctcccctgccccctccaccctccaccacctcaccctccccattagattctcctggagcttctcctcaaggttccagggagccctcaccgaccagcccagactagagaaattcacttcctggggctccctctgcccattccttactatcccgtatgttccttggcttcccccaccaggctgcgaacttggcagaggcagatcccccgacccagcacggtctcctatctggcagtggtttatctcctactcgcccaggccaggacggcctcctgcagtccatcccacgagcttgcagccatcccgtagggccctctgtctcaggcctggcagcagtgggattcctctggatctgggaattctcttgaccccctggtgaaccgcagagagcacagccctcgcctccttgctaatcacaagcagagagtggcgggtgcacgcctcctagctggacgggccctgccccaagtttcttctcatgcacaacgttcagtgaggaactttccagaacgtgccgggatgtcagatcccagtgctgcaggaaggagtttccggggagcgctgggtgagcgggaaagaccaggagtaaggagccgaccccctcaggcttcctctcccatgttttccacaagggagccccccaggcccagaggcgctcaggggaaggcctcgcccaagctgggcttgccgtctgccctgagcgcctggaagtgctcgtgctctgagacagtgccagctgattccccgactcatgccccggcattcccaggacagggatgcatggagggcctgacccagacacccctgggcacacgggccctggcctggacccagcgttcagacaggaactgggccctagtgggaggatcttgcccagctgaaagaagagacgactcagccctgagccagccacacctgatggggtcctgctggggcaccacagaagcccttcctcgccactgcccagtggtgggttcagcggcggagactggcctgttctgggagacagagaagggaggccgcacacaggatactggcctccctcctccaagccgccctccttccttgagggatcttccaagctccaggtggtgtttcctgggcctgagtgggggagatgcctggtggaggaggcgtagaggggaagggaggggcaccagggccagagcaatggcccagaggggacacacacagggcagcctcctggtcgcaccctgagtaaccccggcctgcccctcactcgccggctgcggtctcagtcttcttacctggcgggtggggctggtaagcacagagcctgcccctgacacatggggagcatttagggagacacacacagagggctctcggtacgcccagccccatgagcgggagaaatgtgatgcgaaagccctaccttcacacccagagtctggggaggcaggagagctgggcagcaggctgggtcctccacctgcgtagttcaaaactgtaccctcaagcaagccctcaggcctgacctggggcagtagggagaccccaggtggggtctagagctggtgccagagggtcctaagcctcagaacagcttgcccttggcctcaggtcagcagtgaggagtggaggcaaaccctagggctgcctctctgagtggctttctgagctggccagggttgggcaggaggagggtgaggctgcttccatttcacctgcacccagagctgtacctggtagaggaaggaagagatgactgtgctgaggccgggaactgcctggaagacacaggcccacaaacatctctggcctcagccttgggaggcaagatggcgtgggtactgcctgaccacaggaggacttgggggcactggggtgagcaaccccacggccctgctattctccgcagcctgacatcatgccatcagggcaatggactccttgttggctgtctgtgcctccagctgtgagtctgcagttgcccgtctgctacgtggccaatgcccagcacagtggctaacctggggcactcaagaacaatggaacgaccatcaacaggtccctgtctttctcagttggccatcaattaaaatgcggagaatagctctacttttgaggatgaagtgatagaacagatgtacagcaggtagcacagggtgacaccctgtctgtggaaacttctggagtgaaggctggcttgtaaggactaagacttgccagatagcaggttcattagatgtgatggaaggtaagagagatggggactgctaacacccagaattctggtgtcaacaactgaggggctgggatggttattccttgagatgggaggaagagcttcacatgctagtggataaactgagcaggcattggatctacgtgcccaatctcaagagggcgaaacaagagttccacgtttgggagtcttcaggacatatgccatcatcaaagctgtggtgtggaagagttcatccagggggtgaagttggaggaagggaaggatagaggaagcccaggccaggatgaggccagtgcttaatggaagggagagcaacaaggaaaacaaaatgacgggacagtaaaactggaccaagtggccacaggagccaaagggatagcacatttcagggtttaaggaatgttattccattgtcttccagcccccatggtttctgaccagaagtctgtggcaattcaattcaccattccctgctatgtggtgccttgttctcttctttcaagattttcttttttaattttcatttttatccatttgactttgatgagcctaggcatgattttcttcaaactgatcctattcagattttgtttcttcaaattgatcctattcagattttgatgaacttcttgaatccataagtttatgtttttaaaatcaatttgagaactttttcatcattatttctttaatatttttttttctgctccatttgctctctcctccccttctggaactccaatttcctatatattaatttttggggtttttttttcttttgagatggagtctcactctgtcacccaggctggagtgcagtagtgtgatcttggctccctgcaacctccacctcctgggttcaagtgcttctcctgcctcagcctcccgagtagctgggattacaggcacgtgccaccatgcctggctaatttttgtagttttggtagagatggggtttcaccatgttggccaggctgctcttgaactcctgacctcaagtgatctgcctgcctcagccacccgaagtgctgggaatacaggtgtgagccactgcacctggccatctgttaagtttttaacactattcacatgtacttgagtctcttttcatgtttttaaagccttttctctctctctcattttcgtattgagttgaataacttctattgctctgtcttcaagttcacagactttcttctgtcctctctacactactgatcctttcatccagtattttgttttttactaatttcagagagtgtatttttcagttcaaaacatcaatttagatatttttaaatattttctactggtctgctgaaatttcctgtcatttcattcactgaaagtgtatttttctttatcttcatgggcatagttataatagaggccttgtttgatgattccaacatcatggctggcctcagtcaattgtcttcccttgagaagaaaataccggtttctggccctgacatatgtcatacagtttgggatggcctcctggactttgtgaatattatgttgttggagactctgaaatgtcctgtatttgtctggagagcactgatgcatttgttttagcaggcaattaacttgattagctgccagttgcaaagagtctcacctgaggtgacaggagtcccagtctcagttcagattgctttctgccccataccagaaaccagggcagatttgacacataaaaggcccttctctagccttttttgagagtctcatctcactctccagcgactttgattgcctccagctcctttcctgcttcctctggccataataatggcaggacttcttttaatcccctctttttttcacaggtgttgaacatggcaggcattctattggaattatagatacccacaccataccctgactaccccatcaaaatctacctgcttttgctaactttctagagtccttggtagtttctgtttgtttgtgattcggggtttacagttgttatgtgcaggagtgctggtttgttaaagtttgctactccatactagaaggagaaccaagagaagtttccgagtggggagtgagagcaagcgggtgagcaggaaaaggctgctgagtggtcaagtctaataaaaaaaaaagggtgccctgaatttggctacaagaaggttggtggttgtcgtgaaaagtcctctcagtgggtgaggagatagcaggaaactgaggactaggtatcttctcttatgttgaggaagtttctttttagtcctagcctgctcaacacggtttataactggtagtgcattttagattttattacatacgtttttggcacttctcaatattatcatatggtttttcttcctttggcttattagcatcatgatattaatggatttcttcatgttgagtcatccttgcgttcctggaaacaaactctacttggtcatggtgtgttattactttaatttaatacactgctggatttaatttgctaattctcttattgacaatttttgcatctttctttacatgtgaccttggactgtggtttttccttttttgtgccattgtgtttgagttttgttaatcagggttatgctaacaccaaaaatgaatagaaaccgtgtccatcttctacacttgaaacattttgtatagtacaggcatgatcttgagtgtttaaaaaactttcccgtggaacactctgggccctgtgcctttttctggggtagcatcttgtaaccctcagttgacaacctggtaattggtatgttcagattttcagatttttctttttctttttttttttttttttgagacagagtctcgctctgtcacccaggctggagtgcagtggtatgatctcagctcactgcaacctccgcctcccgggttcaagcgatcctcctgcctcagcttcctgagtagctgggattacaggcgtgcgccaccacatccggctaatttttatatttttagtagagacagggtttcaccaagttgatcaggttggtctcgaactcctgacctcatgatccgcctgccttgacctcccaaagtgctgggattacaggcgtgagccactgagcccggccgatatgttcagatttttctaggtcctcttgagacaatttccaggtatatgttcacttaaacaagacctttacatttcatttttaaaattccttttaatatcattcccaataaatttcatttaatcgacaaatatcttttaatctctatgatgtgttggatcctaaaaacaggatatattcaacctgaatcaacacatagaatctctataagcacagacatacaatggattacagtctctttgctctcttccctcacaaggatcatgtcagaagagaatccaggtagacacttgttgacctacagctgacttgcacctatccacacatccatttatccatccatacatccattcacccacacacacatctattcacccatccatcacccacccactccatcatctacctatccatacatctacccatctgcccatctgcttatccatccaccaacccacccatccattcatggagcccacattgaaggtccaaggctgagaaatataagctaagtggctggaagaccaaactgatactttaaatggcctccacaggctaaaaccatggacagaatagaacaagataagacgatgttctgggatccagggaagatctgagtgaataatttacaaggtgctagccgggcccctcctcagccctgctgtttgttacatttatgttgatgtgccacttcctagagttgttttgagggcaggaatggaactttatccatcttcatgattctagggctttgtacagggcctggcatatgtgtattgaacagatgatgaaggcaggaaggaccagagtgtcgtggaaggtcccgcacagagcccggaacatgggacatgtggccgctgagggctgggtgctggggagggttgcggctgcttgcttcaacaccacagagggctccagtgtagatttctttccctcccacaaagctctgagcccaggtccaggggtgggggaaacccctgtggtctcagcccgctcccacctgctggggccggccagccctcagccactgcagcgccacggagcatcaggagaggcctcgaaagtcttcctccccacagtgctgctgagctggggccagggaccaggctggggcgtatcctaggccccgtcctcggcaggagaaaggtgggggtgggcactgcttgtcttctcccccactacctccaccgactctgcagagaaccaatttgccttatcagaaattcccgagagtggctggctaaaccaaatagctaggattcctgctcagaggcacatctgttcctgatagacgggaggccagggacgacaaggcaggggaagggaagcagaggtactcggccagaccttcccgaagtgatgctcccagccaggcgggggagccagccagcctgagagtgggcagacctgggttgcccccagggcctgaggcaggaggagctccctgctccccatactccccccagctgaggagccagggtctgcatttggtggggctgggggcagggtggaaatgaccccatccgtgcatgcgtgcgatgctgctgggccacaccgagctcctcccagctggggtgcctccctgcgcccggcccagcaccaccccttccaccccacccaccccacccgctagtgcacctccaaaccctctcaggctccaggagttcccacacttagaccatctctccagaattgatggctagagtggctcactctccccttaaaagcccctccccgcctcccagagctcactgaaggtcaagttcagcttcttggctcagcaccgaggccctttgagctgcagccatctccctccatgtgtgcacacctgtgcctgcacatgcggttccctgtgcctagaacgcccttcccacccacgtcctgccaatgcccacgctcctgtccgaccccgcgggaggagcacccctgtctgcatggtctttctcagccccagacctccaggtgcctttgcctcaccccgctcacaccaccaggtccccttggcccaggaattccttcttctgaagccctggctccccagcaccaggagcaggcatagccaagtgcgcgaacaaagaatgaagactgggaggaggcgatcaggagagggcagtggaggaggctggaaggagagaggggcaattctggctctccgaggactccgaggaggactccgaggaggcctggggaaggtgaaggtttgcaccacttttctgtcccctgggagagccaggcacgtgggaacagtctgaagatggggaggggcctgttcttgcttccagtcatggcaccttggggtcccacctgccccctaccactgggctccaacatgtgcctgcacccccctccctcaatgcagtctggggccaccctcctccacacccaccaccccactgacaccgccactctggggctgcaggctttcaagggcagaggcatccccatctctgtgtgctccacggccgagctgagtcagggggtctcaggctttggacaatcaaggagggaggaggcgagaggatggagtgcagtagagggggtgggtaggtaataggtcctgtcaccctgagggtctaagcacctgtctatgtgaagggggtactgaaaggcagacttggagaggggttccctggagggagcggctgcaggcggccgctctcctgccatccttccctgtgtagcctgtgcaggcagcatggagtccccactccaactcccagatggacatgcaccccggtacccccaacccccaagacacatctcattcagccatcccccagaggaagcaagccccaccctcgctccaggtctgtggtgcggtcccctctccccggcctcagcagccccttccaccgaggaggagcccagcacggagggcacggcactggggagagggccgggctggcggccggaatgtgccgcggccagtgtaaacagatcatttctgtctgccttggggggagggctgggagcggggagggagttgtcttgggctttgttatgttctgaaaaaaaaaggcaaaaaatttgggtcacaaaccacaaactgttttgctttcggcatgactggcataaacaggcattttctctttggtttcaggccggctgaggcctgggctggctggggctgggagccgggggacaggctggagactacactctgagcctggggctgcagccccggcctgggccagaggggagtgggcagggccaggggcccagctgagaaggtggagaccaggcttgaggggtggggctgtcagcctgtgggtgccagccctggcctggccgcacctgtgtgggagctgggaagagcggggaccctgggggccagacccagagggacaggttcctccaggatgaggcctgctgagcgggccggtgggcaacctcagcaaggatgcctggcagctgggtctccccggcaagctaacccggggggcagggggcaagctaacctggggggcagggggcaggggccaagctaacccaggggcaggggccaagctaacccggggggcaggggccaagctaacccaggggcaggggccaatctaacccggggggcaggggacaagctaacccggggggcaggggacaagctaacccaggggcagggggcaagctaacccaggggtagggggcaagggggaagctaacacaggggcaggggacaagctaacccggggagcagggagttagccattggtggggtgccagagtccctcgaggcaccctccagggccttctgtctgacccctctggtctgggagccccagacagagccccagggatcctggagaggacttgccagcaggcgtcttgggaccatggttagcagtgtctctggcggatggtggggggctcaatgccagaacaaacaggaagggagaccagggaggccagactcctgggggtcaggatggcacagtacagcagagggcgtgcgtgagttaccaggacaagggtgataccagagggcctgggcaagagggcagcaggtgcagcctgggactgggagtggaggggtgggtgggaggaccagggatggggccaggtgctggaaagcctggccagggcctggatttgccagtggcccacgggattcacggagggctctaagtggagagaggcagactctggccccactgctctggtcccatatggagcatggccagaggggctggctctacaggaggctggacagcagcaggggccagggcctggtggagtccgtggatctcctcaactaactcaatgtgaggtgtggtggagggcagtggtggaccggcagacgcatgctgggtgaggggtctgcaggacatcctggaggagtgaagctggccacagcaggtgccattggaagtgtgtcctcttcattctcagagcgtttgtgggacaggtccacacgggctgccattgtgcagaggaattccaaggcagactccatgccgagggtgcaaccacgccaagatgacctgggcaaaggtctgcaggggaaggggtctaggcaggggcaacccaacctgggaccactgtggctgggcaggtgtcatagcggtggtggtgatgggtagtgtgggtcaggtggcctcatgggtcatcatgagggtgttgcttgtcaccaaggaaataaggtaccactgctggactatgaaccgagctgtgccacgaggccacgtgggtgctgcgtggaggttgggttagggttagggttaggttaggctggagtgcagtgtctgttcacaggtgccatcgcagctcactataaccttggactcctgggctcaagtgatcctcctggctcagcctcctgggtagctgggattacaggttcgagtcactgcacatgacgggacagacctttctgagggccacaattcaccccatggcctcagggtcccatggtgtctgttgaacaaacggcatggcctatgcagcccaggccatctgccccccattacagctctgacctcagccccctacacaggccctccacctcttcctgctgcagctcccaccaacccaaacccccgacttcctgctgtggctcaaacactcccagaccactcatgttttatccctgtgaggaagaacgctctttctggatgcttcatactccttcctcagctccttccagtctctgcccccacgccaacttctccatgaggcctcagctccgtccagtctctgcccccacgccaacttctccatgaggcctgtcttgcttaaaagagcaccgaacacctttcgctttcttccctccatgacgctgagcttatctcttggctgaaagtccagcatgtgggtagtgcctgtccatgtgtttgtatacgtggatgagtgggtgggtggatggaggagtgagtggatggatggatgagtgggtgagtgagagtcaagtgggtagatggacagatgagtagacagatgactgggggtggatggagggcgagtggatagatggatgagtgggtgagtgggtagatggatagatgaatagatgaatagatagatgactgggtgggtggatggagggtgagtggatggatggatgagtgggtgagtgggtaagtgggtgaatgggtagacggatagatggatagatgactgggtgggtggatggagggtgagtggttggatggatgagtgggcgagtgagaggtaagtgggtgagtggatagatggatagatgaatagatagatgactgggtgggtggatggagggtgagtggatggatggatgagtgggcaagtgagaggtaagtgggtgagtgggtagatggatagatgaatagatagatgagtgggtgggtggatggagggtgagtggatggatggatgagtgggcgagtgagaggtaagtgggtagatggacagatgagtagacagatgactggggggtggatggagggcgagtggatggatggatgagtgggtgagtgagagttaagtgggtagatggacagatgagtagacagatgactggggggtggatggagggcgagtggatggatggatgagtgggtgagcgggtaagtgggtgagtgggtagatggatagatggatagatagatgagtgggtggatggatggagggtgagtggatggatggatgagtgggtgagtgggtgagtgggtagatggatagatgaatagatgaatagatagatgactgggtgggtggatggagggtgagtggatggatggatgagtgggtgagcgggtaagtgggtgaatgggtagatggatagatggatagatgactgggtgggtggatggagggtgagtggttggatggatgagtgggcgagtgagaggtaagtgggtgagtggatagatggatagatgaatagatagatgactgggtgggtggatggagggtgagtggatggatggatgagtgggtgagtgggtaagtgggtgagtgggtagatggatagatgaatagatagatgagtgggtgggtggatggagggtgagtggatggatggatgagtgggcgagtgagaggtaagtgggtgagtgggtggatggacagatgaatagatagatgactgggtgagtggatggagggtgagtggatggatggatgagtgggtgagtgagagttaagtgggtggatggacaggtgagtagatagatgagtgggtgggtggatggagggtgcgtggatggatggatgagtgggtgagtgagtgggtaagtgggtgaatgggtagatggatagatgactgggtgggtggatgggagggtgagtggatggatggatgagtgggtgagtttgtgggtaagtgggtgagtgggtggatgatgagtgggcgagtgggtagatggatagatgagtggatgggtagatgggagggtgagtggatggatggatgagtgcgtgagtgagtggataagtgggtgagtgggtgggtgggatggatgaataggtggatggatgggtgagtggatgggtgggtgggtggactgttgggtggacgaatagatgggtggatggatgagtgggtgagactgggtaagtgggtgagtgggtagatgggatggatgaatagatggatgaatgggtggatgggtggaggggtaagtaaatggatgaatgagtgggtgagtgagtagtaggtggggtgtttgtggatgggatggatgaataggtggatgggtgggtgagtggatggttgggtgggtggatgaatagatgggtgaatgggtgcgtgggtgagtgagtgggtgagtgggtggaagaatagatggatgagtgggtgggtggatggaggggtgagtaaatggatggatgagtgggtgagtgagtggtaagtgggtggatgggatggataaataggtgaatgggtggatggtgagtggatggtttggtgggcagatggaccagtggatggatgagttggtgaatgagtgggtaagtggatgggtggagggatgggtggatggatgggtggagggatgggtggttggatggttggatggatgggtggagggatgggtggatggatgggtggagggatgggtggatggatgggtggctggatgggtaggggatgggtggagggatgagtggatggatgagtggagggatgggtggagggatggttggatggatgggtggatggatgggtggagggatgggtggagggatgagtggatggatgagtggagggatgggtggagggatgggtggatggatggggggatggatgggtggagggatgggtggggggatggatgggtggagggatggggggatggatgggtggagggatggagagttggagctgccaggatgaactgagaatttgcaaagcagggagaggggagaagagagggccctgcagtctcagaagccctggaatgaggctgggcccagtgaagcaggatgaaggctgggcagccctgagtgggtgtcaagagaccaggctaaacccgggggaaccagggtgagtggctttgcccagttctgcagagaggtcagggaaggtcacaaggggtccggggaagcagagggcaggcaggctgcaagtgaaaggaaagaagctgcacagaagctcctggctgtgggcaagagtggctgagcaggcccagggtgcggggagagccagtgtggaagtgacctggggccagtggggacaggagcaggagggcccaggctcatggggctggaggctgggccctgaagcagacccagagaggaagcgagaccatgaggccggccctgcgtgggcctgggggactgcagggctgggggaggggcacagggcagagctgcctgggcttgcagggaaagcaactccacctggcctcaggaaggtggacaggactaggcttccatctacatctacagaagggcctcagagcagccccgaccccctgggggtcagcaatgccacctgggccctggaccctccagcttagacctagcactgaggtgcagagccagggaccagctcaggaagggcatggtgccccccatatccaatctgctcttctccaacccccagccctcctcatcttcaaggctaatccctcctcctccaggcaactccccaaaccaccgcccaccctctcccttcccttggagtggttctcagatggtgtgggcagtgacactgtccgtgtagacgtgtccccaggcctcagaggcttgggtgacagcccagcaccctccagtgcccggcacaggagaaatgctagggacagaggcagccatcaagggacagggcttgaccaggggcagaccctgggggccaggatgcaagcacgcccccaacccagtcaggcccctccccaccgcctgcccagcactgaaggctgcagggccctgggcacacttctgggctccttctgtggcgcccctgtccctccatccccacagcaggcggggcacaggcagatccactgcccaaggctgctggaaagttcctggagggggatggagagaagaggctgggccaggctcccagcagcccagcctacccctcctcccatgctcagggacccttgaaagctagaggccagcacccttgggacaggtgggtacaggctgagccctggcaggaggcagtggtactaatgacatctgggcagcctcaaccttggaagggggctgagtccctgggtgagagtggccctgagcccccatctccagccacagatacggtttccagaaccttttagaggttgcccagccccagtcctctaaggctgttggtgggggaggcattccctggagttggtactgatggtactttgctttttctctgaaaaagccccccaggctcctacccttcgtggcacccccatctttgagaacttggtgcctgacactgtcccagaccccctggcttcaggtgcacgacagtgagtctgagagtctggcttccagctctctcatttctccatgtatgtgatcaggggacggagagaggtgtccacacccctaaggccttccttccccttccctcttctatccccctctgcctgcttccaggtgctcagccccttccctccctctggcagtccagtacccaagtcagagagtggaacactcagaagatcatgacttttaatgctttattgggattgcaagcgttacaaggttaaagacaaaacccaagcatgggattttgccggaaatattagcgttaaaggagttgagttgagtcaaacacgggccgcaaggtggaccgaggcggcaggcacaggtgacattcagtgtttggcgtgggggtcttcaggtgatggcagaggaggggacccaagagggggccccccactgaagacattggggacacggggaggagacaagatggagagccacgactaggcacggaggtcagacaggcagcccgggccaggatggttagtggcccaggggagagctgcaaacctggggacgcaaggggctggtcggcaagtgcccccgggaacacccactccggcgaggcagaatataacactgggtgggtgggtgtcctgacgaatgggcaggtaatttggggtgcctcgaagcgttttggatctcaggccaatgtgggttccacaattgtgacaatttggctctttgggcttctgtccaatgttccgaatggcccactcacagggcgcttgccgagggaccctctgcgactgaggcggactggcatggacgacccccggggtcatgccagccccgtcaccaggacccagaagcctcaggcctctagactgctagtcgggctgcgtgcaggggggctgagctgggggcacaagtgggggcgaggtaaacctcccagaggccgagtccctgccgcagccctaggcgccgcggtggtggctgctatggcatcaccagacccgtgggctccggggcccaagcaacctggtcgatgggcagacctggcagctctcctgctctgtgggctcagacccgcctgacctccctactccccggcctcaccccaccttgcccccaagaggtcccacagagcttcggacctcctggagacaaggcagggtgctgaggggcgggcaagatgtcaccgagggagaggggagggttcctcaagtgtgcggaaggcggccaccctgccccagcctgatggaaccctctgtttacacacctgctagccccttcccctccggccagcctcaggccagccaggagccccctcctgtggcctccgagcaccctcctgacacctgaggagaccctgcccaacccccccctccgccctcaggacttctggggaccagccactgtccccagaagccaggccggacagtggccttctccactcccctctgacttctccaagggggctcagtggccagtgccccccaggaggctccaccctcaactcaacccaagcaacagggacagatgaaaaacaaaatccaatcagggcgataaatggcggggggcaggacgtggtggtctccaggctggcttcgtgcgttcttgcttttgtcactgcccccctgttacatggggggggggtttaatttggtttctgagcgcataaagctaaggaggggtaaaaaaaaaacaaaaaaaaaaaaaaaaggaaaaatgccccaagaaacaaagagggggaatagatcaattgacatgaaatttgggggttcctaatttctctatgtaattctgcaagtctgctgtcaatcctcctgacttttccatccaaaatctcccgggaccacttcctaccccagaactccccccgcccagcccccactgccccccacccacccctccaaccgccagacttcccacactccccgcatcagtgcacggcccccgaggactccacatttcttggggggtccccaggagacgggcaaagatgatccctaggtgtgctccggtgggggggtccccaagatcttccttccaggagcacaccagggagtcaggctactcgtgggggcatgtctgctcagctaccgccatctccaatgtggccaaactccttcctcactctggctgggccaacacacagtaagtaaggtgtatcgggaatgggtggggtatggggagcatcgtggctcacgctgcgggggccgtggggacaggcgccaaggaggccagcctcacaagggcatctctgtcatggtggaaagatggaattaggcctgggacacaccccgcccaccctacgggtgtatcccaaatgccgccggccgcacactcaggccgcaccatctgagccccctcctctgagaggcagggcacagacagggccgaggggcagtggagatgggaacaggagcggggctcagaccatgaaaacattggagaatcttagcgggactttggcctgatccatacagatatcgtagttgcttagatatgcttattgttttcatccaattttgtgggggtgtgcgtgtgtgtgcgcatgtgtgtgtgcaggtgggtgcttgcgtgtgcaacgtgtgtgctgcgtgtttgtgtgctgtgagctgtgttcatgtatgtgctgcgcatgagtgtgtgtgctgtgtgtgcatgtgtgtgctgtgtgtttgtgtgtgtgctgtgttcatgtgtgctgtgcatgcgtgtgtgctgtgtgtgcatgtgtgtgctgtgtgctgtgttcatgtgtgtgctgtgtgtgcgtgtgctgtgtgcatgtgtgtgctgtgtttgtgtgtgtgctgtgtgtgctgtgttcgtgtgtgctgtgttcgcgtgtgtgtgctgtgtgtgcatgtgtgtgctgtgtctttgtgtgtgtgctgtgtgctagtgtgtgtgctgtgtgtgcatgtgtgtgcgtgtgctgtgcgtttgtgtgctgtgtgctcgtgtgtgtgctgtgtgtgcgtgtgtgctgtgcgtttgtgtgtgctgtgcgtttgtgtgtgtgctgtgtgtgcatgtgtgtgcgtgtgtgtgccgtgcgtttgtgtgctgtgtgtgcatgtgtgtgcgtgtgtgtgctgtgcgtttgtgtgtgtgctgtgtgctcatctgtgtgctgtgtgtgctgtgcgtttgtgtgtgtgctgtgctcgtgtgtgtgctgtgttcatgcgtgtgctgtgtgttgtgtgtgtgtagctgcggggatgcataaagtatgagtgctttttaggatgggaattgagatgtaagatttgggggtgagggtcgtgccaattacatttcatttgcatggattttggttttcatgctctgtcctcccctcctttggtcttactgggtccctctgactgctctgtgatttttagtgatggaaaagggagtgaggagccagtctgggttgttgctattttcggatggccagtttaccctgaaaattcccgtgagaagggagatggcggtagcagcgacgtgcccacctgtgatttctggggtccttcttttctctttgctggttcagggactcaagtccaggccaatttgactcaaagtccaagggagaagagaaagaggggggtggggagtgccaaattcctttattttgccaattgtttctcagccaattcgtttttaatactttttttttttagccaattgattttttttggtggttgttttttttaaagccaatttctgagcttttgtggggtgtttctaaaaagccaattagttttaagagggttgttgtgggggggggggaagggggttagtttaatgttttgattttttatgtgtggggataattggggataatttggggggagggtatgtgaagggtgtttaaagccaatcgattttgtacatgtttgaagatgctgctgtgcttcctcagcccgatggagggggccgaggagagtagcctgtttcggggaggcggggcacggggactgggtcaggagaagccccagggggacgtggaaccgagagattttcgggatggaacctgatggaaacgtccgtggtcaggaggaggctgcaggatggtggcgccgggctgcagacttgcggcagttttgctcacttccgattgctggccatctctgggggggcgcccccgtgggcggggtcttgggtgggtagagcaatcaggggacggtgacgtttggcctccctgaacgcctcgagctccttggcgagcacgtgaccccggcgggcacgcaggagggcaggcaggcccctgcgcaggcgctgggtggactgcttccaggtgtcatattggaagaacttgcccacggggtatctggggaagttgtcctgggaggggaaggggctggtcagcaggtgcctgctctccacgctcttccgcctgagccgcccgcctgacctgacaggccacccctgtgactgatcagtgacttgagctaatgtccacgggcagagggacagaaggagccagcgtctgagctgctcccgggccacacagcaagcaaggaagtcacgggtccttgtccctggccaagaggtcccagaggccacaggaaacgctgggcgcccgaagccctatttctctgtctctagagagtgggaaaggggcccaggaccctcaccggaagcacggtcggaggggtcgacacgtccctctcggacttggcgggggtagcacagtacgtctccaggagggccaggtcacagctgcggaaacagcactcctcaacgatgccacggctgcgacggctcacacggcttgcgggcctgcctggaagtcccacagcacagagagagccgtgttagcaccgcactgaccccagcccccggaggctgaagggggagcaaaccacccctgccctcaggccaggccctggaaggacgcagccaccctgcgggtcaggggagggaagtgagagctggcaggcagaggcgtcccaggaagaagagaggtgagaggggaggtgagtgggacccagaccagcccgtggcctctgctgcctccttcctcagatgaaaaatgggcacaagctcttggtcccacaaccagagggacaccaccaggaccaaaggctcacaatgggagtggtttggaaaatgtgtgggatgtgagcccagttcaggggcccccacaggagggactgctgtccctgagcttggactctggcctggcaccacctaggaggctggaggggcccacaccacccctggagctgctgagacagggagacaagggcaggagaggagaagacgggaggagaggagtgaggaggcgtgatggaaccactcccttctttcctcccgtcttccccctctcccccacagcaatgctcagctggaaggggaaggtcgctgggggctccaccttggggtgccaaagggcaggtgccatcagccggaggagggagcaggagccccatcacgggggtcccccaagtgggggcttggccctcccctcctctcaggaaagcctggtgcagggaagcttctccctgggcaaggactggctggcaccaggccctgcagtgccacttcctacccccaaatggggcaggcaagagagagggcacaggagaggccagggcgggcaggggcttccagagtcaagcagcaggaacttttcagagagaagctttgaagtgcatttgcatcctgtgagcccatttcacagcgtgagtaagcagtggtggtaaagatgtcacgtggtgagtgtcaggtggaataagccgtgcggcctctgccagtaaggagcggcccctcccctgccccatcaggcatgcccaggcaccatgcctgcctctgcatccacccagcccccctatctgggggtggggtctcaaggacaatgggccatgcacccacctgccagcccccaggctggagaaccaagagagaaacatgaggaaaggctgaagcgtccttgaggtcagcaggtgggcaccccccacggcagccttggggcccaaggaggcgcatgcaccgctcacccctgccacccaccaactgcacttgtcttattgattttaattatataaatcactttattgattttaattctgatcattcaccgaacgcacgtcccttgtcagaatgtccaaaaggtgcaggaagaaaggcaggctcttcctccagagcctgaagccctgcactaggcgtgcggtgcctcaggagcaggagcctcacggcccccaacagaaattctgatgcccagggagacccctgtgagtgcccctgacgtctagggggcacctctggcccacccttcgaaggaggcgtgtgatgggaaaggcagctggtgtggatgccctgggacaccgcacgtgctcagaaacgcggcgggaaggtcaaagtctcagagcaagcggctgggctgctgacctaggagtgtgctcccctggcttgaggttgggcgtcctcaccggtcactctaggggcctgaccaggtctgaggaagcccctcccagctacttactgaagtagaagccgcggtccccacagacgaactggagggtgtccaccagctccccgccgcacagggtctcactggggcggtaagcagcaatgcagcacgaggcgaaggccaagaaggtgagaagcaccagcatcgacttccccattgggattcccattggtgtctgggggcgggagagaagtggcgtgagcggggcagccaggccaagccccaggccagaggtgcccctcccaaaccaaatttgccaacctacaaattcagttgaaaattgaaagcacggctttcctataaacattatttttattacaaaagtaacacacaggtcataatgccgaggtgagggcgcagggccatgtgcagaatgaagcgtccagaagcacacagaaaaggcccagttccttccatttgcaagaagcactagtaattttacacgaggggtgaccatctccacggtcattattgcaggagctcagcggcatccacagctgcaggggcccaggctggacacccgacctggcctccgtcctatgacaccatgggggcagggccagcccagcgtcacatcgccacttctcaggcctccagcgccagccaagatggcagacagccccacccctacagagcatgtgcatccaggaggaccagtcccttcctccccacaacccccagctgagcagggggggtccaggaggaccatcgccctcaaagcagcaggccagtcctgctgggccagccccgcccctccccctggcttttccacctttccagtctgcagctgagccaggcctgggtcaaggactccaatggttaacacaaccacgccacccatgctctagaaaccttgttttcccagtcacccagttctccaactccagtctgccttgggtacccccaaacacacacacacacgcccagagcctcctttccaggcctcaaatcgaaccagtaaggccaggggcctccagaacatctccctatttgcgctaccaaactctccccgtgggagctggagagaccagctcaggccacctgggaagtccgacaccaggttccccagactacaatctggaaggggaggccagtcttaggacacaccccctccacaggctgcagggccacagggccgggttaacccactcgggggtgggaggccgggagccaccacagcaagttggccctgcccctgcagaaggtggaaccctccaggcgggcagccccagccttcgctccgcagacccaggggagtttttgatgcaataaattatgtgagcgactgagcaggcagtgggacagaagcacaactttgcatgccctctctaaagactagtgggcagctgcgccgaggatctgaaagcctccttggtcatctccttgactggaccctggccagtcctctcaccgccccctctgccacccccttccaaattctaagagcacactccgccagctggccactctagccctcgccgcgcttccgcaacaagccccaccactctgaacttggaggtccgggtcaggggaccggcagaaagcaggacaggaagcatgcagcggtgcggagcaggtgagggcccaggaaaagtcctgagctgggcaaggagggggccgaagggaaggaacagaaagggaaggagcaggtgagggagcagagaccaggtgggggcaggggcagaggaaaagaggggaggggggtgctgtccgagaggcagcgggctggcggctgcagggcccgaggcccaggcgtgggccgtgccccctgctgccctgcctcaggctggagtgggatggcagcgggggtcctcactccacagccctggttacctacagctcagcagaaggctcgctggggcaggaggaggaggaggaagaggaggaggaggaagctggaagtctctttcacaggagaagctaatgtccagtttgcaggctggtcagtgcctcagcttttatgtgtgagccgactcctcccagcccgggctccaccctaccccccacccctctccctgctgaccactcccccgcgcctttgctcccgccctctccctcctcccagccagtctcttctctcctgcacccccaaccgggagccctggaccatcccgtagcgaagtgccatgggctcccatcctgcacccccggctcatctctgcacagggcagtgaagggggggggggtctccttcccacctccttgtatggaaacttccacgctgcccactgggcaggggccgcggcctctctccgggtcgaaggctctgcccttcttagcctcagaccagcagcccctctccccctctcccgggactcctgtttggaaatgttgcggacagagccagagggggtgtgggggagatgtcgcgaatgtggcgtctgccatgactcctgccaactcggcccctctccatcctggccccgcccacccccgtcttcctctcgcggtctcgctggcaccgcgtcaacataccagggtgggcttctgcggctccgcgcccctcctcgttacccagcaccccggaggccagggcccgcaaggcacgaatcacacatgtgaggcggcaccccctgcacccacagaccgaccgggaagtcgcccctgcagacacctcacacctccctcggcccttcccgacgcccccaccccacccccagctccgccgccagggtgagcgcggggctccgcgcagggaacgggacccgcagccgtccgtcctcctcctcctcctcctcctcccccccgggctcagccgccccgccgagccccgcaggccccgggccgggagcgggcggaggaagggccgggcgtccggcgcaagcccgcgccgccccagccccggccccggcccggcccgcacacgccgcttacctggaagccggcgacgctgccgcccacctccctgctgcgtgtcgcaaaccgaacagcgggcgttggccctcctgccggacactcctctgccagcgccgctctggccgagtcgcgggggccgaatgtgcgacggggcagagcggggggatggcttttttttggggggggggggagaattcgtctgattgtccagggaggacgggctgtcttcgggctggggcgggccagatgttgtacttttcgggggggaaaaggtatcgggaaatgaggtcagctgttgtatcaaggatagaggggggcagagatagtgggagagacagagtgaacgtgaaaggggggggccgaagagagggcgagggggagagaggacagcgagaggcgggcaggcgcacagcgggagagaacagcacggagagaaacagaaagcgtgtaattaatccactttggttcggcgaaggcgagagggcgggcgtgagggggggagggagtcggaggctaggagctgggggggacgggagggagcgaagggaaggttgcgggagaaagagcgggggccggggccagacgccaagaggggcgcggggagcacagagaagcggagggaagggcgccacgtcgaggggccgggggaggcggtgactggggggcggagtggaggctgcacccggaccgcgggcgcccagctcggtttgggccgacggagccctctgccgtcgcgagcccgggcctcgggagggggacaggcggtggcggcaccggggccgctccgggacgcagcgcggaaaggggagcggcccgaggctgcgcgccggggggagggctggagggggagcgcgggggggggtgacaacgccggcggcctgcgagccggactgcctgcggggggaaccgcctcctcgggcgaagcggggatggggggagttgaggtagatgaagaggaggcggcggggaatccgcaggcccggcggagcgcgaccccgcggacggcgcccgggacgggagtcagcagcgaggcagcgggcggcgtcgacgcggggccgccttgcccgatggaggcgctggtgggcagagcgcgggcaggcgtgggccaggaggcgggggcggccggaaggggggggccggggccggccgggcctcacgcagctccgccggagagcaggcgaactgcgggcgcccacgcccggctcttatagtcgcgccagcccgcggcccagggcccgcgcgggcctcgctggcctcgcgcccgcgccaatgggcgcccgcggagccctcgccccgcccccggcccgcccccgcaacccgagccaagagcggggcggggggtgcgggctgggggccctggggccccggggggggggcggcggtcgcaggggctggggggtgcgcgggggcgaggctgggtggggggcagggagccgcagagcgccaaggccatgctgaatgcccgttctagagaattcaggggccccatcccgggtttctggggtgcccgggcggcctgtgctcgtgagctggggtctccgggcaggcaggggcaggcgggctcccagcgccccaccaggaggctgcactgcgggtgcgccccgtctgagtgcagatgcaggtggcttggggctgagtcggggggtccttgctggttgttgcggctgagggggcccctgggctcgggcggggcgcgcagccgccacctgccccagcaggaggagccggccacgcggcgcttggagcctcagccagatcccgagcgccccccggtgccgcgccggagccccggagcccccgccaggtgcgggacgcgcggaaggccggctgcgccgggccgaatctgggccaggcttggagcctacggaggctccggccgccagaggagagaggatcagggcgggaaacacagctcaaatcctacctgcatggccgagctcaccggggtgcgtctaagtagctcgcctttgcggcccacccaaaatatctggataatggttaccccgtcctcagtgcgttggacttgcatagacgcgagttcggtctcgggggccaccacgataatttgggggtctggggaaaccatctcctggagagtttgaacgatgtaagaaagcactgtgatttttaccaagtcaaaaaccacgcacaaaatcccgcaccccgccagccccccgccgcctaagcctagccaaggggaaggggccgccggcggaatctcgcgcccccctggcccccctcgcccccctcgctccgccatcaatcacttcgcccgcgctccgcgcgcgcctcccggcggagtcctaggcccgcgggctagaggcactttaccgcccggcgggagcgcctctcctccgcgtccctcgccccagccccctgcccgccccactttgggaccctccagccgctttccccacaaatgagatctttgcaatgagcaaacgaaagtggcgcggatttcggggcgcccagcaggagcgagcgcagccgccagccgcaagtccgcagccgtgtcccgcgccccacgccggcctccccggcggcagccggagacgagcgccagcaccggcgggacagcagcagatgcgggccgagagccggtcaggggcgcagaggcggaggggatcggcgcggcggggagctcaccgcgaagctggaggctgcgtccgcgggcgcaccaggagctcaggcagcgagcgatcgaacgctctgtggcaggcggtggacgctgctgaaggtgagcgagaccccggggccagtcctcagtgtccgggagcaacgcccagtccgttggaagacccggggacaatgcccaaatttgggggagactgggggcaatgcccggtcgctttcctggacacggggaagccctccctgtccacgtcctgagggcgcgcggccgacccaagtgtgtttgggcaacgctagagagaaatttcccaaatccgagttgctctggggacttcgtaggagacagagaggcccgaaaccagtgcccgctgtgcgcggggttggggaagctgcagtgggtggccggcgagccgggaacaatgcccaaattttggggaacgcaaggcagagttctttctgccttgcgggcttagcgaatgggtgtcctggaggaggggaccccggggactccgttaatgtgggaaccgtgattaatgactaaactcgagactccagaaaaatagattacaggtttgggggatgagagaagttgctccatgcaattgggaacatagagaaagaggtctcaaataggggccagctagcttgggggaccaatttgtgaggaggggtagttaaagaaaattctccatatgaaattgggaattttgccgtagagccatattacgtaaaattggcagatgaaagcaaggaacacattttggggatccaaacacattcttggtgtgttagggggaagctgagattaattttcacatcttaagaatataagttagtggcctggacgctggcagcagccggggaaaaaataaccttcataattactgtggcttcagggaaaggttttaacacccttcagagatggaagaaagcactgtctagattttgggggagcctggagtgtgatcagtacatttggggaaagcaaaataaaaaataaaaaaataaaaaatcagtattatttttctatgctaatttttaaatgatttccattagcttatttttggtaaataagaaaaagactatatattttcctggatgtcgtctgcatttgggggagccccagtgaaacacatttcaagtttttgggacacatggaaattacccaatggagatttgatatctaaatttctggaaacctagttagtagctaggaaacttataggtcgcaggtttttccatgcctgggatttcttgggacccagggacattttttagtgtgctttgggggtccatggaacattttctaaatgtagggggacccagggcagggaccataaagtcaggagactcataaatcagtattaaaaaaaaaaaaacctcaattgttttgtgaagggaaaaaaatctcaatttgctttggaaggctgggagacaataccgcaatttgggggctccaggaaaatcgtttttgaatctaaagatctagggaagttgctcagagtccttggaggacttgggggtccatatgtacattttaaagaaaggggattcagaattcctaggtcttaggacttaggaattttcagattttgtgatagggagtgtgcagtgtgcttgaaggaaatattgcttaactttgagatgactcagtgggttgtttggagcccaagaaatcagtgctgtcctgtgatccgagggcaatgctgaatgttcctagagggcctggagggcagcgtccagaacatccaagtatgggggaccaggaaaagggtccagtgtgatcctggccgttggggtttcagaccaatgcctgaattttagaaaagcaagattcttgttatgaagctcctgggacccagagaattgtttaatagtcaatatgttgtgatgcagagaaagtgctcggaatgtttgggaactggggccgttagcaacacctggcataacagaaataaaagtaggctctgcccaaggggtccttttgtgcttggtgtagcccagagggacccgggagaccctgtgtgatttggggggacctggagaatcctgggtcacacttgagcacctcctggtaactgctcagtgtgctccagggacctgggtggcactgtctacatcttaagggacctgattcgtggccaggcagcatatagagccatagacgttaatgccccaaagctttgtgactcacacacccacaacattctcaatagctttggggaatcactggggaaatccctccattttatgaaactcaggcaatcagagggcaggtcgtttatgattcagaaaaggattcaacatgctctgggtgtaatgaccgaatttgggggaaggtatgggaagcaattttcatactctgagggttccaaccttccagccctgctgagtgtcatgagggacttgggattcaacgtgtaaagtttagggaacccaggttagtgtgaatagatttgcgggacccaacagcaaatgtcccatgctgaggtgaacgggaaggggcgcgggggtggggtgggggggcgcggaatggggcggacgtgtgccggaaacagtaagcttaggagaccctggagttaatattcaaaattatgcgggaaagttccacttgttttggaaacaatgcctaaatgtggaaaaggcactgtccacatcctggggagccaggcaaattggtcagcgcgaccaccacggaccaagggcttcgtctttaaaattagggaagccgggttagtggcctgtaaatctgtgggacctggagggggtgtataaaactgtccagagcctgggagaaagcacatctggggccccaggccacatagtgtaagtctggaaaagcccgccgggactgatgtgttttgacgtccccggaaattaacgtccaagaaaattattgtgacccgtcgaaatggtgagtatatttagaagacttgggaagcaatgcttaaatttagaggatcccagaaaaagtaaaatgtccgagttcggggaaagcagggaagttgttccgtggattggaatcccccgaggatcaagggctaattgttgagctcaagcttcccgggcagcggaaggaaggcgctgccggggattcaccttggctggggcgcgcgcggagcactggcgccctccccgggaacccgagcgcgggcggcgcgggcaggtagcgcggagcgccctggcgcgcacggccggctgaaattctgcttttcgttctttggggtttttcttccttttgcttttatttttttttttctttgccttctccacacggagagcgcgtttgtggcggcagcccgagcttagcgggcgtccgggtgtaaggaagaaacccaagggccgcgagggagcgaccaggacgctgcttcccgggcgctcccgggactcccagatacctgctcggtccccgcgtgggaggtccgcaggctccccctcgccactgcgccccactcgcctccgcgctgcgagcctaggcgaagccgcggccgagccgccaccgggggcaggctagtccccggcttggcttgggggcccggagcacccccggtggccacctccggcctgccccggagctttgcgcgcgccgttcgggccttcgccagcaccaaacaagggtgaaaccagttttgtttgggtaacactgaagagcagaggaagtggggaggaaaatgagaaacacggggcccgggaggaggggggtgcagggctgcacgccgctggggtgccaggggtctcttttcgttctctccaagcgaattttcagggaaagtctgtccactccggctggggaaagcccagttccttataggcaaatattaaacccgcatgcaggcgcccaacggccctgtcggcaggaacaaggtcaccccttggcgttgggcaatgtcgggcgatggggcagtggccctaaggggacctgtggggtgggtgggggtactgccagagagggggcaccgctggggaccagcagaatggtgggggatcctggggcaactacagtgggcattgcttgtccccattgtcaccccataggaggaccccggctagaaggggggcatctcaaagcctgacactggggaggcagaagttaatggccttggacaggtgtggggagctgggcaggatgaggcatctctttcacattagcttggcaagacagggagaacccgcccccaccatgaaaaacagcccattttccacccacagaacaagacacgtgggaatgtccccttcaaatttctgtctgcatcaatcacccccatgtcccattccaagaacatctggcccatctctccccacccatcactgccccccttcccaccagccttctgcagcctccccgtgtccccagctctctggcctctccggctgtgcctatagaagggggagcctccagcagagaacccctggctgtgttgatgttttcctctgcagggtgacttgtaaatttgggggtgaggagcatttgaaaggtgcctgtctgcaaacctggtccccgggagagcggactaggttgccgaggctcccgtcatggacaaaaccagggcccccagggccagctctaggctccccccaccttctcctccacgcctgcttcccaggctggggacaggttgggcatcgggggtgagccccagttccgagttgtgggttctcctcctctttgggggtgctggggacaattacaccagtgacctgtttgggggtcccttccctttgttctgccctgccgaggtgccttcccccagggggccaccgctcatgcttgaaaatgcatgcctggactttttaaggtaggaagaaggctgagggtcaccttggggtgcccacagcagggtgtagtggccctgtagggagggaggagcaggtgggggagtgggggtgcacacatgttccccctccctcgtggggctgcctgctgagtgctctccttatttagtcagaagtgaccagggcaggctggaggctggggcagacgcgggtcaccctgaggctcgaaaagcacaccggctcccctctagtcaagaccagcatcggggttcttcctcaagactggctcctcccccactacttccagcccccggaggtaggaagggtcccgccagcagtccaagggtgttgggagggggccagggtctcctcccacccagagcttggccggcaggaactttagccccaagcagcgtccgccccccagccctgaaccagcacctcaccagggcaacgctggtctcctctccactggcaaacccacattccacagaggatgaacatcccctcaaggactcagactcaccccatggagcctggcccatgccccagcctcggcctgtggctgctccccatcccctcgctcaccagccctgaagtgggcctttctcattcccatttcctccccagctctggctctgagctcaccgctccgccgtccgtgggaccaagcccagcattttacaaacccagctcctttctccaagggtcctcagagcgcccctccgtcaccccctgcagggcgccgcagacgaggcgctgaccttgcgctcactcccctcgctggggaaggacacactcgctggcgtcagcccggccggcctgggaagtaggactaaggacccgaactgcaaccctccacaccagacagcacagaccaccccaaggctgctcaatctgcccaaagccaaaagtacgtgggggatatgggtccaggttggggtgcttgggagagggccctgggagaggggttcagacggtgcacactccaaaggactgaggcggcgccactgtgttaccattttattgagtgtctaaggtaaagacacctttgaaagaacactcccggcttctatctgggatgggcaaatcagcctgaagagtcacctgctggatccctccctgcaggccctgtcgtggggcaggtacagggactccaatccatgtgcctccagctccaacgctccccaagtcctggagcctcccctgtcaccccagtgcctgaccagtgaatgggtgctgcccccactacagagctccctctggctgaggcagaggccactggctgggcctttctagccacctttcacccctcttgcacacgggaagccccgcaggctcctgaccacaatgggatcctgacgccggagccccttaggccctttgctcagaaggcctctggttattacctcaattctgaacagccaggaggcctgagactgtcacccactttgataaatacagaccgacagaaaggtcaggccattggtgcaagaccccatggccagcagcctggggcggggagaacccgggggtctcacagcccccagcagagcccagctttccttgggtttttaggttcttccccaatgatattttccctttttccctctctacccactttctgccccccatcttctcccctttggctgcccgctctctccctgcccctctccccttctttgccctctttcgtctcccaggagctcccctgccaggacctcggtgccgtggagactgcggggaacctgctctgcccacacctgctctggcccctagacggaagcacctggagccaaccacggaactccagatcccagctgtgtgactgaatccacgccagcctctctgagccaaagctgcttgcagaagggggagatcccagttcgaagactcccgcgcagagcctgtggccctctctgccaggcctcagggtgcctgagacactcacctctctgcctcgcagttggggctgaggctggggctggctgccagcctcagttctgggagcgctggggtcgcctgggccacaggccacagcagctcacctcaggactgggctctctggcctgctggggctcaggctgtggggcaggctgggcagggggctgagctggcagcgattcagagccctggggctgggggctggaatccacctcctcccacacaagctcggtggtgactcttcggcccctggggaaaaacaaaaagatattgctgagatgacctcttttaaaagcaaagcccccctccccatacaccccaagcctgagccctgtcccatccccctccccgggttccttcaggtcaccttgtcaggatctgggcagcggcttccccctctagcccctcccctgcctagagctccctctttcaaagtataagggagggaagaagtggtgagaagtttgcctagaaagggcttcccggtgctgatggagaggccgagacccttctgttggacaggctgccctgttcctgggtgaggatgggcttctgcctggcactgggggtggagggtgcacacgaatggcccgccttgaggggtcatggcacggaatatgaaagcctcctccacctccaaacacccccaccttggaaggagataaggagggggccccagcaaaagccactggacacacagctctgcttgacgaggccagtgagggacggcgtggctgtgcttcctggggaaatgaaccccctccccacagacaccaccctgggtggatcgaggagtctgggtccagggtgcaacagagaaaaacttcatgcatgaatgagcattcccagggaaactgccttggccccagggcgcctctctgtgccagggaggctgggagagcagcaagggggaccaggtgcgccatcaggaggagagaagctaaacctaggggggacatggagggcggttgttgcctctcccggcatttctcctcagtctcctgtccaatttcttgctggtggtcaggaggcatagggaggcaggagggaaggaagctttacctgtaaaatggtgtatatatgtataaataaaatctctgcgccagaatctcgggcccctggctcctctgcaaagtctcctgtttgtctctgggaatgggatgggggatgcaacgggaggaaacttttcacacagaaagactcttcctttcacacttgtgaagacagctgtgtgttcccgctgggaagagcggcctagccctcctcccctacccctcccattttgcttggtgaattagtcaaggaaaacctattttccttgcaaaagcctcagtggctttgtgcagccctaaaggagaaccctctccacaatggcctttcctgcacaccccatccctgaagttgaggctgctctcaggaggcttccctgcaccctccagcagcagaagttcttcccctccttcagaaaccaggatcctggcagctgccccaagctcccggcccacccacgcctgaacacttaaagtgcagcttttctctcacactcaagggatgggagcccagttacctgtactctagtccctgcgcagtccccgcagctcctggacagtggataaagaggaccggggagtcactggtgcccaaggctctctgccgaaactgcctggacgatgatccgccggcctggccaatattagcagtcaccaccaaagcagggggtgccctggctgtggcgtccagaccctctggccaggttgacgtggaggaggagagggacaaagctgaggctggagaaacgaagggcacttttagagtgtgcatgttaatacggcccctacagatgggagagcctcatctccgctgagcatggcacctgctcaaatgccaactgaaatgatgggtttacccctcacctcctcatcccctccactcgtttccctgagcccctccgaatttggggagctttgtgccaacttggtagtgctgaggccgctggggcagctggctcaggcactttccagcaccagggcatggtacattagcgggtggaggtttggcccacccctgacctggcagaaaggcgcctgtgggcgtgggcataagccagaagctccctgccagctaggaggtgggggctatgtggaggtggtggggagtgggtgtagctttacttagagtgacacttggcagttacttgacaccctggaatgttggtggacgtggcactggtaaaatggcggggggggggggaataagggggacaaagcagggttcaagaatcagcagaaaaattggattttaggtgctcccggtacagttatgtactgtgcagttatgtccttccatcttccatgagcaaggtactcagctggggggtttttcacttcactggtcacgtctgatctgacctcagacactccctgtgtggtactaagctctaatgacactgctgcagggggcacttgcaggcatttctggattgggcgattggacaggttcgcagcctttctaattaaagcacagactcaaagctgacagcagctgggtgagggttcatatagaagcatccaccagattggactaaatcacactggaaatttctaacctcttccccaagctagcaaagactcaggaagaggcaaagacgtgtactttccagagagccaccagtccccccctccaacacccacgcaccccaaccaccttcagtgtgattagttttactagcctgtgttgggatttaattgtcccctctccctttttctttcaagccctcgtcttaaatcccttcattagctggaggaataggacatctagtggggacaacaaggatttcagcagggaagagagttagacttgaaggggattcaaatctggcatgtgttgggggatgtctcaaataagacgtagatgccccagagccatgccctcccatgggaggagggaaaatgggatttttcactcggcttttgggtggggagggatgttaatggccctgtcaggtccagagcactgaatgggttcacagtctttccagctaaagcacagactcagagctggcagcagctcagggagggctcagatagaatcacccattggattagatcaagtcttactgggaatttgacacctcttcctcaagcctgcaggaagagaaggcacaaaacaaagactcagggaaagaaacaaaacaaagatacaaggaggtcagcatgaagcagcccttgctccggggctctatggcttagagaccccgtagcatgtgctggtcccagtgtctgctgcaagatgcccaaatgttgcaaacagcgactgccagagccctctggagacacttggctgggactttccaagctgcagatggacctagagagagtgacgggctgacacccagccagatgaagtgattccatgggatgcccccccaaatgaacagtccccaggttgaggaggtgggcagctatggggctgaaagggaagcagcccacaggtcaaactcctggaaacctggagcctcccaggcccacaatggtgtcttgaatccaaactctgccctggactggaattccatctctggatgggcccaggaggagctcactctagtctccaaggctattttatcccatcaggatcttggaacccagggtgtgtaaacaggagaaggagagcagggagaagcggtcaggatagaaagggcccccggggagcagctaagccatggtgccaccgaggcaggactagaggcattggggatcagtgagttggggtgtgagggctgtggccccacagcactacattccacagattttccacgcaagggtctgggggacacatgctttatggagacaggtgagagggaccgcaaaatggacaaaaactggggtgcaggattgagggacacgacatagaaaaacctccttgctccactgcctcttaggcctgggagaggctcagcccacccctgttcatgcatgagagtcttgggaacccccagaaatctgctacaccaagctttcgccatttagcctcttaagtggccttatgctgacacctggcggccatttctagaattacagtggcataacccaaaggtcttgggcgccgcaatttggggcactctggagggggactctgggggcaaagtcaggacgcctccctacagtgtcagggtgccatgggtcctgcacctttgtgtttggaaccggggctcttatctgcttctgtcccggcattacaggactgagagggggcgctgagggaattcctcccttcgggtgtctcctaacccgagggggctgtggcctggtgagcatcctaaagcttagggcctaagccacaggataggtctggaacacctttctgaagcatccgttttgttctaagagaggaaaccaccacattagcatgaacataaaatgagatctattactgagaggcccggggcagaacgttgagaccccctttcagagacagcgtccctaggatgagcccagatgggctgaatttcgttcttaactcgcttccccagccccacccggctccacctgtaaagcggagatttcctaatctggcccgagcctgacaccatgtggccacttgtgagaattgcatccacagcttcagaaagcaccgccagtaaatccatattgccatgaccgtagctacagggccgcttaacaaaccttgggaattgagagaagaggaggaagtaacccacaacctagtcctgaaaacaccagactgtggccccagagccctacaccatcgaggtactggaaggccaggctgcctctgctggggaagtgaggccgtccttcaaaggctatagggccacagcccgaggggctggcagggccaaggggaccactgtgccactcgcacatcagtgcttggaggacggatgggcaggaggggcctgggggctaacccagttcacagccgcgctctgccaacgaccttggacaaaccagttcatgcctcccctctcccttccaacctcacggctacagtggatgggtctgggtagccacctctggcacaaaatcaatgttaataaacgttcgattttatcctccccctgacgtaaagtgacatttgcccctgcctcccctacccacaggtccacaggtgccgaaaccttttttggtggtcatgtgctcagcaactcttcggcaggcctaggcagctcgggagctcgctgcaaagactcctccacctgctccagcaaaacttgctggctggcaggggttgcagtgagctgagatcgcaccattggactccagcctggatgacagagcaagactctcaaaaaacaaacaagcaaacaaacaaaaaacaaaacaaaacttgctgcctgggaggactctggggttttcacagcctgtggcccatgaacaggagggaggctccaggagcacagatttcagcagtgggccggatctgcatccctggcagtgggggcccagtatggacccatcctcaaggcctcagtgccagcaaggcgggagacacgtcttccaggaagcctccccagccccactccctgctaatttctgccttctctgttctgagctctgatggtgcagctgaggtttctccctgccctgggcttccttggatgctgggctgggggttgaaagagctgcaaagaccccttccctgtgatgggcctcagggccacggattgtacctgggtgttgcaggcacctcagagcccctcctgcttgtttttttgattgttttgatttttttgtttttgtttttttgagacggagtttcgctctcgttgcccaggctggagtgcaatggtgccatctcggctcagcgcaacctctgcttcccaggttcaagcgattctcctgcctcagcctcccgaatatctgggattacaggcatgtgccaccacacccagctaattttgtagttttagtaaagatggggtttctccctgttggtcaggctggtcttgaactcccgacctcaggtgatctgcccgcctcagcctcctaaagtgctgggattataggcatgagccaccgcacccagcctctcctgcttgttttactctaagatgtgcagaggcctccgtaccccagccccgggctcctccctcgaggagctgctcctccctccaaggtcccttccacacgccctgtgcatgcccggtagccatggggactgccacttcccacggaggacatgtcagcttccccttgcctgtggtgcccagacctgaaccacacccacggggctgtccccgtgatttgaaggcctgggcacagaaagcagctcacgggtgtactgaagccagaggcgcggctgccgaagggcctgcctctcacagacaacactgagctacaccatccagcagctgaggcaggcagggccttctttggttcccttctgatggatgaggaaaccaaggcccagagatgctaagtgactttcccaaggccacacagccactggcagcagagccaggatgtcagccccgcctctcagctctcacccttcagccccacactggcccaggtggacactcactggccctgaggatgctgagggcccatgacttcttggcacccacagatcacaacctgttgtagaccttgaggccacagctaccccttctttgttgtcgagaccagcccatgcccagccagggggagggacccaggtgctagctctgtaagggtccctggcaagggcagcatgggcagtgctgggctgggtctgcggccctggaagcaggagcccagcgtggcctcgtgctcaaggctgcagtgctggcaggggcctgggacacctcctccaggaagcctcccagcctgctggctcctgcctcctctgctctgagctctggtgctgcagctggagctggcatggggtgccccagccctccctctctccctgagttctcaggcaactcttccccctgcctggagcccagccgcctgctccctccttccccacagctgggcctaggttgggaagtgctctcacggagcatctgtcctgggcccgccccccaggtggcaagggaggaagcccaccttccactcacccctgcccctgaaagcttttcttgcaccttgaaggtcagggctcggagggccccgtggaagcagccatcgctggagttggggtttgggtgcctcattgcctccaccatggggtccccaggatcttctcccagccccgtcctcaccacccaccgagccacccatgtgtaacgggcccatgccaggaaccccgcgctctagagaggatcaggggatgcccaaggtccctccgaaactgggcagcagcgggcctggatgtgggcaggtggtggccctgtggaggccgggctggggtgggaccgagctttgaagtgaaggtggactttgaagacagaagggtgcgatttgagtcccagcgtgagcagccgcaagctggcagggccgcggggggctctggctctgttttccaaaaacacagatgggctgggaagggggtcagagagaggcctgggcggaatgtggggcccgcggcgcccccgaggttctgatgactcagcagcctgggccacacagggccacagggagcagagcctccccgaagcccacaggcctgtggacccccagggcttggcctcctcgaggccggtctccatccctggcaagggctgggctggctctgcctaggggtcacagccacccgggtttagacattctcagcccccctgggcgaggagagcctggcaggcaccacctacgttaccctcggcctgagggaccccgactctgacttagtccttgatccatgggcaccctgagatccctgctatcaacctgccttggagtggggactgtggggtgaccttttggtacagccccaagccagcttctaggggcagcctcggggacactgggaggcttggaggctgcctcagcagtccctggggtcagggagagggtctcccaacagcggcagatgggcaggaagtggggagtccaagcgaggtggggtgaggactggggccacctgggagcagaggagtgagctgaggacgcggaggagcgcgtgggaggccggcggggagcttggcgccagcacagcacggctgggccgcgagagggacgatggggtgccgcctccggccggccccactttcgaaggaatctgccttgctgttcctgcggccgaggccagaaacaatagtgggaggaagggcggagggtgcggaggcggcaccccagtgtgtcatctccgcgttcccagaccctgtctacccctgccctcaaacattctttccagagtggacctccctctcctcacggcgctggcggaggggagcgtgggaacgcactaaccctcagccgcctggaccccagctccaggccttcggtgcccccaggtcccagcccctgaagccccctcctcacatagaaaccaggactcgaccttctggcttgagtggctgagggagggaccctcctggccaccgctggcctccagcctcagtagcccccaggggccctggggaccctcagcaaaggccacagcctggtccaccaccggccacagtgggctcagccacgacgagggtgggacggagtccccctggtcttctcaccctagctctctgtgattctaggggctcgcaggtggggctcagagtccagccagaggctttcttggaatattagagacccagaacatttgtcccggccctctgagaaacccaggctggtgagaggctggcctgaggcttgacttaggggccgagactggacctgagcaggccgggggcctctgcaatgcccccaccatcatcatcagacagctcctctcattcctaagccccatgcccttcagagtgcccagcagggccccccacagcccccatagtccctgggagtgcctggcagggccccccacagcccccaagagtgtctggcagggcccccacaggccccacagcccccgggagtgcccggcaggggcaggatgcagctgctcagaccctgggtggtggccagaacctggacccgtggctggtggccggagtgcatcaaaagtgaggctctgatgccatctgctggtcgcacccgtgaatggcggctcctggccacattgctgggtgtggaaaggtgcccatcctggaaacagctacctcacagcctggctggagagagacactggccaacgttcggcccaagttctgcccagggctacctttcccagaaactcaggcttaaacactgcctgtcctggcctcagtctcttccctgggctggacccctgctgggcaccaggacccgaagggcagggggctaccctcagcaccgctgagtccacactcatccccccggggtctgctcaggcctggagagtcctggagacggaggacagtaaatatttgctgccgacaggggaaggcaaacactgccccaacggccaggcaaaggcgccagttatccatgccaggagcagacgcaatctagggggccagcctggaggcagccacaccgcagtgtgtcctgggtgggtgggagcacgtgccatgtgcctggctccaggcttcagtctctgcttaaggaatgtggtataagagtttcctccctgtgcagcatgtgtgaaggcaggacgcccagacagaaggctgtgtgcgggatggcatgcaggctgccctcggtcctccaggaatggacagaggcttctagaggggccagcaggtttggggagacttggggagcagctgccttgtgactggggagcagttagatggacccaatgccagggtgaccgccggggctggaggcagctgagtgcccctgccagcccggtgggcatgtgaaaccgaggctccaaggccaggcaggtctctggacactgaagggctgtcttttagcttcccagaaggggtggagcatgggcagcagcccagcaggcattgcagagccaagctctgtgggcctggctcacatggggtgacctgggggctccgggagcatgcacactccccgccagggcatctggggaccggcacccaaggtggtgcctgacaggagactgggtctgatgctgcctctgccacctggatcaccttggccaactgcttctcattgggcctggggggatggaggggcgatacctcgccctggctgcggtctcccgtgtccacgttttccaggacacagtatatgaggggtggggtcaaggcgctggcgaagacaggcttgggggacagagtcctgggtctcaacaaggtgaaagctagccccagctctggcccagggcagccgagggcaccgcgaaccatggctgcatctcttttgggtgggcggccttgccctctcctgaggcctcaggtcagaggtcccccaggacagaagtcacagaaaatttggcccctcaaaagacactcctcagcccccagcaccagccagtgccagctgccctgcaagtcctggaaggctggggcagctccaggagtccctggacaccaaagggctcctcctgctgccctccactccaacacacggtcccccacagagcactgaccctcccctcccagaaggggcctctgcccatcactccctacggccttgttggccatcagggtcagccagggcaacagcttggccgatggctgactggtgggcagcctcccagccggcccaccgggccccgctttggcccagccccgcgcgagctcacatacctcagctccagcagggcgcccctgtctctacccgtgcgagtggggccggctgggtgttcccatggacggctgctgccgatcccagccaccgcctccctcctcttccggggccagtgtccggccgtccacccgcctgcccagccttggcccccactctggaggcggggctagctgggggctgtgacatctctgggtggaggggggctgatgtggtcatggggaaggggtgagctcagagcttcaggaacagggctgccccagtggccaggtccccagctggagggtgagctcctggcctcgaggcccaagctggcagtggtctgcagccacagcccatgccagccccaggcccagccatccccagcccagccctgggtggagctctcaggaaaggtgcagattggtttggcctgggtggcaggcagactggcccagccacagggtagctagggtcacccgctgacctcccaggccacagtaggcccaggcagcccctaggttctcgtctgcccactaggctgggtgcccagcggagccaccctgtcctcaggggtgctgcagaagaggctctgtgtcaggacccccaaggacctggagccacaacgaccttgtcaccagggcccgtgggcccttctgggtgagcagcaggtctgtagcaaaggaagccagccaagcagccctgcttactgggagggggtgggctaaggggctgcagggggaccctggccctggtctctgcccctgtggccctggcggttccctgcttctcctgggctgcaatcctcagggcctcatggccggggtgcccaaggcatgggttctgaggccctgccaggtgctgccacggtccctgcacctgccccagctcatggtgccatctgacctctcctgcttcctccaaggcaccagtgggtccctcaggtgtctggctggacctgggctggcataagctgtggctgcagacggctgccagcttgggccgcgaggccagggtgtgtgactgtcccggggctgcccagagctggggatagcgggtggctctcggcagcctctccccaccttcccagccccccgccctgcaggaccccctccctcagcccagcctcctccctccacagggactccatcagaaataactctaaaaatagaacctgggagggctaggtggggggaaaattgctggaatgttctcattccctttcctgaacaaggtctctggggactccaagagtccagagctactgaacaagaagtcacttctcagtggccccaccacccctggcccctcagagacccccgcagctcccatactggaccctgagccacagggtgggggcagcaggcagccgacaggcatggccgctttggggagagccactgcatgctgggcctggccggcgttggcacctgtgggcacccagagagcgtggagagagctgggaggggctcacaacagtgccgggaagtggggcttggcccagggcccccaagacacacagacggcacagcagggctggttcaagggctttattccatctctctcggtgcaggaggcggcgggtgtggggctgcctgcgggctgcgtctagttgcagtagttctccagctggtagagggagcagatgctggtacagcattgttccacaatgccacgcttctgcagggacccctccagggccaagggctgcaggctgcctgcaccagggcccccgcccagctccacctgccccactgccaggacgtgccgcgcagagcaggttccggaacagcggcgaggcagagggacacaggaggacacagtcagggagacacagtgcccgcctgcccgccagccctaggtcgcactcccacccatctccagccgggctggacccaggttagagggagggtcacccacactgggtgtggacctacaggccccaacgcccacatgtcccacctccttcccccgccccggggcagcgtcacagtgggagcctgaacaggtgatcccagtacttctccccagggcctgtccccagcatcttccccatctcctgactatggagctgccgtgaggcctggcgacaggggtctggcccactcaggcaggcagccacgccctcctccgggcgtgatggggtgttcgcccagaggcaggcagcgtggggcaccctgtgaccccaggtcacccaggactttacttaacaaaacacttgaatctgcggtcatcaaatgagggtggagaaatgggctgcggggcatttgtttgaggggcgagtggagggaggagcgtgcccaccctctgatgtatctcggggctgccgaagccaacaccgtcctcaggctgagattctgactgggccacagggagctggtcacttttaggacgtgaccaagagaacttctttttaaaaaagtgcacctgaccccctgctgggtggcagcctcctgcccccttctgcccatgctgggtgggagcgccaggagcagggggtggctgggggcggccaggggcagcaatgggcagttggctcaccctgcaggtcctctgcctcccggcgggtcttgggtgtgtagaagaagcctcgttccccgcacactaggtagagagcttccaccaggtgtgagccgcacaggtgttggttcacaaaggctgcggctgggtcaggtccccagagggccagcagcgccagcaggggcaggaggcgcatccacagggccatggcagaaggacagtgatctgggagacaggcagggctgaggcaggctgaaggccaggtgccctgccttggggcccctgggctcacccccacatgcttcacgagcccagccacgtcctccctgctgcagagctggggcctggggtccagccaccctggaatcctgagcccacctgacgcaaaggcccttggaacagacctgcttgatggcctcttctgatgcagcctgtcctggagggctgagggctgctgggcccccgctggctttatagtctcagagcccatctcccctacctctcaacccctgccgcctggcccattagggcctggggtgggggggtcggcagatggctgggggctgaggctgcaatttccggaccatttccctggtgctgggtctgtgggaagatctccttggtcgtcagcacctcttcctcaggaccagcgggtcattagagtcttaaccaggggcccggtggccagacctgtccctgctcacagctgggggcaaatgtctccaggagagcaaagccctcacctgggccactttccacattagaccaggagagctggaggctgcagggcggggctctttgcgctgctgtccccagacccctgtccccacacccctgtccccacacccctgtccccacacccctatccccacacccctgtccccaggacccctgtccccacacccctgtccccagacccctgtccccacacccctgtccccacacccctgtccccacacccctgtcccccggacccctgtccccagacccctgtccccacacccctgtccccacacccctgtccccacacccctgtccccacacccctgtcctcagacccctgtccccagacccctgtccccaggacccctgtccccacacccctgtccccacacccctgtccccacacccctgtccccaggacccctgtccccagacccctgtccccaggacccctgtccccacacccctgtccccaggacccctgtccccagtcccggatggcccaagatgccgccatggatgggccaaggtggtgggggtgggagagtgggagtgagggaggggtcccctccctgctggctgcctagttcccaccctgccttaggacagcagccccagctgaggccctcagctccccagggtggcagaaggagggcatgacctggggacctggggacaagcagcaagtcctcagcaggccactcggacctcatcttccgtgtgatctgggggtggcggcaggactctgggggtgggcaggtgtgggaagctgtgcactggcccagctccgtcctggccccccaggcaccctctcagcccccactcctcttctgggagcccatctcccctctcctggccaggtcccatgacaccatcacccccatagtgtcatctgggctgagcccctggggtacacccctccggccctcccagctccccagaacaggcacctggaggtccagcctgacccatggtgagggggcatgggctccgagccctgctgcctgcagcccctacctgcctcttagcaccaggggcaggatcaggaggtcccagaagcaggaggatgagaccatgggggcaggcaggttggagtatcctgtgccccggcccctcgcatccctatgtcccaccctggcctcagcctcggaacctctcggggccgctctgcacacacccagcctttggctctcctgccccgagcgggtttggtagtgggcaccagctatctgcaggacccctcccttccgccctttccaccctgagccatgccacagcaggacatgcggtggctgccccaggacgccacagtgctctgaggcccggcagctggagaggacatgggtgcctccttgagaggagtgtgtagggagggaggctggatggggggagcccaggtaggagggcagagccaggcgctggcagggccggggggaggcaaggcaggcacttccccagggcttcctgggggctcacagcccttcagagacacccccagctgcaacctcaggggctgggcactaacaaggtgtgtgaggaacagactgccaggctgggaaggaccaccatgcccaggagggccttcgtggatgagtaggagtttgccagtgttgtcggccggggagctgagatccaggatcccagcagcgtgtagtggggtggctggagggaggcagagaccttgaaggccagctggtgtcccagcaccccctgcaggatgccctggggctgctctctccaaggtaggaaggggacaccctggccggtcaagcctggagggtgttgggtgctctctctggagggcaatgtccaggcccctcgagtaagccaggggcatcttacagagtctgaaatccagcccccatcctgcctcgctggggagacaggcccagaccatctgcctgggcaccagctcagccagaccctccccatcagcacacatgctgggggccacactgaggttccccttggttcgcagggcctgctccgggtgggtgagggcatcagggcagctgttcctccatccctgtttctctcaagggctgggagccctgtcagcagggagggttaggcctgcaggcccacctctgagaccacccccagccagcacagtttgtgacccctgctccctgccaggcctgagagaggccctcccactgtcacgtggctccccaccttgggagggcaccccacggagatggggcagctcggccagggtgcccgagcctctggagctgcttggggctcagagctgggcggggcctcagggtgagcggggaaaccaggcccggaggggccagctgcctggccagggcggccagccatctcccagaggaggaaggaggccagggcgaaacctctgagtgaggctggggtgggggtgtgggagtctgaggatcccagggtctgtctctgtggcacagatgtggggccaggcaggtgtagagaccacagtttcttttattgtgacggtgattggggcagcagacagtgtcagggaagggcggagggcagtgcagcagcccccaggaccctgggagccaggacaggacctcaccacaggcagcacaacctcaccacgggcacacacagctgttgcgctgagaagcaggtgcaggggcagtgggagcctggcagcagggagggcatggggggcacccgggacccagcccctcaccagggcctgagctccgggacagtgcaggaccaggggaggttgggaagggccctcagggacgccgtgcacctagccaatggcactcagcgcatgggcaagggtgtccagctcatcctggacaccctccagggagcgccgcacggcctgggggctgtccagcacgtcgatggccagcgtgtacgggtcgaacttcacggagaaggggcgctggatgcgtgaggcatagctcctggggaggagagcggcagagccctcgtcaactggcgggcagagtctgcagcctccaggagaggggaggccaggggccgcgtttccaccttcacagtggctcagagctcccagggcttttctgagccaactggtcacaggcgggacactgaggcctcttccagggctgggtgagggggttcatgggggagataggctaggcgccttttccactagagactgccgggcaccccatccctccctgaacctccactgggcctcctccaggaagctttccttgaccatatccctaagcctgtgggtggaattcagcacccctgtccgctggacacatagcccctggcctcagtttccccagtgcataagaggctggagggaaaatgatgagaccttttatgaggatgaggctagagggctttgctcccctctcctgacactctggtcactgcaccaaaggcccccagccctggggaccccactcccgccctgtcccccaccttgactctgtctatccccctgacttctccccatcccagggcagggggccgggacaggttccacaggacgtcctcacaaagctcaggctctgtcagcacctccaagactggccttgacccggccacccagcagcccccagtcctgtaggtctgcccctccccagacgctggggtccttctcacggatggtgtccctgctgtgtgggggctgctgcaaccaggggtcggttttctcatctgtgacctgggctcacaggtccagccctgctcaaggccagaaggaaggcctggctggcccagtttgggggcaccatggggggcttgccctagcagcctagcccacctgagcttgtccttggcgtcactgaagctctcagacacgaagtagactgactggtacgtctggtcttggtagggctgcacggccgcagcctcagggtcgaaggcccgaatctcaggctcctcagacaggcagtgctggcaggaggccaatggcatcactgactccactgcacccaggtccccgagggaactggggcaccgtggcctgacgctgggtgggttccttgggtagagtcacccccatctcccccgccgggccttcggaggcctgggataatgtggggtgaggactgggcagagacaagccttctcccaaacagagcctgagtcctggaggtccaggcctcagtttcctcccactgggagcctgtcccctccctgcaccgtcccccagccctgcccctctgctgggggctgcagcaaggagagactctcaccaggagctccccgtaggaggacagcagcccggcaccataggccttcacctccccgttctgcttacacagcccgaactccaccgtgaaccagtacagctgcggggaagccgggcagcatcagcccagagacagctgccgcccaccgggcagcccctggtcacccgtgaccaggataccacccccagggaggccaggccaggatgcaggcaggccagggtgagggtcacaattcgtgggtggaaggagaggcctcagcctggacggcaagagggtgaggcctggattcagacccccaaacccacaccccaggccctgcagggaggggtcaacccaccgtggacagcttctcaatttcctcatccgaggcccccagggacgccaggccaatgtcctgtggagcagggaggatgaaggatggggagaggcagccctgggtcatgctcgaggtgggggcaccgggggtgtcagcagcccctccaggggtctctgggacacttccctggcggcagagaccttccctggccgcccaggatccgcacctccaccgggcctcctcctccaggcagccctccttgaccacattcctaagcccgtgggcgccgttcccaggtagccggcaggtggcagcacaggccgtgggaggctccgctccagccccgccctatgccgcgcgaccctcggggcgccgagcctccttggcggggcccgggagcaggcagcacacttcacccacccgcacatcgatccccgcccgcccccggcgccaagccagcccctgggtgaccccggctccctccgaggccgcggcgtacctgcgagaactgcgcgaaggtgcggtcggccagcatgggcacgtgccccagcagctcgtggcagcagtccctgcgcgtaggagggagaagggggctgaggggccgcccgtcgcaccccccaccctcgggctggcggccagggcgcgcactcacggctcaggggagtgcatgggcgaggacgcgtggcggatatactgggtgcactggaacacgcggaaggccaggctggccaggaagtcccgggcggacagcaggccggccacaggccgcagctggaagcccgtgcgctctgcaaggggccacgcgggtcactgccgagccgggacgggctggagccgcgctggggtggggcgcttggctgaccatccccggccccccggctctgcgcccctcccgtctgggcacacccttcaggaagcgggagacgtcctccagctgggggatattgtcttcccggtagccgctgaagcgctccagcaaagcaaaggcctccaggtgctccccgcaggcgtgcgtggcgtagaggcccttcagcgtggtgtagacctccttcctgcgggcagccaggctcagggccctctaatgccccaccccagtgcccgaaacccccctcctgaactgtgggtgcctctgcctgcctgagcccctaccaacgcaggcctcttggggacccctgaagacccaggcccccgggaggggcttttgctggtggctttagggaatcccaggggatagggggccatgaggggcggtccctcagcacactggggatggcccgacaggatgggtagcctcttcctcccaacccaacattctgagccctgcaagtccctcttcttcccggccttagtctctcctgttgtgccaaggtccctggaggcggccctcacacgccaggattccaggaggcatcccccgggctcctccccagcccctagctgcacggaggtctcaccaggtggcaatctcctcggcggtgtactccacacggggaatcgggtcgccgctggggagggggccagtggtcagcaggtcccctcggggagtgagaagggcaggagggagggagggagcttcactgggcacaggtccacacccgcctagtgcagcgaggcctttgggttggaggatggacaggagggtgcaccccagctgactgtgccgtgagccggctatgtggcctcggcaggttgctctagcccccctgggcctcagtttccccactgggatttggggacatggaaagccctggagcagagctgcctggcaggaggcactgatgctggtgacaagatgggtcctcccctttgtccttccctcccaccccccaggtccagcgtcagcctgcaggacggagtctgggtcccgagcgcaggggcccctcactgcctgtactggaaggcgatctcagcaatcagcttcctgcgctggcggtacacctggtccgagaagccctgagggcagaggggatgcacgggtcaggaggctgtgctggggtgggggcacaggccacggaggctcctggagccgacagactcctgtccagggttgggctaagggtaggggatgtgatcaggggcaggaggcctgagtgaggggcgcaccactcaccgggtggtccaagtccaggtcagggtcgaacttggtgaccaggtgatgacacttgtccagctctgacacttttcttgggaaccaggggactttatgggtgatggaggaagagatcttggtgagctcggagccgtggggctgtgtcacccaccttgaagcagcctcccctacaagacttccggggggcagaggcagccggggctgtgagagctgcggggggatcctggagtggccccaggcccggacacggatgtgtagcaaaacggggtgcggagtggagcccgcagagagggaaccaggccaccaccacgtggtcactgtagggtccccctgcaggagcccctgcaccccagcctctcaaggtcatttggtggccctcaaggacagaaaaccgcctcacccttgggccccgcggggctgcgcacgtcctctgacacctggcgcacaccactgagcagggcggccaggtcccctcggcgcacctcgaggcgcacgaagtactccaggtgggggcccccagctcgcggcctctgggcgggccgggtctctagatggtggattttggcttcaaacgtcttagggagcaaaagcaggaagagagagagaaggagaaagagacagagatggagagagagggtggggtgggcggggaggaggcacatctggctggctggccaggccctgcccttgacttttgtgctagcagcacacagatcccgttcttccaggctcaggtcagctgtcggccaccaggccagggtttgccactggcaagttggattttgtgttacgtgcctaaccaggagttgtcaccgcttgaggcttaacctggttctgggcggctcggtgtgtgtgtcccaaggccatgccacacagtccggctcctcagccactggtcagaaggtgcccccaaccctggtggcctcatccaggtttgtaggatgggccctgagtctcactggcccctgagcgtccaggacactggccagaagggtccgctccacccccacctcctgttgcctagcaacaagggcggtgggtcgcagtggccctcgggccacaaaactggctctgggagctggggggcggggagtctggctttaatgtcatttgggagcttcttccgggagctgggtcacctgcctcccggggcacagtggggccggagtgactaatgcaatcagtggtcacctgagccactgtgctgggtgggtgggagagggcacactgccctgcccctgcctcttgtgctgccctgctgggagccccccacgtgggaaatggtgggtgagggggatccaggggatgggcaaggcaagaggcacagtggggcttggtagcctcagccctaggggtgggctcaggatccctcaaaaacacgggggtgtggctagatgccatgggggctgagctgaggcctgagactcccctgctgcatcctgtgccggcctcgggggcctgggcagctgcacctctgctatagaggggtcaggaactcagcccacacagccccacccacaggtgaacttgccccagggacacgaaggccaccagctcacctcaaacaccttcacagctcgggacagcgccgagggcttggtggccctcggggagaagagcaggtttagcacggccttcccctccttctcctcaaaggccacagcctccagggggtccccgggctccgaggggactgcagcggccgctgctgccaccgccgcctcccgctccttgcgggcgtcctcgatgaggctctgcctgcgcccaatgaaccgcggggactgtggggacaaggggcacccatgcctcctccacctgctgagacccggggacctccacccacagctggtcccacagtcgggcagcgctgatggcacacagaggcaggggatgagagcacgtttttgagcgcctactgtgtgcctgctggggcagatgctagccgaggtgcctgcgggcattgcacgcccttcccgatgggggcagcccagtcagaagcagtggtggtgggggaggagtgggggctgggaaggtgctcgcctgctccccactctgtggcgagcagacagacagagacgctgtgtcactcatccccaggccaggcgctaactggattagtgatgggaagagggcgatgtcttgatggacagtggcatcggctgccggggagggaacggcagctcaggaaggagctgcccccacagggccccagtgaacaacccccctaccctcctggctgccgcacaggggaccctttctcacactcccatcaggacacctgtcctcgggccctgcccctctgtgccaccccgcaggcgcccgctcctggctgccttgtcatccctccaccctttgtcatagctctgggcgcaggtgtctctccctgggctcagcgcctctgacccctcgatcccagagccgtcccaggcctggacagagggggacttggcagacacctggggctcatcccttggagctgaactcccaagaaggctctgggccccttgtaagagaagaatcagcttcatcctgagcttccagggttgtggaacatgaaggggagcagcagaagcccctcccagagtcccctcttacttacccttggggtgggggtgtaggatgcagctggggctgcagttccaggccacggagagcctgtgaggctgggccccggggcgccctggggaggggatgcctgatggggagcctggtgggggagggtaggggagggcgggggaggacgggggagggcgccctgtgtccctgagaaggtacctggaaatgacactgctacaactcacaccacatttcaatcaaggtccataaataaaaacccattttaaatgtgccagggagcccaaggttctgagtgcccaaggaggcaccgaagacccctcctgtgggctgaaaagctcccgattatccagcctggcccacacagtcccctgtacacagggcttccgagtgcaggtcacagggaacacagactccatggtgaatgaatgaatgaatgaatgaatgaatgagggaaataagggaggaacaggccaatgggaatcaccccagagcccagataccctttgaattttgccccctatttgcccaggaccccccaccatgagctgctgctagagcctgggaagggccttggggctgcctccccaagcaggcaggctggttggggtgctgactagggcagctggggcagagggaggcaggggcaggtgggagtagggtgggggctgggtgcagcagccggggacctctggccatcttggattttttggatggatttgtttccacattccgatcgttaagattcaagatgaaacaagacacagagacccacacgacccccgagagaggtcggcctaagaggggcacacacagggacaggcatcacctcaccctcccccaacagggactcaaacaccaggcacaggggatgccgctgtgcccaggcctccacatccacgccgcgtcccaggggtttgcatggaccctgagcctggggctgccagccaggctggggagtagcagaggcagctggcaccagccctgggctccggtccactgcggccgccgggcacctacctgccctcttaccatgatggcctctgcctgcttggcgtccagctcagacacggccctgcggaagcccttggcctgtggcgtggtggcgtcgggggtgggcatggctcagtgtggaggtccgggctccgtctccacagccctggcccagcagcctcttataagctgagctgacgtcaaagccccctctgggtcccccaccttcccctccttacatcccccacccctgcctgctgtgcctgatggaggcgggggtgggtgaggaaggagggaggcgcaggagaaagggctcgtccgtggaatctaattgccttcactccccagccctgtctgaatcatcctcagcccgcgggcttgcggggaccaggggctcgtgctctgcggggggctgagacagccagggtccccttggccccacagccctcaagagagcacacagggaggggctttctggcagcccaggggcacacttttaatgaacaccagaacctcgtggcagaccgacccagaaagccccaagacggggaatccagcctccagcctcagatgtcaggaggcaatttgtttgcttctccagaagattccaggccgtgtgtctcatagacgtggttcctaggagtgccatctgcccacagcccccgggccctgcaggtgtggcccttgcagcggcttcccaagctcgccccgtggggtccagaatgtcccaggagggcccacctgtccagtgtggaggaccctgggaggctgaagaagacatctctaaggagacgccacgcgtttccaaatggctgccacctcctgcatcacagtccccaccagggttgccagggcgaccagggccagggacggcttccacccaccccactcagcccctctatggcccactgctagctcctggcttccctcggggtcctgtggccccttctttaaagagcacgcacgtccctcagtgctgagggccctgatgccttccccttggagagacctttgcagtttctcctctaccccaccaggccccgggttgagggtgaccctggggtgacctgagaactcccttgaggacaaccccagcctagagcctcccccaagttccatgtccgccccgcaggcacccgcatccagcccacgcccactggcacctcctgctcccagccgctgccccacccagggagagtgatgcccctgcccagggtggcttctggcccttctggtggaaggggaggcctccccatccctctggggtcagcagagatggccagagcctgccttgacaatgctggactgtacagagggaaggacgtggccccagagtgcatggcctgcggctgaacgctgccaccgctgtccctcctggagaagaaccgtttccgacagggcttggggcttcctgtatctgctgggctttctggtgttggcagcccaagatgacaccctgggcccagcaggagccagaagccctagacgctccctgacttctcgaaggcctaccccggctggtcactgtggcagccagagctggcatctctcagggcccactctgctcctgtcagctgtgggactccccgctccccgttctctcttcaacaatagcccctgggacctttcctaaaactgcttcagccatggcatccctgtcccacacccctccgtggctcctcgctgccctctgcaggcaggctgagtgctcagtcaaagcaaagggaagaccccccaacccttcccacttcctggcccagaaggatttggggctccgtgatccccggtttgcagtgtcattcctcacccacctcttatccgggtgaactcctatgcatcccacaaaacccagttccgtcgctgctcactctgcaatgcctgccctttcttgccacgatattaatgcccctcccttgcgctcctctggaacatccctgggggcagggaagcctaccgctcggcccctgctgtctctcagcacccagtgcagaccctgtcctctctcggagatgctatgcccctccacagtgttccccaaaggcctccacctcctgtgggtcctgcccacagtaggtctgggtgcctgctcagaagggcgttggagggatttgcctccaagacctcagcctgaaggctcagcctctggcctcgccctgcggcccgtgagcttctgtcacccagggctgaggcccacccacctgagtccctggtgatggcccttgggtggcccagcctccatgcccagtgtccaggcctggtgaagctctgcatggctcccccgagctcccctcaaggtccccagaaagagtctcatttgcctcccccagggtcggctgctgaggatccctcggtgaggcagctccaggccccccagcaccccgccccagctctgcccagggcggccccagtgctcaggtgcccaggccaggaggagagacatgcctgatgaacaccacgccggaggctcatggcccacactgccggatgtggatttaacctttcagcaaatgtcttccactgatacaaatattgctttttaattcggtttcctgccgggccagttgtgctttcatggaagcccgatgggaactaagcttactagactcttccttggggccaggctctctggaggcaggagcccaggccaggtgctgaggctggggaggcccctggacccctgtggaggtgagtgctgccctcaggtgcctgcacctgccctgcctccagcctcccgccccaatcaggcagcatccatccctgcctatccattcctgggaagcctgtcccacacgccagccccttcagggccggggaaccatgctgtaccccagatccaaggcccctgttggcacagaggtgcccccgactccagtcctggccctggccccgccctcctttgtgccgtgcccctctccgattccagatggtgagggtatccatggaggccccaaaagtctaccctggccagcctccccgctcccagcccgagggtacctctccagtctggaccacccatgattgagccatgccccgtgtcacccacctgcctctggccctctccagagatgtccacaaacaccaggaaggctccactccagcgcccacgggacgaggcctctccacgctgggcacaggcctggagggagcacacggctggcccctggtcttggtagagctcagtgctgggtcagcctgcggcatccacgttcgggcagctgaggtgttcacagacccattctgcagatgcgaggactgaggttctgaggtgcaacttctcaggggtcatgcagtgagtctccagcccaggtttcccaactcccaagacactggtctttcctttttttctttttttttgagaccgagtctcgctctgtcacccaggctggagtgcaatggcgcgatctcggctcactgcaagctccgcctccccggttcacgccattctcctgcctcagcctcccaagtagctgggactacaggcgcccaccaccacgcccagctaactttttgtatttttagtggagacggggtttcactgtgttagccaggatggtctcgatctcctgacttcgtgatccgcccacctcggcctcccaaagtgctgggattacaggcgtgagccactgcgcccggcctgacactggtctttcaaagatccggtggcatccatcccctggcactgtggggctcaggaacctaggccacagggaacaaatcagacaggctgctgtgaccagcgtcccatctacagagaccccagagggaagggcagagctgggacagggttctctggaggccgaggtcacgccccaagagacccctggggccagcatactggcccctgggaaggagaagggctggagcggagccccaccagggggggctatgaggtggggccaggagtgagggccgacccaggccagatcagagacaaaacaggtgaccaggggagtgggggccccgcagaggtctgaggagcccttgctgtcccctccattgcaccaggctccaccttcctgcacggagccctctgggcttccctccataccccaccaccctccaccacttccgccgtccctgtggttacagcccctgccaccatggccgtaaggaatgctgagccagctccacaatggagcgtgttctctctcaacagcctctcagcccgaggcttaatcacccagattaatcacccagcacgtctgtgccctgggactggtgcccactccccgcgtggggcagggtcagagtgctgacttcgacctggctgtgaggctgctccgcccacagggcgagtctctgaggccaccaggcctgctccccagcaccagccttgcccaccacgggcccttcccaaatccaggcctgctggaggagcccagccatgtgctggggaggagcccaggaggtgttctgggtcccctggctgacaggcatcgccctgtggctctgcagggtctagccatggcctggctgtggtgtgcacagggctcaggtggccctgtgatctttgagagccagcatggtgtcctcttgcaagtgcctaggcaaatgcaggcatctgtgtgaggcacacacacatgcacacatggggcacacaagcacacacacaacactccatgcacgtgtgagcacccatgacacaggtacacaccacaggtacaagcagcatccacacactgcacatgcaagcacactcacacatgacgtgtacatagcacacatacaggcacactcagacataacacatgtgtgcaccacacacatgcacacacagatgcatatgacacatgcatgcatatatgtacaagcacacttacatggcacctgtacacaccacacatacaagtgtactcatgtacacgatacacatacgatgcactcgtaatgacccacggacacaccagatgcacacacggatgtgcatgcactacacaggcaaacacactcatatatgacacagtacacacaacatatacaagtgtgctcatacatgacacaggcacacaccacacacgagcacacactacacatgtgcgtgcatgcatgacacgtgtacacatcacatgcacacacacaggcgatacaggtgcacacgtgtacatgcacacacacacacacatgctggagcacacactgcccccccgcccatgtctactccgcagttctctttatagcccggggtccccagggtccccagagatgccccctctagagcctggctcccagggacaccggcctgcagcctcccagacccccactcacatttgggagacagtgggggacctcctgaggatttggggtgtcatgccaccctgggctgtccctcagttcccattgtcccaagaaggcaggggacagtgagtcctgcgtcctcccctcacgccatcttgccccgcctggggtgcagggcctttctctgccgtgtaaggaagcagctcccctccatcccccaagctggaagaaccaagacgccccaacacaggacagaatccgccgtccctgtcagacccaaatgccagagcaattagccctaatgaggccatcagatggagccccacagcagggcgggcggagcgcatggacgaggtgggccccggaacagccgccctgccagtcgatcggatgcacttagggataattgggtgtttggaagtcaggcccagagcgaggccggcagagcaggcaccacgcctccttcgggctctgagcctgtgggctgcctctcctcctccacaccctggacaggcagccggaccctccctgtcccccacagacggctccctgccccccttctgctactgctgctgcccacctggggctccactttcccttccccaccaaatcctgccaggccctcaggcccgggctgccctcctcctccaggcagtcccccagtggcctcctctctgagtccctccagcctggacagccagtgctgtccttccatccttgttgcctgtagggactgcctcagtgttgagacccaccatgtagggggccgaaaagagggtcctgactcagccccttgggccctggactcagttttgccatccacacagtggggggcatcagggattagcagttgcaggcccttgtgggaggaggggtcagccttgagccccttgtgtgtgtgggacccccaaaggcccacagacacagaccagcgaaaactccaggccaagctctggtgcgtgggttcccaagcctggctgcacacacaaccagggtgctctcggcaattccagcatctccatacccctggagcctcttgtcctggtgtgggcttcctggtgatgtgggccagccaggtatgggtggaaccgtcctactccccctccagccctaagcctgagccagcctgagtctggcatggagctcctggagccaggtgagcagtgaggggtgcttccagggaaggggatccagtggccagagggtcctgtgggaccgagtcgggcagaggtggaggcagagggagggaaagggtacgaagggggcaggttacagagccaagcaagagaagtcaccgtggtccctggcagccaggcattcagctggaaggaagggcatccgggtgggcggggtgcgcatctcctacccacagggcatctccccagctcccagcgcccctcactgctcacctggctccaggagctccatgccagactcaggctggctcaggcttggggctggagggggagtaggacggttccacccatacctggctggcccacatcaccaggaagcccacaccaggacaagaggctccaggggtatggagatgctggaattgccgagagcaccctggttgtgtgtgcagccaggcttgggaacccacgcaccagagcttggcctggagttttcgctggtctgtgtctgtgtgggagacagagtgtgcattcaagggtgtgtgtgtgtgcgcgtgtgtgtgtgtgccaggaagcatgtgtgggagtgcttctctgcgtgtacatgtgttgtacatgcttctaaaattattcatgtgagtgtatgattttatgtccacatgcatgcatgcgtgtgtttgtgtaagtgtgtgtgtgtgtcctatgtatgcatgtgcatgtgtgtgtacagtaggggcttagaagagctgaccagccattgatatggaacaaacagggtgaccccagctcctgtgtccctccggactctcacacgacatcatggccaaggtccccaccggccctgagttcctgccaggtgctcctggtttcttgcagacccctccgggcacccagcctcgcccccatgccggtgactcaatcagacctccggtccccaccctctgccccctccccctggctcttgacagcctctgacaaattagtcgagtgaaaagcaataagagcggcattcagttctcattagtcactcaccgaggcggcagctgtgctttgacagcaaatcacatctcattgcaaggccacagcccgccctggccccccagcagtgccagtgccacgggcttgggtgctagtcacctggcctgtggcagggagaagatgtggtcccaccgctgctctgagctgaggcaggtccacacccagggctcatgtgcttcattccatctgtgctgtgactccccttcccagccacacgtgtagacttggaggccccacctggggagaggagccccgcctgtggcctgcacggccctgggctgcgttcacaggggacctgggcaggcagctgcatgcatggaggatggtgggaggcactggggcatttgcccacaagatgcagactctgggaggggaggaggtgacctcaatgccacctctcccaagggcgatcagaggaaggaggcccagcttggacatacagggcctgaggagaggggccttggaggcagccacatacagacatggaggagaggccgcacactgggtcagagccggggaaacagaacaggggtgcggaggaccccttgcatcacctaggacccgtctggccagccactgtaggctcctctgcttggccccacggcctcgccagggccttctgtggccccgcccctcttggccggctgtccacacaccctccaccctgggggcagctgggctcagatttgggagcatcctggaacagaggggaccccctgtgtgtctcctgtccctgaatcctgtccttcccttctgcacctgcctgactttgggggcctgcaagagcaagagcccctcgcccatggagttcacctcctgccaccctgtgctcctgagggcgggaagggaggagcagcccaggcctctagttcttgtttcagatgagggttggacgtggctgctgaggtccccagttggccccacgctgacactttacggacaacacggcagagacccccaccgcctgagagaatgcaaaggtcccactgcggtgagatgagtctccagggggcttggtaacgcttccatgggcaactcgatcgtaaacatccttattttccctccacccgtgctcaggagaaacgtgttgctcccttgggctctggaagccctgagccgatgggcagacctggagggaagcccgcaggtggcctgctcaggcagtggctgctgtgaccgccttgtccaggggctggtccagatgccctaggttccccgaaccaacatcaccacccccccatggccgggtggccccctctctcgaggactcactgggcctgcaggggggcagctttctctgcccccacccgtgggctgctggtttgggcctggaagtgcgtccgccccactccggccaagctcagtctccccactctcctcagcctgctaccccatgggaaccagcccgggctggggctgaaagaagagcccctggccccagtgagaccctctgagcccctccccaggtgccccgggctggcccagcccaggtcctgagcaggagcaggaaggaggaggtgggcgcattcacttcaggtacctctgctaatcccggggctcggaggagcccccacccccggctgacatttccaggccgctgcgtgccgctgccccagccgccgtgatatttagacagggcttgtttgccatgtgattactttggggcctgggatgaactctaccaacacctgagcttgtccgctttgctccaaagcttgtttttaatacactcgctgtcagctaagccggctccctccagctgtggggtccggtcccctcctgggccagagggaggactaagcccaggttttcctcaggaagacagatgcctcctcactttccacactgagggcaggtcccaggaggctggaaggctccatcgtccccacccagcccccaggtgaatgaactcactcattcactgattcacgcagcaagcatttcctgggtgccctttgggaaacagcacggaaagggaaacagcacggtcccaattttggaggctctcatagtctgggggaagggaggcccacggtcctcacatccagtacagccgagaccctgccaggggcggccagggaggtgtctggaacagccccctccaagtgggaagcacatggcccctgtccccaccccagcatggccttgggggtgggggacctgccatgcttcagggagggtgaggccagtggccagcacagcacagttcggggcacacaatggggaggtggaagggctgtggtgtggccacactcccctcaccccacagtctccaaaagaggatttaacttctattttttaaatgtttattttgagagacagggtctttgtcacccaggctgaagtgcagtggcttgatcatggctcactgaagccttgacctcccgggctcaagccatcctcccatttcagcctcccaagtagctggagctgcaggggcacaccagcacgcctggctatttttaaaaatttttttgtagagagggggtctcactgtgttgcccaggctggtctcaatctcctggcctcaagtaatcctcccaccttagcctccccaaattctgggattacaggctcggctaccacacccggccaggattccaaatccttgcaagttccccagattctgggcctggggagcctcccgggatcttctgggcctctgttctgtctgccaaggctgctttctaggggaggaaaagtaaccagaaaccaggaggcctgagctcctggccagcaggtctcaggaaaactagggcctgagaagcatcaagagccctgtcacagagctggtggggccacaacccaggccactcccatccccaggagccaggagaaactgggcgggcccttgggatgaagaactgtcaccaaggctgctgggccccccaccctgtgcaatcagattggggagcgagggcgtcccggagatggagcaggtggggcagggtgtggaccctgtgtccctggggccctgggggccacaggtgtagggagacaccttggtctctgcacagcagccatagtggcttctggctccttccctgcactgtcagcctcagcctcagccagtccgggtcagtccgggccaggcgggcagccaacccaagaaagcccctactcgtgcagccgaggacacagagggggcaaaaactgcatccagggaagaaagggctgtgggcaggtgccacaggccagggctgagagggcgggcaccctctgtggagccgaccttggagcaaggctgcccgggcaggagtctcccagcgcagggcacggcccatgcagaagcttccgaccggagagctggtggcacgcccaggaccctccctcccgccagggcctcggtccagacccacccgtcctcatcttaggcagggcttattggccgtgcgattactttggggcctgggatgaactcagctggacgcctcagcttgccgcctgtttttaataaagggtcccccaaacaggggaccttccttctgccccgcccccgccccacaggtccccagcagcggcacctttctgcgtgtgtgtgaccgattcgttcacgtcgactcctcccctggacagaggcttctggaaaactaaagttggccccttggttccccccttgccaggcagggctggccctcagagcctggtggatgaacagaccaggagggaagtttgggaacacccggctcagagatgagaagagagggtggatcagccgccacatggcaaagccatgggccagctctccctgccacggccagtggacccgggacttgggttctccagcatgggcccaggcggctcggagcaggggctgcttccctccggccctttccccgaagcccgctcccttctccacccccgtccctgcccactccccgcaggccggggtgcacttggagccccgaggacctccgaggctgtcgccaccctcctctgttctgactgctttctattactgggcttgtaaaatgattattgttttgctgtggtaagatgtacataatataagatttacctgttttttttgtttgtttgtttgttttcgtttttgattttttttttttgaggcagggtttcagtctgtcccccaggctgcagtgcagtggcacaattttggcttactgcagcctcgaacacctgggttcaagcaatccccccacctcagccccccaagtagctgggactataagcaggtgccaccacatccggcttttttgtagagatgaggtttctctgtgttgcccatgctggtcttgaaccctggcactcaagtgaccctcacacctcccagcacctcagcctcctagagtgctaggcttgcaggcgtgagccactgcgcctggctaaattttaccattttaaccactgttcattgtccagttcagtggcattaagtacattcacatggttgcaaaaccgtcaccactgccatctccaggactcttttcatcttctaaaactgaaactctgttccccattaaacactcgttcttcagctcctggtaccgacaatggctctctgtctctacgcctgtgactgccttagggactgtgtctaagtgggatgctgcagtacctgtgcttctgaggcttatttcactcagcacgatgccctcggggtcatccctatgcagcagtgtcagaattttcttcctctctaggatgggccatcttttgtccattcattcacctgtcaacacacacttgggttgcttccgctttttggctcttgtgagttctgaacctatgaacgtgagcatacaagcatctccttgagactccccctctttttttttttttttttttttttttttttttgagatgaagtctcgctctgtccaggctggagtgcagtggcgtgatctcgactcactgcaacctctgtctcccgggttcaaacgattctcctgcctcagcctcccgagtagctggaattacaggcatgcgccaccatgcctggctaatttttatatttttagtagagacagggtttcaccatattggccaggctggtctggaactcctgacctcatgattcacctgcctcggcatcccaaagtgctgggattacaggagtgagccaccgcgcccagctgagacccccctttctgtatacacatacacacacacatacgttttttaagagatggggcctcactctgtcacccaggagtgcagtggcaccatcatagctcactgcagcttcaaactcctgggctcaagcaatcctcccacctcagcctcccaaggagctgggaatgcaggtgcgcaccaccacgcccagctaatgttttaatttcttgtagagataggggatctccatatgttgcccaggctggtgttggactcctggcctgggtgatcctcctgccttggcctcctaaagtgttggaattataggcatgagtcactgcacccagccttctttcaattcttttggggctagacctagaggtggcattgttgggccatgttggaccattacacactccccccaacagagcacaagacttccaatttctctacatctatattatttttaattttagttacatgagcaacagattctcctttgaacacacacatacacacgtgcacaaacacaaatataaaaaggtgcgtgtgctcctggccccccagcctggatactggagggtgagcccctttggggaggagggaaatcatgagcttatgagctctgggagcccacattcatgttcttaggaatgccccagcacctctcccgtcacactccgccagcgcgacccaacagcgtctgtcttccaggtcatcatccacgcccgacattacaaagcttgaatgacacttcagcggcatctcaggtccgcttgcttcccgagcatctctacttctccctctctcgaacgatcccttcacttcctcccctcatcttccctttggagcttacacttttcctgatgagatgtgggaattctttacgcattcccgacatgaatccttttcggcaggaagtatcatctcccagagcctggtccaccctttaccgtgtttatggagactgtggtcatcaagaaggcttggcaatgatgtggcttcggggagccacgcttgtcaaccgtctcctttgtggtttctgccatccggatcttgtccaacaacctaccccaaaaacagcaatgttcccccaaagaagggaagcaccagcacctttctcgtgcacactggggtaggggactgtgttcccagaaaagcacatgtaatgtcatagcgcagttttgcatttagaagcaatagcaaccgatggtctattgtttctcttttacaaaccacagatggtgggctgggcagaatcttctgaattggggtgaatgtatctgtgagtgcctgtgcaggggaggcagcatggagggcatggcctccaggcaatgctgatgctgaggttttgatgtttatcaaagggatcaagggttaggaaggcagagagagctgtcagctccacaagcactgagatgccgcagggagccctgcggagggagcaggcaggccatgcaccccaccttccttggggagggcctgggcgccagggctgggcgacatgaggaggctgactctgtccaggccacctcgggatccccgccccctgcgccagcgcgcctctggagtggcttcccattcggaccagaatggggaccctcaggcttgcatcctctgagggttcgtctacgggcacagggggcctgggctggccctggactcgaggccgatgtcattaccgctgccctgacagtgtcagagcctgcgcctggctcgcgctccagagaaggagctgcaaaactcagcctagattggcagtctcccaaggaagctgggcgagggcgttcagctggagctggggtgggggcatagggaaggcggtggtgccagagcgggtttggctgtttggaagggggtggggatggcaggatctccaaatgacctcctctggaaggagccctttccttctagattcagctcctggggtccccacccttatgatcctcagagtgctgtatgccccctccccactgtccgcctgggcagggagcagtcacggggtggagctggcgtccaacatcctggcccctcttcctggctcccacctggcacccaggtgtaaatggctgtggtttggggcgttccagtccctccccatctgacctctgcttgccaccttctccgatccaggctattgccccctcagccccagggcctctcaccttctccacatccccacggagagctgggagtccaaacaaatcccacggtccatgcagcctgccacagctccatgagacacccaggcttagtgaggacccctgaaatgtgtacacaggcctcacggttcttcccagccaccctcactctatctctttccagcaaacacctcccaatacaggtgcttcattgatttcatcaaacgcacgttgccttggccactctcttactcaagcactttcaatggctcccactgcctgaaaatgatggcatgacctcaggtcttgccaacgcagggcccctggtgggccggaccccccactctctagcacttcccctcctctgcgtccttctgctcacaacccccacgctccagtctcagagcccatgggaggggcctcctttgacattaggagtaaaatttccaggcatttttagacaacaacacgtttgaatattgactctgacctgccgtagatgccccggtaagcttattttataaaggaccccagcacaaaggccttctcagcctgatatccctgtgggcaccacaggatggcgcccagacgcaagcacttgggcagccttcacccagaggacgcacgtgtgctccctcggagcctccaggtgaagccactgcaacccccgctgaggagacaaaagatgagggcggcccacccaggcctccctggagaggctgctgaaaagggcggctgcattcgaagggcagcagaggcaggagcaggaggcacggccgggcgaagggggcccttcccaggatggcagcccgagaaggaagcggcgccaggcagccagggactgactgctctccatgacaagctgcgaacacaagatatctaagtgcgtgcacacacacagacacacacacacacaaacacaccacacaccacatacacaccacacaccacacaccacacacacacacagatgcacaccacaccatacacacaccacacgccacatacaacacacacaaaccacacacaccacatacacaccacacacatgcacaccacacacaccacaccacatcacatacaaacacaccacacacaaaccacacatatacacaccatacacacaaacaccacacgccacatacgcacacatacgcacatgcacaccacacacacaaacaccacatgccacatacacaccacacacacacaccacacaccacatacacacaagctacatgccacacacaccatacacacaccacacacaaacaccacacacacctacatacataccatgccccacatacacacaagctacacgccacacacaacacacacaaaccacacacaccgcacataccacacacgcctacatacataccacatagacacaaaccacatgccacatgcaacacacataaaccacacaccacacacacaccagacactacacacacaccacacatacacaccacacacaccacacaacacacacacctacatacacgccacacacatgccacacaaactacaccaatcatacacacacaccacacacaccacacaccacatacactacacacaatacacaccgcacacacaacacacttacctacatacacaccacacacatacacaccacacgctacacaccacacacacaaccacacacaccccacacactccacacataccacacacaccatataccacacacatcacaaacacacatcatacacacagcacactcaccccacacaactccacatgtcacacacatgaacacaccacatactacacatgccatacccacacacgtgtgctctatccacacagcctctgggcggggaggtaggaacctggcacagggctgtcccgtggccctgttgtgtgttcgtggaatgtgtatagatccctattcacaaatacgtagaggagagactggcaatccccctggcaaatgcagtcccgtgatctttggcacaggtgccaaggccattcagtggggaaaggacagcctcctccacagacggggctgggaaaccgggatgcccacatgcagaagtgtgacgctggaaccctcccttcccatccaaaaattacccccaaacaggtcaacggcctggacgtagggcctgagacggtagagagaacacacagggcaaaagcttcatggcctcacacctggcagtgatttcccagatgtgacaccaaaggtgcaagcaacaaagagataaattgggcttgaaaattaaaacaaacaaacaaacaaacaaacaactttgtgcatcagaggacatcatcaaccgtaaaaaggcaactcccagaacaggagaaaatgccgcaaatcacacacctgatcggggagtagtacccggaacccacagagaacccctaaaacacaaccgccaaacaccagattcaaaagtgggcgaaggacgtagacgggcgcctctccagggaaggtgtatccaggacagcagccgcagggaaaggtgctcaatgccacgaatcattagggcaatgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaagaaatgaaacctatgtccacccaggaacgtgtgtgtgactgctcacaacagtgttattcactattgctggaaagtggaaccaacccagtgtccgccggctaagagcaaaatgtggtccacgcatacaacggggcacgattcagattcagcctcaaaaaggaaggacattctttttttttttttttttttttgaggcggagtctcgctctgtcacccaggctggagtgcagtggggcgatctcggctcactgcaagctccgcctcccgtgttcacgccattctcctgccgcagcctcccgagtagctgggactacaggtacccaccaccaggcccggctaattttttgtatttttagtagagacggggttttaccgtgttagccaggatggtctcgatctcctgaccttgtgatccacccgcctcggccgcccaaagtgctgggattacaggcatgagccacggcgcccggcccaggaaggacattcttacatccgctacaccgtggatgaacctcgagaaccttacaatcagggagaggagccagtcacaacaggacaaatgctgcccgagtccactcccacgtggtccctaaagacgtcaaatctgtcaggatggagaggagaatggggctgcggggggctggcggaggggatggggcgtgagtgtttcaggggacagagttcggtttgggaagatgacagagttctggagatgacggtggtgatggctgcccggcaacgtgaatgtgcttaatgctgccgaaccgtgcactggaagtggttcagatgagaagttttgtgttatgtgtatttgaccacaaaaaactggaaaaagtataacacaaataaagggagaaaagcatgttgacaaagagaccccagagcgaactcttctgctggatggcgggctgcctcacgtgtttttctttgccaggcctggagtttccaccgcagtcagcgtgcacagaggcctgggctggaggcagagaccggccgggtcagtggcaaggctgtctctcagcaaccctggggcagagcaagcagctcctcccgggaggccaggggggcactggacacaggcccactcaggggccgggcagctggtgggcacaccccccgggtgctgggagtgcacagccactgaggcagcacctcagggagccctggggcgtgtcccctctgggtctacacagcactaaggccgcccctggggcataaggtcggcagcctgcctgccacggcactgcgctgcctgtgccctcctcatgggcagagtgggcatccagagcctggcaggaccccctctggcttgttgtccacaagtccccagttacacagcccaggccggcttccgaggggcacggtgacagagcctctccccgccctctgcaggaagccgggaaagaagggtggacccttcccgttccaggctgctcccgccccacagggatggccgtgttggcggtgaagcctgaggctcagggtccaggcagaaagcgctggttcctccagactgccaagcgcggttgctatttatttcttctccattaaaagcctcgggaccgtttattgatttcttgctaagatgtgttatcgtccatgatacagcaaagtgaacaaaactggagaaaacaggggcagaggcgaaggcgaacgcacacgtggccgccctgctaatggggctctgagcatcttgtttcgctgtcaccgcaggtggccttgctgccatcatcccgctgcgtgtcagaaaccttttccatggcgtctgtatcaatccgcttttaacaaggaggaaggaagggcccgagcccgtgccagctgcctgggggtgagggctgcctgcccctgggccttcggctgagtaggtttggaaagcactccctttgtctaattacgcctgatccggtatccagggaaacagctgcatcttaatcctcagggcaggacgttagtttgtcttttatctgtccacaatcggcaccggggccacgtggagccaaattgtgttgacttcttgcacgcacgcggaggctaattgcagggacacggaaagccagagacccctgagagtggagcagcctcccagtgtgcagggggcagagccgggggctgcccatgctgagcaagcccagggcacctgcctggcgggaaggtcggggtggaggaagcggatgcaggtggctgagattgcagagggagaaagcaaaggaggaaggagagagagggaaggaggaggatgagggaggggaaggaggaggccctgaggctgtctcagggaggggcctggggcctaggactctgaggaagaggaacagaactgttccccagtcccctttgtctgttgactttgtcaccaggcacatgctaacctttcggtggacgagggtgttggtggcttcaatttgttattgaggaagcacagatttttgttttcgttttgagacaggtctctctctgtcacccaggctggagtgcagtggcaggatcatggctcactgcaatctccatggcctcaatcaatcctccgacctcagcctcctgagtagctgggactacaggtacacgccaccatgccctgcgaatttgaaaacaattttttgtagagacggggtctcactgtgttgcccaggctagtctcaaactcctgggcttaagcgatgcccctgccttgaccacccaaagcattgggattacaggcttgagccaccacacctggcctgaaaccacagttttttaactgaaaaaataggtatatatatatttacgattaaaagagtaaccccacgctcactagaaaaatgcaaaagatacagaaatgcataaagaaaccaaatggcctcagaactcctaaagcaaacacacggactaggtaaagtcccctggggaacaatctgtgacccctcctccccgagcctggataaatcaggtgccctgtgtggacaccccatgggacacgagattcaaagtggtggctatgtctggggaaggagggaaggagggagggaagcacagtgagccaggggcgtgggcagggctggtttcttgttctttaaatcaaggtgcacatgaggctaagtccaggtttgacagagctgggcggtggccactccatggtgctggtgatgactatctttgtgaaccgagacggccaatcattaacatcccctagacccctggggtacaccctggaggggcccctgctaggtgtggtgtgacttctcaggggggaagcagaaatgcaccctcctgggtcaccccctccaggctgagacccgagggggtctcagttcactgtgacctcggcagcgagaggtccccagccataggccctgtggtccagccagggctcccgacctcccagctccccgcccccccatattccacacccaaaggaggtgatttttctctcagaaagcgggggcttgttggcttaacctgggacactcctggcccggcagtcaatagagcagctgtctccaggctggccgagggcatgcccgtgggcaggggtccatgtcgtgagctaccagggtgccccccatggttgggtgctctccccacagcacaaaaactcggctccaaggaggatcagccattcccggagggagtggaggctcagggaccccccaccaagggcctggtctggggcagctgggactgagcagtcttcttcaggggagcagccttgggaaccccagaaggcagagcccggtgtcttgagctgactctgcaggggggtgcacagcggccgaccactgcatgtgggcccccctccctccctttctcccctgtttccaggggtaaggctggctacagccctgcccactgaggggccagtgttgtcctgggcatcaggcactggtgcagggtctgacagtgtctaggtaaacaggagagaggctgcctgggggcagctcagaggccagaacagggttggccctggggaggttgctgtgtaaaaacgaggcccagcttggtggcgcatgcctgtaatcccggccactcaggaggctgaggcaggagaatagcttgaaccagggagtcagagtttgcagtgagccgagattgtgccaccgcactccagcctgggccacagagtgagactccgtctcctcaaaaaaaagaggaggcccaggctcgaggcctcatttggccactctccggtgggcctcagtgtccccacctgggtggcatgtgtccttataccaaccccgtgggctacggtgggaatcagcggagtgacagggtgcaatgatggctcaggcagatacagtggcgtcacagggcctggtgggtgcaccagccccagacggtcctgctggctgtggcacaagatgttctctcccaggatgtgcatcctgaccttgcctgcgggcaccgctgagctgctctgctctgcgacacagtggccctggtctgtgtcactgtgacaggtgacaccattgctccgctccactgggaggtaggcagaggctccaggcaggggcagggtgtgccgtgtgctgtcctcagcagcggggagaccgaggaaggcacagctctgtcaggatgcgggctgggggtcaattaaggagagaccgtccatgagggcagcaggggcccaagtggacacagggaggggaaaagcaggggcaggaatggaggcaccatcgggccggcctggagcagggagtacagggtggagcacggggcgggagctcggcacagtgcccagcaggggcccagccccacccttgttcttggaagggcctcagctacaggcctgcagggaagctcctgtttactgtccggtccaccctcgctgggggctgctatgaaccccatggagggcaggcccctgggaatccacccacagggacaccccacctgaaaccccatactcgaggcctagccctctgtaccctcggccccacgttcttctccctcaagaccccagactccaaacccggggggtggggagctggggcctgtgcccggggacttatcagagtagtgctggtgttgaaacagctgcgatttgtgcgcacacatgggagagtcagagcgtgtgagcccggccctgtgtgcacacacatgtgagagtcagagtgtgtgagcccggccctgtgtgcacacatgtgagagtcagagtgtgtgaacctggccctgtgtgcacacatgtgagagtcagagtgtgtgagcccggccctgtgtgcacacatgtgagagtcagagtgtgtgagcccggccctgtgtgcacacatgtgagagtcagagtgtgtgagcccggccctgtgtgcacacatgtgagagtcagagtgtgtgaacctggccctgtgtgcacccgtgtgtgcatgccgagggtcaatggaagaccaggccacctgtgaaggccagcttagcctgctgagagcggtgatggtggctgcaagcggggacagggagggaggggacagcagatggggaggcgttgggtcctggtcctgccgcccagctggatctgggacctgcctgcagggacagggacaaacctgagcaggctgtgcgcccttcctgggcacaagggtctccatggtgtgcacgggtgcttctgcagggcatggacgtgagtttgctgcagatgggctgagtgtgtgtgcgtttgtatgtgactgcgtgcatctgtgggctgagaagttgcaagtatgtttctccctggatcatgttgatctgggatatggatggggtggggtcctgggtcctgcagcttccctggcccctgcaccctgagctcaccccagggaccctccagcatgcttgctcccaggggctccggcgcctgccccactcccacttgtccacaccctctagctccgtggatggggatggctgcagccacactcaagcccatgccccagctaagctccgctggccaccgctcctcttctctgcagctgtcatcctctctcttgctgcctggggtgcacacttcttggtgggtggcaggtggcaggcatgctgggccatctctgtccttgcagactgaggcccagccccttccctggtgttccctgaggctggcacccccttgcggccatctgcggcataacctcgctcccggccgcctgtgccggaaagaggctgggggtccacaaagccccctccctgcccggggaggggcctggcaggcaaacctgacagggcagtctgtggggacatttgtgggcacctcaggggcccccgggccagctggcatcgggtgcactgaaggtgggtgcccatgggccccaatttcccagatgcctctgggctccccaagtccctgacatggtcagtcaggggtagaattttctagggacacttccacacagctcccagacacccaggtaggagcagggggcttctcgaaaggtctctggaggcctgagaggacctctgcccctcactgactcccaccaagggctctttcctcccttctgaattggccagcccacccttagcaaaccggccatgcagtgagcactcatgcagtcaggccctggcttgttctggggggccacgcggctccaagttcagaccccagccctgagcaaggctgctccccgcttcccgcccccggggagggttgcgctgaggtattcgcaatggggcaccccccagctttgcagggcactggtggcctcgcaaatttgtgcagcaccacgacgccctggggctgtatttccatcacccccattccacaggtgggaaaacggaagcctgtggacagtgagtggcagcggggcccaggccttcagactaggggagccaggctgcttccacctccttgaggaagaggcatcttgggaggagggcgtcctggcctgccaagatggggggccggtgcccacccctgcctgtgagtcagggcatcagatctcgtgggcaccactcacaggggcagatgtggcaggggtcagcttgggcctgggctggatctggggtcttggcatcagggggctgaatctggcctggtagagggtgggccgtccctgggctgtgctgtggcccagctggctctgggctccagccaccgccatgctcactattatcctcgagaaaccggtgggcccaggaacactggggggaggtgaagacctgggttctggaccacacaggtcatgggggtctccatctgtagcagggagaggggtagagggtttgaggtgaacagaaggatgggtgtgtggcctcatcagtctctgtttctctgtttgcctctgtctctacctgcctctctccccatctctgtctatctctatctgtgtctctgtctgtctgtctccatctctatctgtctcttccccatctgtctctatctttgcgtctctatttctctgcttctgtctctgtctctgtttctcttcccatctctgtctctctctaattctgtctttgtatctccatctctttctccatttctgcatctctgtctccccatctgtgtctccctgtctctgcgtctctgttcccccgtctctctgtttctgtctgtctatctccccgtgtctgtgtccctgtctctgcatctccgtctgcttgtctctgtcttcatctctgtgcctctgtctccccgtctccttccctctgtctccctgtctctctgtctttgtctccctgtgtctctgtctccccgtctctgtctccatctctgcatctctgtctccccgcctccatctctcttctgtctccctgcgtctctgtctcctcatctctgtcttcgtctccgcgtctctgtctccccgtctccatccctctgtctctctgtgtctctgtctccctgtctctctgtttctgtctctctgtctccatctctgtgtctctgtctccccgcctccatctctcttctgtctctctgcatctctgtctccccatctctgtgtccttgtctctgtgtctctgtctcctcatctctgtcttcatctctatgtctctgtctccccttctccatctctctgtctctctgtgtctctgtctccctgtctttgtctctctgtgtctctgtctccctgtctctgtctccatctctgcatctctgtctccccacctccatctctcttctgtctctctgcatctctgtctccccatctctgtgtccctgtctctgcgcctctgtctcctcatctctgtctctctgtgtctctgtctccctgtctctctgtctctgtctctctgcgtctctgtctccccgcctccatctctctgcatctctgtctccctgtctctgtgtccccgtccccgtgtctctgtctcccatctcacatgtacagtcggagaggaggaggagccctgggtgctgaaggcagaagtcaggccgaggagccgccctgcagggtgtccaggtggccacacggtggggccctcgtcccatgtccaggtggccgggctgcaggaggagggtgctggttcctcaaggaggagaggggctgggaaggggtcaggaaaggggagctggggtgggactcagggggtctccatcagattgctctcagggaaccaggctggtccccaggaccccgagggagggacaggaccgcaggaggtgcggctcaaccgtgactgccacaggagtggggcaggggaagggtggcggggccaggcgtgggccgcccgaggtgctgacactgccaggcagggcaggggttgctcacgtcccaggaggcccccataagactcccacagtcgagtgcagaggtctccgaagcaactcagtcccgcctacaatctagccatggggcttgggcttaacgggggtcaatgggcgccaggcctgaggacgtggggcccccagacacactttctctacaggcacgtcgcatgccacacaccacacatgcacacacacacttgcgggccctgcaaacacgcgtgcgcagatgccagcacacacggccctacgcgcagcacacacagtcacacacacgccctcggcggcctcctgcacagctgtgcactcttacaccacaggagaaaggaaagaatcacaccccagcccagaaagagaccaccgtgtggcaccacagcccagcctgcagggtagcaggggagaggccagcaagtgacaaacgggggccggtccgcaaccccagctccctaaccaggcaccaactgccggggcatcttggcccctgggcttcagctcccctgggaggatccacatggccaggccgcacacatgccccacccctccccacccagctcaacgtcctccatcacccacaccccacgtgccctgtgccatcccactcaggacctcgctgcttcctttctcccagggcaaagcccagctcaggggacagaggagggggccagtgggggcccctggagtccccacagtcactggacttggcatgcacgtcggggtggggacatggcatgagtcgtctgctgaggtggccttgagcccacctcaaggacccagagacctggcaggcggcacctttctaggggctgtccagggaccaggcctggccagtatcttcacctgggatcaggagggctcctcctcaaaacccaccccagggatgtcgggtgcatcccttccccctccaggatcctgtcctcacagccactggcagggaaggggtcgtggcccctgctccacagaactaggagctgggcctgccatgtggtcattcacaggccagcccagccccatgtcgtcccagttctggtggacagcaagacgaggccacctggtgctgggcctctcgcctccacagggccagcatccctcctttaactagcgctaggcctggctactggctgggaatacaactgttccagcaccaaaagtcacctgtgcctgcagggtctcgcgcctgggtgtccgaagtcggcacagcacagccctcacagacatacctagccccggaccttctgagctgagcagtgggagccagggcctggctggcatagctcactgtctgccctgggcaggttgaccaccacagacagacagccacagaccaatggcctagaggactgccagccaaggcacagccctttgtccagcacagccagcacctgcagacagggacaaccaggagtgggtgagagtcagacaggctgacccgcagagggcctccagctggggacatgagggcagacgtcacaaaaccacagcatctcctgtttccctgccgcaggcgtgaggggacgtggtggtgcggggaacagggcagctagcggagcccggggcagctagcggagcctggagcaggaggcggcctgggcaggcctggaggagggagcccttctcaccctcctgcccagaatacctaggtccttcctggctggccagctccgtctccactgggctccctgaccatactttctatacccacttctctgccgtgcaagggaggccatggaggcttgaaagcatagtctctgactatgtcccctaaggtcgggccatcctcccctcctcagcctgggccttcccaagacaggggcccttttgctggaacttttggacagtcaggtgacctggcatccaccagggacctctgaggctgagcacagagaatgccccacctccaggagcagcccgttgctgcagtgggccctggacagaacccccaggccacagctggggcccatcccatgactgccctgctgcagacttgttgctgggccactctggccgaggcctttataagcgcctactgcatgctgccccactctgaatgtggtatggccggcagggtggcaggggcccggggtcagctcatggtgcagcgttcagcgcaggtgcgctgttggctcctctgatggctcacggggccagccctgcagctagcagggtgtgagcccagagccccaaggtgtttctgggtccccagactccccagttgcttgtttcagcccagcagcccccttcctgagctggataggaccggggctcctccgagaggcctaagtctgcatcctaaggcaggccagatccccctccccacccgtgtcccagcccatcctccaccctggcacctacccgggcacaccggtgagcactggatggccgttccacctggagaaaatgtcccctgtgctgagcaggacagacagggtgtggaggtgagggcaagacagaggcaggggctggacagggagcgggcacagaacgaccagggctctggacaggccagggcagagaaagcagtggcctgcacaatcttgccctggtgggcggcctccgggactaaagacgctcgctatcctgagagctcagtcaactcaggcagccagaacaaagggccacagactgggggcttaaaccctacgcattcatttcccatagctctggggtctgggcggcccagatcaaggggccagcagatgcggttgctggtgagaacccgcttcttggctccccgtcggggcctccccaggctcacatggacagcaagcaagtgctgtggggtctcttcttataaggatactcactgtatggggtcagagcccacacttgtgccctcatttagccttgactacctccaccaaggccacacctacgccctttacagaacccccacgatgggccacggtcctgttggatcctcaccctcttcccacaaagcagacactcccagacttcaccaaggagacacggaggctgcagaggtggacgcatgggcaaggccatcagctggggaaggactgccctggcgtctgggcttgttgcctgcctcctggccccagacagcctattccaacagcccttcctcccagccgcccacccacatctgtccaccttcccgggggtgtcctgtcatctgccagttccttttttcaccctcgagcagcccccacaagagaggacggggaccacccaactgcagaacaaacctggactcagagtcgaccaacaaccaaaggtcaattctctatgaaggtgaaaaagagatattttcaaagcaactgaattaataaaacagtccaactgctttaggaagatttattcatgaaagaacttctgggacccctcccatatgattatgggcacactgagacatgtactctctggaccccaaaagctcttaagctaataagagataagttgtgatttaacccatgcccatctgctcataaaagtggtgagagttaatggatagatggatgaatagatacataaatgtgtagataggtgcctaaagatagatgcacagacagatcaaaggatgacgggaggaagagagggagagatgggtaaagggatgaatgaatggatggcaaaatggatggatggataagtggatgggtggatggatggatggatggatggatggatgaggtggatggatggatggatagatggatggatggatggatggatggatggatggatggatggatgaggtggatggatggatggatggatggatggatggatggatggatggatgaatagatggatagatggataagtgggatgatggataaatgggtggatggaaactgagaagaaagacctttgctgtattccaaacaccatatccttagtctaaagactcaactctggtccctgccagcttggacatttgcctgggttgaccctcttgtaaacagacctaacagacctccagttctctgaaaccccaatccttaccaatgtcagacttggtagctagttaacgtaaccctgaaaccctggcccacctggggcttagccatggtaggggggctgcccactgctaactgggtaccttctaagtcctctgccaagcatcagtataccacattaagatttagtagataaatgggtgcacacatctgtacaatgtctccctgtaggggaatctcaggaccccgctgaggggatgctaggagctgtgtgctgtccagtcactcttgtcttctaggcccagcagaaaggtcctctactcctctgaaacagaggggatccctcaacccttcctcctctccctcccccatgggggccattaagacccccatgagttctagaccacatggtcctctagtgcttggttcatcccaggtgtctgccaggccctgcccaaaaatgcaatgtctgggcagcaaggaggctgaggccagaccccaccctcatccatgcctggaacctgcatccacgtggcaacccctccctccaaacccagctcatgccagggctcagagcatggtggagagggtagccctgggcacctggggcatggcaggactgccctgcctgccccgcctgccccgccctggcccgtgcctgcaagagccacctagggaaggctccttcacctggccctgggcctacactccacccaggaatgtcctgcacccctggagtgtggagatgaaggttacggggtccagcctctgggcaccgggacatctggggtaggggctgaaggccattcaaagcccctgccccgaagtctaccttccctcctcgcccctcccccacccaccctgggggaggtttgtaatcttcagtgtcataacctgtcaggcctgtttggaagggaagggccgccagcttcctaccagggagcagggagctcaggcgttggttagagaagaggtgaagcgtgcacaggaagcgtgcggggcccccctgggcatgggggaggggcgccggccgacgggagcttgggcacgtgctcacacacgggactggaccgtgtgtcacagcaagcctgggtaggtgcagacaggtccgcgcgtgtcacctgcgcagtgcacaggggcctctgctgcggacgcagggcctgccggagtgactgcctggctgcccaagattccaggggttccactccatccggtgctgagtggtgccccccaccccagagacctgggacagccgagaaatggaggagaggaacccacccacccagccctgtggcctccaggcttgacttgggtgcagctggcagaggccctgcccctctggctgtctccctcctagaggggtctaggagtttcaggaactggggaccgagggaggtcttctgcagagacaagagggcgcagggcgcaggccaggaaaccccttcacctgcagagccatcggtgtggggaggtcagccacggggtgtcttggtgtctcaagggggccttaggtagagctgttcactccctccttgtggccccccgaggcccaggagggacctggagcccatgtcccaggagtgcccttgggaaggtcaactccaggaacccttgcagcccgaggctagggctctgaagctgggatgggcagcgggggccctgcagggccccacaggcacagaaatctctgtaatcctgaaccataaaggggccgccttcccttttgattctaaattttaatagcaaaatgaagagataagtcagctttgatctgagttttattagcctatgcctttgttccctctctcctttaggggaacagacgggtttacggctggtctccccatccctctgtcagctgcaggcgggtggcgggcggccgctctgataaggcctggtccctgcccctgtgcctctgtggggtgccggcacagcaagcctgggacctggccgccggcccctccgccaggtcaccgggaggcctggggggcaggtaccctcaggttagggggactctgggatacagacccctgcaagcccgtggcctcctatttctcccatcccacctccctccctctgcctgatgactcccgtgggtggggcttctgccttcccaagcccctgtgcctcagtttccttacctaaagaacagggtgctaatggagacaagggagaccaggagacagctcagccaggggccaaaccagcagctattgctatggaggttcagggaggtgaggatgttggaccacaggctgggaactggccctccagggacccctgaggagagcaggcctgggatcctggggctgggctgggggagccggtggactccagggtgaacgcggtgttagcctgtgtctgctgggactgggccacaagagttcccagcttcaaagggccaggggaggcctcggggccccgcccacctgtgagttcggggacatcaaagggccccacccaaggggcggctggcagtcggagcaagggtagaaacatccagaactctatctccagagggagcggctggggtcagccccacccctgggtccactggaggccccctgcagtgacccgaggcccctgcctcaccctgaggttctggccaggccggtgacaccccacctctctgggtgagggccttgctcccaggggtggctggggagtggtgggtggggcttctgggggctgtgacacaaccgcactccacttaatgatcacccagttttaacggggatccaggagcttctggggggtgctgggtgctgggtgacaccatggccccctcgtgcgtccctagcctggcggcaggtgctctgggccctctccctgggactatctgcctggacggcattttctggcccttttaacaccggggtccctagcccagccctgggcctttacgatcaggaggtgaggaggacccctcaccccaagggaagcctcaccctgatgggacaggcctggcctcggctgaactgcacagagggggggcccttgagagctcccctgctacagcctaggtgcccccttccactgccctggcagtagcaaaggtccacagcatgggtggacatgcctgatggcagccctactgtgtgccaggtgccaggacgcagcctgaccccaggatccggttcgctcctctccacaaccctgggcggggatcctctcctaggaccctccggagcctgagggtcagaaggtggtgacatccagtcacacggagagggacttggagtgtctgtacggcaccatcctgtcccgctgcctaaagggagcgcctgcttcaattcctgcccccagggccgtaggagcaggccttccgggactccgttcctaggatcaccgatggaattcctggtgggggtgggactctgccccttcaaggactctagaggattccatgacagggtgggttgggcctgaagggcaggggccaagtatgggggcctccccacagatgtgaaagcagaggtttccctacctcctgccagagggcagggagcatagctggatgctgtggctgggggcaggactcctggcagccttgttccccaaggcagagggtgacaaatcactaattggcctctggggcggtgctgcacctgacctgggctgtcttcaggggctagtgattcgctgaaaaaagcccacattctgccaaggctcagcctccacacctcctcacatcccagccagccatcctccccacctccctccctcccagcctccagcctccccacctccctccctcccagcctccagcctccctacctcccagcagcccagccttccagcctccccacttcccagcccctctgccttccaacctccctacttcccagccttccagcctccccacctcccaggctccccacctcccagcctgcccaccttctacctccaagcctccccacctccccacctctcagcctccccacctcccagcctctccacctccctactgcccagcctccagcctccctacctcccaacagcccagtcttccagcctccccacttcctagcccctctgccttccaacctccccaactcccagcctccccacctcccagcctgcccacctttctacctccaagcctccccacctccctacctctcagcctccccacctcccagcctccccacctccctacctctcagcctccccacctcccagcctccccacctccctacttcccagcctccctgcctccttacctcccagcctccccacctccctacctctcagtctccctacctcccagcctcctcacctccctacctctcagcctccccacctcccagcatcctcacttcccagcctgccacctttcagcctccccacctccctacctcccagcctccccatctccctacttcccagcctccctgcctcccagcctccttacctccctacctcccagcctccccatctccctacttcccagcctccctacctcccagcctcctcacctccctacctcccagcctccccacgcccctaccttccagcctccccacctccctacctctcagcctccccacctcccagcctgtcagcctccccacctcccagcctccccacctcccagcctcctttcctcgtgtgagtgttgtggagggacattgggagaaggggcttatccgggacacaatgcactgatcctaagacatttgtttacacttattgtctctgaaagcaggtttcatgtgaatgctgccaacagccaggttcatgacatggtggccccagctcaacacggatgaacctgactgtatcacctggcagtgacccctctacacttccatcccaagcctcaagggcccatctagggaaggacagtgagtctggggcgccgtccagagatcatttgctggcacctgctggtaagatctagataccggcagagcaagcaaaagttcccgggtcaatcgtggaggcccctcttggggaacgggtgtcccccagccctgtacatggcccaaaggaagagtgtatgagggacagcctcggtgcaatgactctagacaaaattgacccggaggaagtggactcaaatgtggggacagtaacccttacttgctggtattttctctctacgtgtgtatacaacagtgatttatgaaaatccctccctcaacccatcaggcaaggtgctttcaataagcaagaaacaaaacaaggaaaacactatttccttgtttaagttccatttctttttttttttttttttttttttttgtgagacagagtttcattcttgttgcccaggccagagtgcaatggtgcgatctcggctcactgcaacctccacctcctgagttcgagtgattctcctgcctcagcctccccagtagctgggattacaggcgagtgccaccatgcccagctaattttgtatttttagtagagatggggtttctccatgttggtcaggctggtctcatttcttttctcatcatgatggcaaaatgatggtaaaacttgacatgggccttagatttgaagaaccaagagggcgtcgaacagccaccctatcttgtgtacattttccattgtatttcactcttgcagctgccttataaggtagggtctaccgtggtcctgatttttcacatgagaaagctgaggctgggactcaggtcacacatgcaggcagatgtcccttatcagagtgtcccttcagggtcacccacagctgcccaacagcagtgactacagccaggaagtcgtggaaccatcgcctctcacagttctggagttgacgggtcttagctgggcagtgctcactcagggtgtctcgtgggcagtcagacgacagctggagtggacgtcggctcagagcatccttgctggcaggtctggtggctggtgctgactttgtcaggttctgccagggccattggctgcacatctgcatgtgccgcctcggtggcacctgggcttcctcacagcatggcagtcaggctccaagggcagctgcccgagagctccaggaggaagctgcgtggcctcttatgatgtggtctgggagttccagggtgtcccttctactgtggttgtcagcctgccccagttgtaagaggtgggagaggccccacatctgcgtgtccacaccataatggggaaagggtacgcaccaccttctgagagagtcatctgccacggggtggcacaaggtcatggcatttcacatggttgtcacccaaagaaagccctcagccgtggagccttgccctctccagaagcgtcataggagatgccccgttacgtctgcagacaacccgtgtgggttcacagcctccatcagcaggtcagttgtttgttccctctgaggagcaggagcaggggcccaggcacgctcccagtgggcaccgaacacctgctgctgggtgcctgccccgcacgtaggagggacacagcggtgagcaggcgctggtcctcatgcggctgcctgctggtggagggaatgtcacgatcagggaagaagcagatctcacatagagatgtcaaacgctggcatccaagaaaaatccagccgtgtggcgggagcagagggctccgtgaggagaggcaggttccttgctcttcagcctccctgggaagctgtgggaggaatgtctgcaccgtgcagaggccctgaggcaggagtgagtgtgtctgcagctggtgggcagtgagtggggaaaggtgcaggccaggccagaagggcggcctctgagaaggggagcctgatgaggacagcccacgccctggcttgaccccgggcagctgctctcagcagtgcctgcagaatccatgaaaatgctgatcccaggccctacctgtgactcacagtctgcggccaggcctgggatgtgcattttgcaggaatattctcagagctccagagctggcagaccagggtgagcccatggcctagaaaaccagaaggaccgggaggcattcctcaaaggcaggaaggtttggaatatcagagaagagggggatgtcctggtgccccctggcctgctgggcacaggctcacatagcctgggcttccctggtgttccaggcagctgaggagtttgaggtctgagtgccctggggtagagcgggatggcaagccaggtgccaagcagaaaacggggtcactcccccgctgcctgtgagcagccctgagaagaagctggcagctgtccacacctcacgccaaggctggctggccccatgttccagaaatcacccgtcccaggctgcctcgctcgccgcgcttctcagcctgtccacctggagtgctggaggctgtgcccagtcctggtccggcatggcctggccctttttcttcctggtagggagctcagcggctggccaatgggcagcagagggggcagcagacagccagggcacaaggaggcggcggcagggcaggcccaggccagtggaggcagaagccgcaagctgggagcggagaggatggcggagtctggcaagcacccaacaggtggcagagacagagcctggcccggtggacagtgcaggtgggggggcaccagtgtagacgggcagggcggccaaatgagaggagcccagacacacacagaggcagacagggccacgctgcaaaggctggagacactgccagctcaggactgggcacggagcggggcaaggtgaccaccctgtcagagcagggcaggggccctactcaggagatggagagaaggcgaagggctgggggaccccctctggccccaggcatggccggccccttgcctcatggccaggctgatgccttcccagcccaggctgggcgggggccgagcatgaatgtggccccatggccaagggtaaggcagagtcagggccccaggtcacccaccccacagccactcggccttctctcaggtccccagactgcctcctcaccccctgtcggcccacaggcctggacctccctcctgcctgccctcctccctgccctggctgcccacgctcctctccagggatcaagtccgccccagccaccctggccctgcttcccagggggtgggctccagccttggcacttgcacacctgaggaccacgcactcactccctcctgagcccattctgacagggaaagtcccgtaacagggtccaagcctaggacttccgcccagcctgcctggctcccgctctgtggacacccgagaccagggtctcttgtctgtcctgcctgaggtccctctgtctcatctccaagaccccagaggcccctggaggaggtttctcaggagcagagaatgagtattagtggtagctatgaaggggtcctaggcccggccgcccaaacccactcctccccaggcagatcttcagccagtggctagggcagcaggagagccactctcaccagccctctggccactgtggcctctgcccagctctaacagcccaccctgctccgcagctgtgcccttgcgtcctgtcacaggggaccccggcgggaagggcagggcctgagccggtctgcgctacccatggaggttggcctcgttcttcttgctgtggtccagcccctctggagcccatgggcccacctcccaggccccgtcctgcggggactcccaccttggatgtggacaggacctcctggctcacttctaaccaataggatgaggcagaagtgacaacattgcttccaagcttaggtcacaaaaggacgtggtttttgcctgctttcatttgatgatcttgaaggagtctgccctgcccacaagggcttggccgggcagcaaggactgcgctccatctgtctgtccagtccctccctgcgtgtccctgaggtagctcctggaggacagtggctggcaccttgtcagggtccacacctggttgatgcaagaaggcacaggtgagcccagtccacgcagctccacacgggtcagaaccgggctgtctgctgggcaggcaggtgcatccacctgtgtccaatcacatttggaaagtggaaagggaaatggtggcctgcaaaaggcattggtgcccctcagaccccagggccgaggtccctgggcagcccggcccacagacccatcaccctgcactgccagccgaggctgctggccctgggctcagtactctggccatggctgggctcatgtcgagacctcccttcccctgacttccatgctcagggctccttcgtgcaggtccagggatgtggtggaggcccgaggtacagggacaaggttgcaggcagcgctggtggggcaagtgccagggcccaggccgtttcatgcaaagacacccactggagaacggaggccctaggtgcaggccctggcatgaccctttccttcactggaggaggactcatgttaaaaaggacctgccaaggggacatagacagaggagctgtagataaaaagctcctgagccaaccaggttccaggcagcccaggagccaaggggtggggggagcaggatgccctggggacacactgccctgtgcagcccggcctctgtgcctgggcaaacagcaaagcctcagtgagcgggctgcaggcaagggaggccccatggcccagggaggtttatggcctcccagcagagcacccggccccagcagctggcctggcccctgcacctgtccctttgtttgcacaaatcccgtccctaatagtcttaatcgcaaagctttgatgactgtgccagaccctgcacaggcccctgcggactgcgctgaacaaacacgccattgtctccgggtgcaccgcaggcgaccagttaatggttaaaccaaggggagaaggatggcagctctgcctgaggccagggtgggggagctgcctggcgtggtgtgggcaccagctccccccaccccacaagggcacagtcgtcctacactggggctcccagtgggcagagagagcacacggcttctcccctgttttagaactagcctcccagcaaccctggagccgggagacaagtccagaggaagctgctggagtccccagcaagacacctgccccgacccctccacaccaggcaggcgcccaggctgtgggagctgctcagacgcttgagagccggccactctctgtgtactccagacccacgggccaggagtgggcatgcagttagagccccgtgagcaagcctcacacagctgtgggacgtcagcagcacagctgccatgggaaatgccctggccggtccacgcaggccggttacccccagcactaccgtgtgaccagcaatcccaccccaggtctatccccagaagtgaaagcagggactcaggcagacacgtgcacacccatgttcccggcagcatcactcaccagaggcaacaggtggaaacgaccccggcatgcaccaaccacgaaaacgacgagcccaggccgggcatggtgtctcacgcctataatcccagcactttgggaggccgaggcgggtggatcacgaggtcaggagatcgagaccatcctggctaacacggtgaaaccccgtctctactaaaaatacaaaaaattagccaggcgcgatggcaggcgcctgtagtcccagctactggggaggctgaggcaggagaatggcgtgaacccgggaggcggagcttgcagtgagcagagatcgcaccactgcactctagcctgggcgacagagtgacactccgtctcaaaaaaaaaaaaaagacgagcccactgtggtctgcctgtacaatggaacattattgggccatgcgaggaatgatggacagatgcaggctgcagcatggacaggcctcaccaacgccacattcggtggaagaggccgggcacacaacgccgcgtggtgatggactccctttatatgaaatgtccagaataggcaaatccatagggacaaaaatagatgggtggccgcccagggaggggggtggtggagacggggagtgaccgctcagtgacagggtttccgcctgggggatgcacgtgctccagagctagaccgaggtgagggtcgcacagcactgagatcgtgctggatacgctggattgtgcactgaaaatagctaattctgggtatgtgaacttcacctccttttaaaaatgacagcccactgagacagacacacaaacagtgggtccctgagtgtgggaaaccaagacgggctggggccgaggccaggccacagaccccagtcgggcggcctggctcactcccagctctgcctggggctggccacggccttgatctgtgccttgatctccaggtttgtggccctgagcctcccgtggcaccatcccagctcctgttgagcatggccctccctgggagccactgtggccacacacacactcctccgagcacgtttgtccagtccatccactctttctcacaatgtcctgaagacctgctaggcagcagaagctggccctgctgggggaacgcaggagtgggcaggctgccctggctcctgctagcatggagcacacagccccaggggcaacaggcaaaccccaggagacccccacctgcagcctggagaggggtgcaggcagggcatgcagcaggggccagccccatcccaacctcctccagcccctccggccaactggcctgcaggctatgccgggtgccctcattggcctctgggctttttctgttttgtaactggtagccttttttttttttttttttttttttttaaagaacacactttaaggtttatagaaaatggagcagaaagtacagaaagttccctgatgctctaccccctgcccagccctcccccatgcctgcagtctccccgttactggcctcttgcatcgctgtggccaggaacccattggacattttttaaagtcgcatactttttattggggcaaaaaacacatcacatcaatgtactgtcctaaatgtacactgtttttcaatgcacagttcaggggcattagggacactcacactggtgtgcagccctcactgccatccatctccggaaccctttcatcttcccgagatgagactctgtccccattcaaagcaaactccccacccctcccccagcccctgacacccactgttctacttcccgtctctgcggatttgatgactgtaggagcctcatgtgagtggcagcacacagcgtccgtccttccgtgtttggcttttcccgctgagcccctgcctcaggtccaccccgtgacagcgtgggtccggatcccccaccgtatgagaagatcgcactttgcttatccacgctgatgctttttaaaaaacatttctgtttatgtaattgacaaataacaatgcatatatttatcctgcactacacgttgttttgaaatacatcaatacttaattattatgcaaaggccatagtttacatgaggcttggagctcggtgttataagttctatgggtttggactaatactaccctgtatccactgttacagcaccccatagaggggttccacggccccgaaatcctccatgctccacctgtttgttcctcctgcctccctaacccctggcagccgctgacgtttgtcttcatggttttgctgtttccagaatgtcctaagggtagaaccctacaggatcctacaatcctttgcagcctggcctcttccacatgtcgagttagcggtttctccctgtctttttgtggcctgtaactcatttcttccacgggcttctagacaggctcagttctctcccatcttaaatactcatcccttgagtccacagactgccacacagctcgtgccaacctctttacttcacattaaatgtctggaaagagagaaggcctgtccactccctttccctgtcacctcatgccacctctcttctaaccacagtccaggtcagtcagctcccgcactgccaaggggcccagtgctttggcctccagccctggagacctcctcctgccttcccagcccctcatctgtttcttccccgctctgctgctcctccccaggtccttgcgggacggcctcttccactgggtccggagctgctccagacggcctcctctcatcttcctgccacagttgccggctacacgcaggccacagtccgtctcccgctaggccgcctccctctcccctgtgctccaacccagaagccagctgccctctgtcactctcagacgacagacggcagcacgggtccagctgccccaggcccgagccccggggctcctcaccgcctgggcctcctcgccaggccggaccttgatgctgggtactactgccctgccacctgccctgccacctgccccgctggcagctgctccttcctgcccccacattctgtccttcagacacgccatcgggagggcagtgacatctccgtggtctccctttaccctcctgctctgccactctgcctctgctcatcctcctctggggagtcagcctgacctctgcaaacatgggcatcagtgggcacgtctccgtgcttagaggcccccagggctatccgtcggcctttggtaaagtcacaggcagaacccacacagagcctttgtgctaggactaggccggcccacctgcctccccaggctttgggtggtgcccacccaccccagcctctgcaggtccatgcctgactagccgcagggcctttgcacacctgcattttgcccaaattaactctactggaccctctcctgtgaggaaggctccgcagcctccccagccaggccacacaccccagtcctcgttcaggggtacacatttgtccccttcatacacaagccaggctccactctgggcactgggtcacagccaggagcaaaacagacccagtcctagaacccgcaaagcatccaccctgggggaaaggaagcagagatcagaggtgtcactgagcacacagaagctcgaggtgctaaattccatggaatggaagccaggagtagccagagggagcacgggtgctggggggtaggtgagggtgactgagacagccactggggggtacgtgagggaggaccgggacgggcgctgaggggtaggtgacgggggaccgggacgggtgctggagggtacatgagggaggactgggacaggcgctgcgggggtaggtgagaggggacccggaaggccgctggggagtaggtgaaggggactgggacgggtgctgggggggtaggtgaggggggaccgggacgggcgctgggggataggggaagggggaccaggacggccactgtggggtaggtgaggggggaccgggagcaagtcccagacaagtgagttttcagaagcccgcgaggccctcaagtggacaggccaagtgtgtgaccagggcttggggagacgtgagggtgaggtagctgtctgcagagggtgcaggagagcagccacccaggaggcccacctggggccctcagtgtcagaggccgcggagcctggcttctgcttgcccccactgccccgggccttctcctgccctgacccacaagccctgtgggggtccctgcccggcccagatccccccactatatcccagtgtgtccagtaggtgctcagtcagtgccagcagactggatggatgcagctggaccaagaggcactccggacagacccccagaggagctgaggatggggcctccctgcgggatgcactgggcgcaccggatgctcagggtggtctcaccatcgtgcccccttcacagagaggaccctgagcctgggatgcgcaggtcctcacctgaggaaagtaggcaccagccaggtgtaacctgggccagatgggcagccccgagggccgcgccccacctctcaggccccgctcacagccaggccccagggctgctcccaggcccctgggagagcagggtgccgtgggcggtcagcaatgggtgcagggtctcctgaggtcaggagggagctcagagctgcttcttcccttctcctttctcagctgcctatcaccccaccctctaaacagcagggagcccggcatagacacacttgtggctaccccaccctcacaccctcagaaatcctcagggagacaggtcgtacaccgcccatccttgcaatgggctccctgccccctttctcctggagggcaccaggcacacacaggtacacacacaaacacgcaaggcacacacacagacacgcacagacatgcacagccacacacagataaacacaaacacacacagctatgcacagcacacacagccacacagccacaaagacacacacagacacacagccacaaagacacacacggacacgcacagacacacagccacacagacacacacagacacacagacacacagagacttgcacagccacacacagataaacacaaatatacacagccatgcacagcacacacagccacacatgggcacacaaaggtacacacagacacacacagccacacatgggcacacatagccatacccagataaacacaaatacacacagccacacacagtacacatagccacacagacatgaacagacaaaacacagacacacagagccacacacagataaacacaaatacacaccatcatgcacaaacaacagggacgcacagccacacacggacacacacaggtatgctcagacacatgcaggtgcacagagacgtatgggcacacacagacacacaaaacaggggcacacacaggcacgcagagacgtgcccatcctctcacagccacacgtacccacagccacagccacacccatgggcacccagcaacacccgccctcccagcacagctgcctgcccacagggacaccactaccaacgcccagcaccgacaccctggcaccaacgcccaaaaaacgtcctcagcggtgcccacccaggccggcaggctcagacagacaccgctgctgcagcgagtgtgcctggagtcccacctgctgggacaaggagacctacaggtgtggatgctgcccgctgcctgctgtagggggccaggacctctgagcctggctgagctgggcacccccgtcccatgcccagggggtgctgcaggactgtggccaggccaagccttcccaaggcacctcttggggccagagcagcttcccaggacagcccccatgcctggcaggctctctgtgggctccccctgttccaacgccctgtggacccagccttggaagcttcacaatgcccggtgcgaggaggacacgtggtaatgagaaaggtgcctggagctgtccagcctgcagcatgctgccagcgcctcactgggtcctcatgccctgtgcccactgggtccctataccagcctctgctccgcctggcccttacaccctcggctccacctgactcctacactggctctgcaaccattcccagccacagaggttggctgcaagtactcacagctgcccctcctcagtgactcgttctcaggcaaacaggaggctatgccccagcccaggggcagcccacgctaggagtgaccacccaggaatatgaaacccagtccccttacctcaaagcccagcctactatagtacaatttatgccccagagctccctgaggctgtctgctgccgagaccccctcttgcttgcctgtgttctcagcctcttctcttcctgggagggcacccctcccccaacaaatcccatgcatgagaaaccccactgcagattcttcttcaggggaacaggcctgagacagttggtgccaggcatggcactgggaagctgagcccaggtgtgggctctgtgatcagctctctcactgaccagggcaaggaggagcccctcatgggggtgagcaggggaggagtggatagagcccctggcaggctagagcagaacactgtgggatcacagaccacctggtgccatgtccccagcacttgagaactatggggaaaccttaagcaaagagctgtggaacgggcagcttttgctgagagccatgaaggtcctgaaggaagaaaaccccaagttcagatctataaattcacaatccaagatccagtgtgagagtcctaacgaggtcatgggtgtgggcttttgtcttactctgtttgtgttgctataaaggaatacctgagactgggtaattgataaagaaatgagatttatttggctcatggttctgcaggctgtacaggaagcatggcacctgcatctgctgctggggggggcctcagcctgcatccactcatggcgggagggtgagagccggtgtgcagagaccacatggtgagagaggaaccaagagagagggaaggtgctgggctcttcttaacaatcagtgctcatgggaactcaaagtaagaacttagttctcaccctcctccagggagggcattaatccactcatgaggaatccatcctcatgaccccaacggctcacatcaggcccccacctccaacactgggcatcaaatttcaacatgaggttgggggacaaacatccaaactatagcattcctccccagtccccccaaatttatgtccttctcacatgcaaaatacaatcatcccatctcaggagtcccctaaagttttagcttcttcctgcatccatttaaaagtccaaagtgcaaagtctcatctaagactcaaggcaagtttctttcaggtatgagcctgtaaaatcaaaatcaagtcatttacttccaaggtacaatggtgggacagacattgggtaaacattcccattccaaaaggaagaaattgaccaaaagaaaggcaggacaggtcccacacaagcttgaaacccagcagaacagacattaaatcttaaagctcccaaatctcttttgactccatgtcccacatcccacgctggaaggaagggtgggctcccaggactctggacagccctgcccccatggctttgctgagcccagcccacgtggctactctcacaggttggagtccaatgcctggggcttttccaggctgcgattgcacactgctggtgtctctgtaattctggggtccccctggcagccccattcccacagctccagtagaagaatatctccgaagggctctatccctgcagcagggttctgcctgggcacccaggctttccaatacaccctttgaaatctaaatggaagtggccaaacctccagcacttttgcattctggattcctgcagacttaacaatacatggaagccagcaagtcccatgcctcgtgctctgcagggcagctgtccaagcggtatctgaggccattgggaccatggctggatctggggtggctgggatgtgggaagcagcatcccaaggtggtccacagcagtggcaccctggacctgaccctccaagccactctgttctgctaggcctctgggcctgtgatgggcagggtggcctcaaagtccttcaaaataccttcagggccctttccccattgttttgactgttagcattataccctctttcagtcatgccaacccctctagcaaccggtgtcacaaaggaccttgaattcctctcctgaaaacattctttgcttctctaccacaggccaggctgaaaattgtctaaatttgtatgctctacttccctttttattagaaattctacctttagatcattcctttgctgttgtagtgattgtaagttgttaaaagtagccatggtacttctggaacactctgctgcttagaaatttcttccactaaacattctgggtcatcactcttaaggttagccttctacaaagccttaaagcacggacacaatgcagttgcaacctttgctaggggttaacaagggtgatcttcgctccagtccccagtaagttcctcatttctatcagagacctcatcagcatggcctctattgcctgcatgtctatcagcattttagtcacaaccacttaactagtctccaagaagtttaaaactttccctcatcttcttgtcttcttctgagccctccaaactcattcaacctctgcccattactcagttccaaagccacttccacattttcaggtatctttatagcaacaccccactctcagtaccaattttctcagtccacttgtgttactataaaagcacacctgagactgggtaatttataaagaaaagaggtttatttggttcatggttctgcaggctgtacaggaagcacggggcctgcatctgctgctggtgagggcctcaggctgcttccactcatggtggaggtgagggggagccagtgtgtgcagagaccgtatggcaagagagcaagccagagagatgggagggaggtgctagcctctttttaacaacctgctcttgagggaactaataaagtgagacctcatttgccccgctctaccagggagggcattaacctgttcatgagggatctactcccatgacccaaacacctcccattaggcctccactttcaacattggatcaaatttccacatgaggtttggagtggacaaacatccaaattctagcagctttaatccaacctgactgatatacttgtgagaagaggagattagaacccagacacacacagggggaggaccctgtgaggacacagctagaaggcagccatctgccagccaaggggagaagcctcaggaggaaccagccctgtgacaccttgatcttggattccagccttcaggactgaggaggataaacttctggttattaagtcccccagtctatggtacttagttatggcagccacagaaagtgaattcgggcagcaaagaggaaatggcaccagttggccttacccacaggggtctttgagaaggataatagagcatgatgctcctagaggggacaggtgggcaaccaaccaggtgaccctttaatatagaaacaagggatcaagactggatgcctgaggctgagatcattctctcaaatgcaatcctgaccccttgaccatttccagacctcagccagttctcagacccagactcaccaatggaaagagaagctgggtccccatgaggcaggaccctgaaacagcataccaaatgcaacctgtggtatgtcctcagtcctttccccaagggacctacagccactgaatcagatcatcacagctgataactgagggacacaactatctttgcagggctgttgcatatggagtctgcataacactcataacactggtactaggggacccaagtgccatcatgggccccccattaaagaagcagcataggggagttagataataagtggaaatctggcccaggtctatctcatggggtgggctatgttcatgaacccatttgaagattacgcccccagttcctacacaaataatcaacatggacccataagcaggcagactccttcatcagctccttgacctttgtggtaagacctattatggcaggaaagaacaagtagaagtccctgaacctgcctttactccaaagccagaaaataagtcaaaactgatgacactctccaaggcttttcacccacttctggcaaagacgaagtaacaggaactgggtttcccctctcagctgaaataataagcaaaaagattgaagaagaaaaaaaaaaagaaacactggttttcaagaaaggatattgggcaaagaaggacagtgatccccaagagaagaaaaacaaagtgagccctacaattgccttgtcttgctgccctgagagagtttttggactgcaatacagggaggaaaattgaggcagagcccaatgaatccaagttgaggtaacagaattgggggtttggggagaccaaggtggctagagtttgcagggcagagaagagagtggtacaaagagtgaaccctggagatctccagaaggttccccctaaaatattcagcaggatacattcatcacaggcctgggagggaatgacccaagcctggaaggaccaactgaaagggttcggggctgcaagacccagtacctatgcagaactgggagaagaaccagttcccaccagccagactggaaaatgtcatgattcacagggcattgggtagtgtaccaataaaagggtcttgccccagcagtggggaataattagccctggatggagtaatgtcccaggcctgcctgacaagccataaaagcaagatatgaaaggaacaagttgttccaaagtatcttaactgcatcccagaacaaagctcagccgtgttcataggaatgcagacgtatccagtatccaacacggcaaaattcacaacatctgcaaccaataaaaaattgtgggatctgcaaggaagcaagaaaatacacccataatggggagaaaaatcaacccattgtaacaaacccagaacagacatgaatgttagaattggcaggcaaggacattaaaacagttattgtaactgcattccctatgtacaaagagctaaacagagatgtggagagatgtgaaaaatgtaagaatgaaccaaattgagctgtcagtatgaacacagcaatgtctgagataaaaaatacactggatgagattacttaaagatataccaatagaaaatattccaaatgaaatgaaaaaacaagaattgttttaaaatgataagagtatcattgagctatgggacaatttcaggtggcctagtatacaagtaattagagggcctgaaggaaagaatagggagggacaaaaacattctgaaaaaagaatggatttttattttcaccctcaacatgtaaagagctcccatccttccaccggaaaaagcagaacaacctgaaaatcactaactttctcagacccatcagagacttgagattgtagagcaaatcactctcctgaaatcagggaaatggggaagtccagagagttgtggccaagactggcttactggagtagaagccacgggagacacaaacagacacagatgtttaaatggtagttctgatcaactgctgagacaggctaccctgagagtaagagatcctgggggtgtgcagtcttgggggctccacgctttcatggactttacctccaggaaccagtttctcactgtgaagagcgcagaagagcctggtaggaggcaggtagggggcaggggtgaagagtaattgtggagcaatttccataacaaagtactactcttctggggaaagatgtttccagagccttatcccacctgggtgaagggcatttccccaactccagccccttctagctctcctgtcactcccaagttgcaaaagctatgacactgggaaatacttgtgaaggtttcagcccgaggcacaggctcactgtaaggcatttaattgggagaatatagaacactattctccccctcatacctgactccctgtcagaataacataaaccctcacagtagagggctctttacctcagtttctattacctgataaacaaaaaatttacaaggcacaccaaaggataagaaaaggcacagcttcaaaagacaaaacaagtgacagaaccagactgagatatgacacagatgtcagaattatcacatagataatttaatataactatgattaacatgctaagagctctaatgaaaaaaatcgacaaaatgctaagaaaagatgggtaatcgagcggagatatgataatcctgggaaagaatcaaaaggaaatgctagaaataaaaaacattttagcagaaacagggaccgccttcaatgggattatcaataggctaagcaagtctaaggaaagaattgaggagcttgaagacagatcaacagacactttccaaactgaaatgcaaaggaaaaaagaggaattgaaaaaaacaaaacaaaaccagaacagagcaaccaaaaactgagggaaatttaaaaaatgtaacatacttgtagttggaataccagaaagagaagaaaaaaggaatggagcagaagagatgtttgcagttataatggcttagaacttggcaaaattaatgatagacatcaaaccacagatccaggaagctcagagaacaccaagcagaattttttaaacattaaaaaaccctcaactacacatagacatattatatttaatctgagaagacctaagacaacaagaattcttgaaagacacaaaaggaaaaataccgcattacctagagagaaatatggataagaattacaatgacctcttgtccgaaaactgcaagcaagaagacaatcagatgaaataattaaagtgttgaaagacatatactaccaacctagaattctatatccagttttatatatatgtgtgtgtgtgtatatacatacatgtatgtatatgcacatatatgtatatatacacatgtgtatatgtgtgtgtatgtgtgcatatatatttacatataatttttaaattatataaaaatgatttttaaagccctgagaggaacaagggccacaagtatgttcaaagtgttgatgatacatgtgtcctgcaattcacattaattctcacagctcttaggctatcattaaaaaaaattttttttcagcatcagtctcactctgttgcccaggctggagtgcagtggtgtgatcatagctcactgcagccttgacctcctggactttgaaatcctcctgcttcagcctcccaagtagctaggactatagatgtgctgcaccacacctgacaatgtttttattttttatttctgtagagatgaggtctcactatgttgccctggctagtcttgaactctggggatgaagtgatcctcctgcctctgcctcccaaagtgctgggattatgggtgttagccattgcacccagcctatatacagtgataggctgggtgaagagaaagtaaagacttttgcagacaaacaaaaatggaaggaatttatcaccagatctgccctacaagaaatgctgggattacaggtgtgagccaccacacccgaatgaaatgttaagattcttttttagacagaggaaaattataggtcagaaacttgaatctgcataaagagaaaaggagcatcagagaaggaataaatgaaggtaaaagtaagatcttttcttattctaaatcaatgtaatgataactatttgtttcaaataatattagtaagaatgcattgggttattacagcatatgggtaagtaaaataaatgacaagcattataagggatgggaggaggaatcgggactttatatagtttggtatttgttccctccaaatttcatgttgaaatgtgatcctcaatgttggaagttgggcccagtgataggtgttttggtcatgggagtggatccctcatcaatggcttggtgccctctctgcagcagtaagtttatgtgaaagctgtttatttaaaagggtctggcacctctcttgcttcctctcttgccatgtgacatgcctgctccctctttgccttctgccaagggtaaaaccttcctgaggcctcaccagaagcagatgatgacatcatgcttcttatacagcctgcagaactattaaacctctttactttatcaattacccagtttcaggcattcctttatagcaatgccaaatggactaacacaggacttatctgtgctactaatgaagtgaaatggtgttatttggagatggacttaggtaaatttaaaatgtatattgtaaatgctaaggtaatcactgtttatctgtttatcaacagaataaacagaaaacctacagaatgggggagatattctcaaactatgtatctgacaaaagtctaatgtccagaatctataaggaacttaaacaatttgatgagtgaaaaacaaataaccccattaaaaaatgggcaaaattggctgggcgcggtggctcatgcctgtaatcctagcatgaggatttgggaggccgaggtgggcagatcacgaggtcagcagatcgagaccatcctggctaacacggtgaaaccccatctctactaaaaatacaaaaaattagccgggcatggtggcaggcgcctgtagtcccagctactcaggaggctgaggcaggagaatggcatgaacccgggaggcggagcttgccgtgagcggagattgcaccactgcagtccagcctgggcaacagagtaagactccgtctcaaaaaaaaaaaaaaatgggcaaaattcaataacaaatacatctcaaaagaagacatacaaatggccaagaaacatgaaaaaatgctcaccatcactaattaccagagaaatgtaaatcaaaaccataataagataccatctcacatcagtcagaatggctattattaaaaagtcaaaaaataacagataacggcaaggctgcaaagaaaaggaacacttatatactgttgatcaaaatgtaaattagttcagccactgtggaaagcagtttgaagatttcttaaataacttaaaacagaactaccatcccaggcaacagtcccattactggttatatacccaaagaaaaactaatcattctaccaaaaagtcacacgcattcatatgttcactgtagcatgattcacaatagcaaagacatggaatcaacctaagtgcccatcaagggtagattagataaagaaaatgcggtacatatacactatggaatactacacagccataaaaaagaacaaaatcatgtcctttgcagcatggatgcagctggaggccattatcctaagtgaattaacagaaaaccaaatactgcatgttctcacttataagtgggagctacgcattggatacacatggacataaagatgggaacaacagacactgaggactacccaagaaaggagagaaggaagggggcaaggccttaaaaactacctattggatattatgctcgctacataggtgatgagaccatttgaacctcaggttcatgcaacatacccatgtaacaaacctgcacaggcaacccctaaatccaaaataaaattgaaattatattaaaaagtcactatataatgataaaggaaccagacttccaagaagatacaacaatccttaatgtgtatgtacctaacaacagagcaccaatacacatgcagcaaaagctgatagacctgcaaggagaaatagacaaatttactgttacagctggagacttcaagaccctacggccagtaactgataggtcaagaagacagaaaatagacaaggataaagttgacctgaacagcagttatagcccaacttgatctaattcacattttagactacctcatccaacaacagaataatacacattaatctctagctcatgtggaacattcatcgtgatagaccacattctagaataaaacatactttaattgaaaataatagaaattatataaagtgttcccagaccatagtggaattaaactagaaataaaaaacaaaaagctggcaggaaaatcctcaaatatttagaaatcaagcaatacacctctaaataatccaagctgaaaagaagtctcaagagaaatttaaaaaatatttttaactaaatgaaaatgaaaatacagtatatcaaaatttgtaggactcagcaaaagcaatgctgaatatagcattaactgactataattagaaaggcaatcagtaacctaagctcccaccttaggcctaaaacaagcagaagaaaaatttaataaaaattagaggataaatgaatgaaattcaaaacagaaaaaaatcaacagaaataacagctggtgctttgaaaatattaataaaattcataaacctctagctaggttaggcaagaaaaaaagaaaagacacaaataatcaatatcagaaatgaaaaagtatcatcactgttaatcccatggactgtgaaagcataataaagaaattctataattaactctatacccacacatttcacatggatgaaatagaccaatttctggaaagacacaaattaccaaaacttacacaaggtgaaataaataacctggatatccctgtatctattaaagaaattgaattaattgaattaataatagtagccttcctaaaaagaaattaccaggcccaaatggttttagcagtgaattctattaaaaatttaaggaagaagtcataccaaattctccaccaaaaaatctcttccaaaaaatcaaggtgacagacacactttctaactcattctatgacgacagcattactgtaataacaaaactcaggtaaagatattatgggaaaggaaaactatagaccaatatctctcatgaatataaatgcaaagaccttcttaaaattagcaaagtgaatcgaataataaataaaaagaattatgaagtacaatccaaatgggatttattctagatatgcaagatgggttcagcattcaaaaagcaatctctgtaatccacacatcaacagactaaagaaaacaatatataaccatatcaaatgaagcagaaaatttatttaacatttttctctctttggcttctttctgctctttctcttcttccccttccctgtcttcctcttctccactactcctctactactcctcttctcctctactccacttttctgaagggggaagacattagctctccaagtatgtaagaagtggctgcagccaccataggtatatccagtttctgtgacaagattttagtgatcttgtccaaagtatcttatgaccaacagctggagttaaaaagagtgaagtcagtaagatggcagaataggagatttccaccatcatccctccacaaaagcattgatgtttcaactacctatagatgacagtatctttgtggaagtccaggagtccagtggagaagttctagcacagttatagcaaaaaatctaataataaatgcattgaagagggtaaaagaaccgtttgactttatccacatcacccctttttcaaggcagcatagctcaatgccaaaataaatctattaggtccatgacctttccacagaggaaagtgagtgagcaccaggctcccccagccatatggcaaactgcccaagaggcccactgtttctcaccccactgagaacactgaggtggtcggcacagctaagtggttgcaagaaactgagagaaggtgagaaaggccatagaccctactaatttatctgcagacttcatcataaacatataatgtggggaaggaagaggagtgaagtagtttttgtatgggacttaagctattatcagcttaaaatagactgttatatgatgtttaatgcaattctcctggtaaccacaaatcaaaaacctatagtaggtacacaaaatcaaaacatacaattacagaaaatcatcagatcacgaagaaagacaataagaaaggaagaaagcgacaaagggtgtataaaatatccagaaaacaatgaacaaaacagcaatagtaagtctttacctattaataattactttaaatgtaaatggatcaaattctacaatcaaaagacacagaatagccaaagtgtggtgcactcctgtagtcccagctactgaggaggctaaggcaggaggattactgagcccaagagttcaagtccagtttgggaaacatagtgagatctcatcttttaaattaaaaaacaaaacacaatggctgaatgcatttaaaaagcatgacccaagtatatgctgcctacatgagattcacttcaactttgaggatacacatagactgaaagtgatgggaagaaaaatgatagttcatacaaatggaaaccaaaagagagcaggggtagctgtacttatatcagacaaaatagactttatatcaaaaactaacaagagaaaaagattattacataatgataaagtgatcaatttaccaagagaatataacaatattcaacatatatgcacccaacattgaagcacctaaatatataactaactaaagggagaaatagacagcaatgcaatgataataatagaagacctcaacaccccactttcaacaatggatagatcacccagacagaaaaatcaatatggaaacaagcactggacttgaactacactttagaccaatggacctaacagacatacacagaacattccattcaacagcagcagaatatacattcttctcaagtattcacagaatattctctaggatagatcatatgttaggccacaaaacaagttttaccaaatttaaaatgactgaaattatatcaagcgtcttttccaaccatttccaatttctagtttggtatcaaactagaaatcaataacagaaaaaaacagaaaaatccacaaatatatgtaaattaaacaacacacacctgaacaaccaatgggtcaaagaagaaatcaaaagggacaccaaaaatatctcagacaaatgaaaatggaaacacaacataccaaaatgtatgtgataccacaaaagcagttctaagagagaactttatagtgataaacgcctgcatgaagaaaaaggaaagatctcaaataagcagcttaactttatacctcaaagaactagaaaaagaagagcaagctaagctgaaagttagcagaaggaagaaaataacaacaagcagaggtggaaaagattaatgaaattaagagttgttttttgaaaagataaccaaaattgataaacatttagctagatgaagaaaaaaagagataagctaaaataaataaaaatgaaaaaggagacattcaactgatactacagaaatacaaaggatcataatagaccactatgagcaattatatgttaacaaactggataatctagaagaaacagatatattcctataagcataaaattaactaagaatgcatcataaaaaaatagaaaatctgaacagaccaagtaaggagattgaataactaatcaaaatcacatatcaaagaaaagcccaggacctcacggcttcactagtaaattctaccaaacgttttgagaagaactaataacaactgttctcaaactcttccaaaaaactaaatttttggaatacttccaaattcatattataaaacaagtattactctgatgtgaaagacaaggacactacaagaaaagaatacaaaccaatatccctgataaacataaatgcaaaaatcctcaacagaatactagcagcaaaccaaattcaaaagcatattagaagagtgacacgccaagatcaaatgggatttatccctcagacgcaaagatagttcaacataagcaactcaaaaaagtgatacatcacattaacagaataaaacataaaaattatatgattatctcaatagatacagaaaaatcatttgtcaaaattcaataccatttcatgataaaaaagtatcaataaatttggtatagaaggaatgtacctcaacacaataaaggtcatatatgacatctcacctctaacaacatactcaaaaataaaaagtgaaaagctttctccctaagatcaggaacaacaaaaaggatgtccacttttgccagttctgttatacataatactggaagtcctagccagagaaattaggtaagaaaaaaaagcaaaaaaaagaaagcatccaaatcagaaaagaagaagtaaaattatctctgtttgccaatgacatgattacatacatagaaaaccctaatgactccatgaaaaaaagttagaactaatcaatttagtaaatttttaggacacaaaatcaatatacaaaaattggttgcatattgatgtactaacaatgaactatccaaaaaagaaattaagaaaacaatttacttacaatagcatcaaaaaggataaaatactgaggaataaatttaatcaaggaagtgaaagatatgtacactgaaaactaaaacttggatgaaagaaattgatgaaaacaaacaaatggaaggatgtcctgtgttcacagatcagaggaattaatgttgtcaaaatttccacactacccaaagtgatctaaaagtcaatgcgaactctatcaaaattgcagtggcattttgcacagaaacagaaaaagcaatgctaaaatttttacagaaccatgaaagaccccaaatagctaaagcaatgttgagcaagtggaccgaagtggaggcatcacacttcctgattcaccaggactcaaagtcctggctatttcaataagacaagagagtgaaataaaaggtatatagattggaaagagagaaataaaactgtttatatttgcagatgccatgattttacatctagagaatctctaagaaatcaacaaaatactcctggaactaaaaagcaactatggcaaggacccaggatacacattaatacaccaaagtctatcactttcctatatactagcaatgagcaactgaagtctgaaatgataaaaaaaaaaagataccatttacaatagaacccccaaaaacataattcttaagaataaatttaacaaaatatatataacaccttgtaaaggttaattttggttgtcaacttgaagggatacccagataactggtaaagcattatctatgggtgtccctgtgagggcatttccagaagagattggcgtttgaatccgtggactgaataaggaagatctatcttcacctgatgtgggtgggcactatctaattgtctgagggcccagatagagcagaaaggtcaatggtctacttgctcagtctctctctatttatctacctacctatctttcctggagctgagacacccatcttccactgcccttggacattggaacccctggttcttcagcccttggactccaggacttgcaccagtgtcccccgggttctcaggccatcatctgcagactgagttacaccaccagctttcctggtcctgagtcctgcacacttggactgagccatgctcttggcttccctggttttccgtcttgcaggaaacacattgtgggacttctcagcctccataattgcatgagccaattcccataataaatcctgtctcatatagctctatcaattttgatatctacatctatatctgtatctatctgcatcctactggttttgtctctctgggtaactcatactacgtaccaggaatggttctagtggggacagaattttaagagtgagttccctaaattggttttagagtttctggaattgggtctttagtctgattagacttaaaaatgctaaggactctacttccaatagtaccaagagtaccgatagtcattccataaattgtttataaagatacgcaaaatacatgcattaagtactcctaagcaaccactttttaattttttttccttatttatttattttttattgtggcaggggctctctctgtcacccaggtgggagtacagtggcacaatcacagctcactgtagcctcaacctcctgggctcaagtgatcctttcttattttattttattttattttattttattttattttattttattttattttatattttattttattttatattttattttattttattttattattttattttattttattttattttttgtagagatgaggtctcactatcttgccaaggctggtctcgaactcctgagctcaagcgatcctcccacctcggcctcccaaagtgagcagccacttttaagaggcaaggaacttagaggctctgtatatgatactttggagcatttgtggaaaacgaaggaatgaatgaactgttggttactcctaatgttccaggacaaagtgatgaaggaaaagaatgagatcaggtatttggattctcagctcaagcaccgcataaatgacctaacagcggctaggtgtgtccctagggagaacctaggtcctatagccacagggtcggaattgctgcaagtcaaatgcaagccctcatcacgcagttctcggccttgctgggtgtctgtggtaggctcagataaatgcaacgtttttatcacagccccaggaaaggtttttgttgtttatgttgctgatgttgtgttttaaacaactcctctattaaaaaaaaaaaaaaaagaaagcacagagaaataaaagaaactctgattatcctgtattgtgcacagaaatacaaaataagaatctagaaattttagaatattcagctaaaaattcacattgtgtgtaaatggcatttactggaaagacggtgattcttaactgtggaattttgtctagaaatgttgataaatttacatcctaatgggattgatctcacatttggttttgcttacatgtttataaagcattaaagtttggttagccaaatttctcatacttgatatatatcagaaattgtatttaaaagctttacttctgttgtaaaattagttgcctgaaatgaataaaaccaattaaattgatatttaaaaaaaaaagggaaggcattggttgagaaagaattgatatgttggaatggggacctgggaggggggccttgatgaagctggggacattgcaccctgaaatactgagccttcttttaccacggaaaaagtctctccacaaccagcataagtgacattcccagccccacaggcagcagcgtccctggcccagtggaagcagcctccccgcccccagcagctctggcctttccacctcctctggggcattaacctgcgttgcctgaggaaagggtaaggacttcccctaaggcggttgccaggcaagtcagtgctgattctcctccggtccttcccccaccacctccctttgcttctggacctataacaagactcgcagcccaggaggcccctgaaggtgaggcccacagtgtgacacaggaggaggcgagccacaccccagaagagccacttgacctctctgatttacacagacagacacccaggggcatcagtgggagcagacactgggtgtgggcactgggggaggaacacggaggtggaggggccgggtgtgcagacgtgtccaccaagcagaggccgcactccaggctgcagctaggggacttggaaaagctctaactggctggtcggttgaaacatggatcaaaggatgcccgcagtgagcgagctggaggtacccaagctcccttggcttaacatagaggaaggggttcaaaggctcagggagatgggaatgtgacaatgaaaacctcctcacccaccctgggagggcccaggatgcaggcctctcacaacactgagacatagatctgtgagggagcccagtctccttgaagagctctgcaattgttcttctctgtaggccagactcacagtgggaattgcagtcaatcaactgcgaaactttacatgcaacggggaataatcggatcctggggtagcaggggccaaagaaaaagtgggtgtggttaccatgatggacagcagaagcgaagcagcaatcagacctgggtcactggtctgacccatgcagacctatggcactggctgcttatcatgttcctagcagtgaaataaacaggaaatctgctcaattcctactggatacaagcagtaaacttccaggccaagtggacaaaagtctaagttcagtcataaaaacacagagaatcatggccttggtcattcacagacttgagacagtctacggacccagaaccctcgaatgcaagaaaggcgggtacccttgagaaaaagtctccccacaaccagcataagtgtcattcccagccccagaggcagcagcgtccctgccccagtggaagcagcctccccgcccccagcagcacgggcctgtatagtccccagaatttatcctgataatcttttccgcagtcttcctgaaagagactgtgtattggagaaaagaaaatactgcaacatttcgggacgattggacactggctctgtcctgacattgattctaggagacgctggaaggacactgtggccctccagttagggaggggcttagggatccaggtgatcaatggagttttagctcagatctgactctgtgggtccagtgggtacccagcccatcctgtggtcatcttcccagctccagatgtgtaagtggaacagacacactcagcagccagcagagtccccacatgcgtcccctgacctggggtgtggtgtctgctatggggggaaaggacaagtggaagccattagaaaggcctctacctagaaccgtcagtcaaaagccatcccacatccctgaagggactgcagacatcagtgccaccaccaaggacttgagaggtgcaggggcggtgatccccaccacagccgattccacccgcctatttggcccgtaggagagacaggcgggtcctggagaatgacaggggactgtcctaagtttgactccagctgcagctgctgggccagacgaggttccatcgcttgagcaaattagcacatctcctgctccctggtgcgaagctcttgatccggcaaatgcgttctcctccacccctgtccacagggcccagcagaagccaggccagcaatgccccctcgccgccccacctcaggggcctctcgcctctccagcccgtgtcagaggtaattctcaggagtctcgatcaccgctcccttccccaggatgtcacactggcccattacactggtgacatcatgctgacgggacgtaaggcacaagaagtagcctccatcctagacttgttggtgtcggagggtggggaataaacccaactggaattcagagccttctacctcagggaaacgtctaggggtccaatggcgtgtggcctgtggagttacccgttctaaggggaaggataagcagttgcatctgccccttcttagtcataactaagagacaatgctgaatggggcctcttcgaatttttttttttttttttgagacaaagtctcactctgtcacccaggctggtgtacagtggtgcaatctcagctcactgcaacctctgccaccccccaaggttcaagcgattctcctgcctcagcctcccgagtagctgggattacaggtgcacgccaccatgcccagctaatttttgtatttttagtagagacgggatttcaccgtgttggccaggctggtctcgaactcctgacctcaggtgatccacctgcctcagcctcccacagtgctgggattccaggcgtgagccgccacgccggccctctttgaatttagagcaacacatttctcatgtagttaatctggcccaagtgccctgaaaagctgccagttttgagtagaaaccagagcaggagaaggctctatggcagatccaggctgccgtgcaagctgctctgccctgtgggccatgtgacccagcagatgcagtggcgtctgggatgtggtgttagatggggtgccgtaggtgaatggtgactggttggtgttagatggggtgccgtaggtgaatggcgactggttggtgttagataggggtgccggaggtgaatagtgactggcgtgtggtgttagataggggtgccggaggtggatcacagcacgggcctttaggactttgcggcgaggccctgccaccatccacagataaccactctcctttggagagacagggcttggcctgctgccgtgccttagtagaaactgaatgtttgaccatgggccaccaagttaccctgtgatctgagctgcccaccatgaactggggaattatctgacccacgtagccataaagttgggcatgcacagcagtgctccgtcatccaacagagaggtatatacatgatccggcctgagcacatcctgaagacacaagtaagttacatgaagaagtggcccaaatgcccgtggtccccactcctgctacactggaaaaggcaaaacgagagagacagtagacgcatcagtcattgccagggggctggtagaggagagaggtaggtgaagcacaggaggttttttttttagggcagtagaactattcttactaccttaaaaggtactgtagtggtggctacaaggcataagcatgtctcaaaagctataaaactttacagcacaaagagtaaaccttaatgcatgcaaattttaaaaaataataatttaccaggtcaggagatcccaggatggaaagcagaatgcgatgcagtcatcttactgtgctatctacgtatgaaacaacctcactgagggagctgggaataaagtgctggcctaagtaactttggaaatgagtggagtctgtaagactcaatgcaaaaataactatacataaacactgtaccctagttggtaaggttgttgcttatgcttgtatgggttaacaattctgatatcatcctgatatcagatatcattccagaatacgtattctggaattggacagttaagtaagtggaagtaaaatggtgggaaccgagtgtcttatggttgcagtagaaggttacagatgagcaaggagagactagaaaaatccatgtggggcaggagtacagttagagacatcagtatcaaccgatggttagcgtaatatagacacagatggttacatttagaaatactatgatgtgtgcatatacacatgctaatgtatacacatatatttcctttctctgtccgctgagagggcctaaaagcaaagaaatcccagtagcaatgagcaccagatcttggtatcaaataccactctccagtaaaagaaatcttggaaaaaatagctgattctaggaatagcacaggaaatatatacgatggccctagatgcttttacactgttggtaggaatgtaaattatttcaacaattgtggaagacagtgtggtgattcctcaaagacctagagacagaaataccatttgactcagcaatcccattactaggtatatacccaaaggaatataaatcgttctaccataatgacacatgtacacgtaagttcagtgcagcactattcacaatagcaaagacatggaattagcctaaacgcccatcagtgataaactggataaagaaaacatggaccagcctggctaacacggtgaaaccccgtctctagtgaaaatacaaaaaattagctgggcgtggtggcacacgcctgtagtcctagctagtcgggaggctgaggcaggagaatcgcttgaacccagaaggcggaggttgcagtgagccaagatcgcttcactgcactccagcctgggtgacagaatgaaactccatctcaaaaaaaaaaagaaaaaaaagaaaaagaagatgtggtatatatagatacacataccatggagtacgacacagccacaaaaaagaatgagatcctgtcctctgcagagatgtggatggaggaggccattatccttagcaaactaatgcaggaacagaaaaccaaatactgcatgttcttactcaaaaatgggagctgaatgatgagaacacgttgacacatggttgggggggaaacacacactgggcctactagggggtggaggcggggaggagggagaggatcaggaaaaataactggtggatactaggcttaattacctggctgatgaaataatctgtacaacaagcccccataacacatgtttacctatgtaacaaacctgcacatcctgcacatgtacccctgaacttaaaataaaagttaaaagaaaagaaaaagaccacgttagagcatcttgtagtaccaaaaagtaagaaagcactgcagacaatacctacaattatggggatatgccaaagggatacaggagccaactgaaagagcttccagtggccaaagctggaacaatttgaataaaacaaaataaatgaagtagtaatggattataacccaaattataaaataaatattctggagtgcaatctgatacaaatcaatgattgaataaataaatatatggaagacaacagacaaatctaccatgcagaagaatttcaaacaatttatgtagctacttcacccttaacaaggtggagcataactccccactccttaaatgtgggctgtgctagtgacatccttccaaagaggacagtattaaaaggggagaaaagagtcacttaatggtggagaaacctgacaaacagcatgtgttaggccgttattgcattgctataatgaaatacctgagggtgagtaatttataaagaaaagaggtttaattggctcatggtttggcaagttttacaggaaatggtgctgacatctgctcagcttctggggagtcctcaggaagcttacaatccaatcatggcggaaggtgaagggggagtgggtacatgatatggtaaaagcaggagcaagagagacagggagggtcttttttaaacaaccagaccttgcaagaattcactcactagcacaaggatagcaccaagaggacggtgctaaaccattcatgagaaatacacccgcaggagccaatcaactcccaacagaccccacctccaacactggggattatgtttcaacataagatttgggtgaggatgtagatgcaaaccatatcacagcacctgggccaggtgataaaagtcaacatcaagagcaataagccatgttgataatatagagccttaatatgatgcgaatggcattacctctgtcatcttactcaaacccataatcccaaattaatcctgagaaatcagacaaatcccaattgaggaaaatgctacaaaacacctgactagtatttctcaaaaactgtcaaggtcatcaaaagaaagcaaagtctgagaaaacgtcaccagcaggaggaagctatggaaacatgactgctaaatgtaacatggtatcccggatgggaatcctgcaacattaggggaaaactgaaggaatctgaaaaaaactatagactttacttaataataatgtatacatattggttcattaaccatgataatgttccataccaatgtaagatggtgataataggacaaactgggtgtggggtttatgggaattccctgtactatctttgcaacaattctgtaaatctaaaactgttctaaaatgtaaaactttattgaaactgtcataataggcaaaaaaatccaaatttgagaaaacctataaacacacaaatctaaaaattttaatgagtcccagcataagaatcactatcactaagaaaattacactagggaagataataatcaaatttctcaaaatcagtattaaaaataaatcttaaaagcagccagagggggaaaaagacacattacatacaaagaaagaaagaaagataagagtgacatttcttaccagaaataaatcaaagaataaaagggtgagcagcatctttaaaatagggaaagcaaataaattgccaactggaattccctattcagtgaaaatatcttccaaaatgaaagtgaaatcgactttttcagatatacaaaagctacaagaattaattgtcaactgacttgcactgtaagaaatgttaaaggaacttcttcacgcagaagaaaagtgatatcaaataaatatatggatctcaaagcaataaagagcacagaaatgataactacatgggtaaatatgtactttttatcttgctatttacatatctttaaaagataattatagttgtaacaataccaaaataattcaagatgttaacaatagagtaaactgaatgtggcatagactgggaactctctgtactaactttacacattttctgaaaagctaaaactattctaaaataaaaaatttatttaaatattaacttaataatgagaaacaatatagtgtgaggtttataatatgcaagtaaaatgcaggacaataatagcataaaagtgaggagggaagaaatggaaatatactattgtaaagtttttatgctatgtatgatgtggtcaaatatcacttgaagaaagactgataagataaatatatgcattagaaatcctaaagcaaccactaaaataatgaaacaaatggctatagatcataagccaacaaaggaaagaaaatgatatcatgaaaaatactcaatctgaagaaaaaaacagatgaagcaaatataaaacaaattacaaaataatggacttaattccaattatatcaacaattacattaaatataaatgatctaaacaccttcattaatatacatagattgttgggttgcatagaaaaagcaagacccataaatatatatatgctgcctaccaaaaatacactttaattataaagacataagtaggttagaagtaaaagaattttaaaaagcataagcaaaactagcaccaatcaaagccagaatagctatggtaatataagggaagcagatttaaaagcaaagaatattactgggacaaaaaaggtcatttcataatgatataagagtcagtccatcaagaggatttagtaatcaaaatgtttatacacccagtaacagagccttaaaacaaataaagcagaaaactgaccaaattactaggagaaatagacaaattcacattataacaggaaattcaatattcctctttcaataatagaacaagtagacagagaattggtaaggatataagagacttgaacaaaacaatcaacttgatttagctgacactaataggacgctccacctgataacaacacaatacataatcttctcaagtgcacaaggagcatttactgagacagatcttactatgggccataaaacaagtctcagtaatttcaaaaggattcaagcaacacaaagtatgctctctgaccaaaaagaaattgaattacaattcaaaattaaattcaaagttaacagaaagaaggaaacaataaaaatcgagaagtaaatcaaggaaacaaagcacagggaaaaatgagaaaaaaatcaataaaccaaaaatggattctttttgagaaaatcaatcaaattgctgaacttctaccaagattaatcaggaaaaaaaagacagaaactgccagtattaggaagtaagagagatgacatcatttacagattctacagatatccaaaggataatacgggctattacaaataactttattctgataaattgacatcttaaacaaaatgaacaaattcaatgaaagactgaaattaccaaaactcatacaagaaaaaatagataacctaaatacactcacaaacacaaattaaatttctagtaaaaattctattcacaaagaaaacatcacagcatcactggtaaattttaccaaacatttaaagaaaaaggataccaattctagaaacactctttctaaaaattaaagaagagggaatactccttcaccatttctatgagaccaggattattaccctgataccaaaagtaggcaaagacattacaagaagagaaaactaaggctaaaacctgtcataaaaatagatgcaagaattctaaacaaaattttatcaaatcaagcctgaaaatatgtaaaaaggataatatctcatgatcaagtgtggtttcagaatacaaggttggtttaacactcaaaaatcaatcaatataaattttcatattaatgaaactagaaaaggaaaagcatattattatcaatatacatatgtgcactggttagggttctccagagaaacagaaccaacaggggtgtgtgcgtgtgtgtgtgtgtgtgtgtgtgtgtgtgtggagagagagagacacacagagagagagaaaaagagagagaaaatccaaaatcggcagggtaagtggcagactggagccccaggaaaaagctgcagcccaaatccaaaagcagtctgctggcagaattccttctggcttagagaaagtcaatctttgttttgttaaggccttcgtcaactgcttagatgaggactatggttca

SEQ ID NO: 27 - DNA, 188409 bp, Artificial Sequence
  Synthetic BAC sequence
agcttatcaatttgactgagcctcccaaaaaactaatttttactttcattggttttctctttttttctgtttcctatttcattgatttctgttttgatcttcattctttctcttttacttgggtttaatttgctcttctttcctcagtttcttaaggtaaaacttgaagccgttgctttgagacacttcttcttttacaatatagcagctagtgctatacttttttctttaatgaccagtttatcagcatcccacaaatttgcatgtgctgtgttgttacttttattcagttcaacaaattttctaatttgccttttgattttgtctttgatccatgagttatttagaagtctgttatttggcctattatttagttcttaatatttgggaattttccagagatatttttgttattgattcctaattctattctgttatggccaggtaatacatttggcatcacttgaattctgctgaatttagtaagacttattttatggcccagaatatgatctatctttataaatgccccacctgcacttgagaggagagtgtagtctgccgtcgttgggtggaatggcctataaatgtcaattggatcaaatttcttcacagcgctgtctacgtctactcaatccttactgagtttttctgcctgctcgttctcatagttatggagagggggtattgaaatctctgactgtaattatggttttgcttacttcttgcaatctcatcatgcatttggaagctatatgattaggtgcctaaatgtttaggatgcttatttcctcttgaagaattgacctctttatcattataaaatagccttcattatccttataatattctttcctccaaaacctcctttatctgaaatcaggatagtcactccagctttctttagacaagcattagcatgttgtaacttttttcattctttttcttttggcctatttgtgtctgtatatttaatgtaggcagcacacagtcaggccttgctttttaaacccaatttgacattttctacttgtaatgaggtttagaccatttgtatttcatgtgattattgatgtcattaggcttgaatcttctatcatcttcctatttgttttctatttgccacacttattctttattatttttcttctctgtcttcttctgaattgattgattttttttctcttttgagacagagtctcactctgtcacccaggctggagcgcagcagtgcgatctcagctcactgcagcctcaacctcccaggctcaagtgatccttcaacctcagcctcctgagtagcgggaactacagacacacgccactatgccatggctaattttttgtatttttggtagaaacagagtttcaccacgttgccctggctagtctcaaacttctgagttcaagggatacacccccccctcagcctcccaaagttctgggattacaggtgtgagccgctgcacccagcctgaatatttgtcatgatttcattttatctcttttgttgactttgtagctataacttcttgtttattttgttagtccctttagtatacattttaagcatcactctctacaatgtctcaccacgttacttatagggaagcaccttgcactcggacccttccacttcccctcagtcgttacgcagttcttgtcaagcattttacttttacgtatgttaaaaatctcataacacaccgttattattttttctagtctattaccttttaaagtgatttaaattatttttattgtttaaaaaaatttttgtgggtacacagtaggtatctatatttataaagtacatgagatgttttgatacaggcatgcaatgtgaaataagcacaacatggagaatggggtatccattccctcaggcatttatcctttgagttgcaaataatccaattacattctttattttaaaatatgtaattaagctattattgactatagtcaccctgttgtgctatcaaatagtaggtcttagtcattctctctatttttagtactcattaaccaccatccccaccttctcccaaccccgcttttaaagagttttcctttctttctttctttctttctcttttttttttttgagacggagtcttgctctgtcacccagactggagtgcagtggcgcgatctcggctcactgcaagctccgcctcccgggttcacgccattctcctgcctcagcctcccgagtagctgtgactatgggcacccgccaccacgcacggctaattttttgtacttttagtagagatgggtttcaccgtgctagccaggatggtctctatctcctgacctcgtgatccgcctgcctcggcctccaaagtgctgggattacaggcgtgagccaccgcgcccggccaaagagtttttttttttttttttttaacttttaagttcaggggaacatgtgcacgatgtgcaggtttgttacatacctaagtgtgtgtcatgggggtttgttgtacagattatttcatcacccaggtactaagcctagtatccattagttatttttccggatcctctcccttctcccaccctccacccttcaataagccccagtgtgcattgttccccatatctccacgtgttctcatcatgtagtttccacttataagtgagaacatgcggtatttggttttctgttcctgctttagtttgggaaggattatggcctccagttccattcatgtctctgcaaaggacatgaccccattccttttttttttttttaacatatctttttcattaatgagtaaattaaacagacgaaaaaagtcagtgaggatatagaaaatctacacaacgtcattaacaaatggacttaaacagaagacaaaaccctacactcacagcagcaacaatacatgcattattcaagcacacacagtatatttgtacaacttgatcagagacggagccattaagaaaatctccacacagtttaagggatttatagcacaaaaagtatgttttctgatcactttgttgctaagatggagatctgaaacaaaaatattattgaactcttgaaaggttgaaaattaagaagtcacttctaaatagtccagacctcattcctttttatggctgcagagtattccatggtgtatatataccacattttctttatctagtctgtctttttttttttttttttttttgagatggagtttacttcttgttgcctaggctagagtgcaatggtgcaatctggctcactgcaacttctgcctcccgggttcaagcgattctcctgcctcagcctcccaagtagctaggaccacaggtgcacaccaccacacctggctaattttgtatttttagtagagacggggtttcgctatgctggtcaggctggtctcgaagtcctggcttcacatgatccacccacctcggcctcccaaactgctgcgattacaggcatgagccaccgcgcccagcctatccagtctatcattgatgggcatttaggttgattccatgtccttgctattgtatagtgctgcaatggcgtgcatgtgtctttatgatagaatgacttatattcctctaggtatatacccagtaaaaggattgctgggttgaatggtagttctgtctctaggtgtctgaggagttaccatatcgtcttccacgatggctgaactaatttacacttccaccaacaagagaaaagcgttctttcttttccacaacctccccagcatctgttttttgactttttagtaataggcattctgactggtgtgagatggtatatccttgtgggttgttttgttttgttttgttttttgagacagagtctcgctctgttgcccaggctggagtgcagtggtgcgatcttggctcactgcaagctccgactcccgggttcaagcaattctcctgcctcagcctcctgagtagctgagattacaggcatgcgccacgacacctggctaatttttgtatttttagcagagacagggtttcaccacgttggttaggccgctctcaaactcctgacctcaagtgatccgcccacctcggcctcccaaagtgctgggattacaggcgagagccaccgcgcctggcctccttgtggttttgatttgcatctccaaagaaatttaaatgattttaaaatctcacgtgtttgcccatgtagttaccatttccagtagaatgtagatttctgtctgatttcacgccgcttcagcctgagtgaatttcttgaacgtcattcacggcacggttctgccggcgatggagcttcagcttttatatctccaaaatgttcttatttaaatttcgtttgtgaaggatgttttacccaggcatagcattctgatgctgatgggttctttttgtttcagcaatttaaaggtcttgctttcccgtcttcttgcattgcgtcttgtgggaaatctgcggccatccgttcctctgcacgtaccgtgttccttttgcctctagttgcttttaagattctcattttatcactagtttaaacaatttgattatgatgtaccttggcttggttttagtcctgtttcctgccctagggagtcattgagtttcttggtttatagttttcattaagtttggaaatgtttcagtcattatttcttcaaacatttttctttctccctcctgccccaaacatacacacatctctccttcaaggaagccaattatccatatattgggccacctggagttacaccagaactcatcgatgcagttaaaaacatttcttttgtctctctgtattttattttgaatggtttccatttctatgtcttcaaattcagtattcttttcttttgctgttaatctcatccagtgtattttttcatctcaggcatggtagtttttactttagaagttgtatttgagtcttttaaactatacttcatgtctttaacttcttgcagctgtggaacacagttaggaagctgtttcaatgtctttttctgataattttgtgtccgtctgcatcagtttcagttggctgatcttcctcattgtggggcatattttcctgccttttcgtgtgcttagtcatctttgattggttgttgtgcattgtgaattgtacctttttgggtgttcagcattttgtactcttatacattttgtttggactttgtcctgggctgcatgcagttcagttacttggaagcaggttgattctttcaggctttactttatgatttgtttgatgaccccaggcaggcacactcagggacggtgagagaatggagacggttgaacacactctgcgcagcagcctgctgcaccttcctgggaggggcatcccatcccaacatacaccggggtgggaactgggaggaggccagtgtttcagcgacactcacggcgagagtgagtccactccagggtgcaccaagaaaatgcacaagtgagcctgtagcccaggagaggcctgacctgaggaggggaggctggagaggtgggcaaccccaggagaacacagagcaggggccgctgcctcctcagtcggcactgctcagaaagcgcacgcagtggtaggaaagcgtccaccagactgagcaggaggcggagtgcagagactgaatgagcctgtaccataccatccaacacacccatgcacacacacacacacatatcacaccaccacacacacatcacacacgctcacatcacacacacatatactcacacacatcacacccatgcacacacacactcacacagatcacacccacacacacacacacgcagactcaaatcacacactcacacccaggggagaaagaacagaccttggaaccatgttgatcaggagcccgggaggaggcaagcctgccttggccttggggaggactgacacatggtctgccagtcagaggtgctcccaccgtgaccacctggaacctttccattcagtgaacgctccaggagggcgtcagggtctcgaggacacagctgaatgagtgggccgcgtcttcaaggcctggcaggggaagctgagcagcctgcaccccagatgcattgtgatggaagcttctgtgggccatgggcaagaagtaactgggagtgggaaggccctgtcacgacaccaggaggggcctggcctagaccaggcagtgggtggagcgggcagctgtgccggcctctgtgcctctggtccggggcagtccatgtaatttcatccaggggctctagaaatctcatgaagggttcagacaatgacaggatggccagaggggatcgggggtggcagtggggtggggaggcccagagacccaaggatgatgagatccagcccccgggcgtggtcagtgtggcagggcagggtgtgtggctgctgggtgacagaagggctcgaggctggtcgcctggagggcgttttgaagccagggtggacgctgatccatcctgagaccaggaatccagggcatgggagagacgacgcctgggtttggggcacctgaagggtaaccaaacacgtatcgtggccgagacttaggagtgaccatctggggtgatttccaagggctggggggcagaagccactatcgggggggacctggcagcccctcacccacactgacccaggctccagttgcttcttgagttcctatggcctcggagcaggacaccccacaccctgtgctcaccacaaagaagccaggatttgagggactggtggaagctacccagagactttgggtctccagggactgtaatgagagacacagctgtggcaaggtccagcctcctcctgactgggcccagccacccatgcagtgcacggatcagggctcagcagggccctgtgtgtgatggggagagccagactctgcaccagctccgggagcccacaagccaggggtccaggtgtgcctcccaagccaggcatcctgagcctttctgtgggacagtcctcatgccaggggactcagcaggtggacgggaaggcccttagcctcatttactcattgaacagacctgcgtggcgtctccggcacaggcggcctctcctcctccacttccactccaaggcccactgggactgcactggcaggcagtggcagatgaggaatgccaggggcggggtggcaggcgaggggtagggtcaggaaaggcctcacagagaaggtgacacctgagcatggacaaaaggaggtaaggacaagccctgcagtacctttccggaggttctgtgttcccctcgaacagggacaagcggccagtgcacatacaagagccacggggctggctacttaccgaggaatgcacgtcagaaccagtaggacagctgccatcccaaagccagaccacggcaagcgctgggcgtgggggagtcggagctgcctgtgctgctggggatgggccgtggtgccaacgctatggggccgtgggctcctcacacatgtaaacctacggttgccattccacccatcaagcccgctcctgggaatgtgcctacaggaaatgaaaccctaagtccacacgcaaatgcgtgcatgaacactcatagcactccatctcctttggccaaaaagggccaacagcccaaatgtctaccatctgatgacaggattaagcaaatggggtccatccatacaatggaacatgactcagccatgaaaaggaaggggatatggtttggatctgtgtccccacccaaatctcatgttgaattgtaacccccagtgttggaggtggggtctggtgggaggtgatttgatcacgggggtggatttctcatgaatggcttagcaccatcctcttggtgctgtctttgcaatactgagtgagttctccccagatccggttgtttaaaagtgtgtggcacctcccctgctgtgtctctctgattccgccatgtgagacaccagcttccccatcaccttctcaccttcctgaggcctccacggaagccgagtggatgcctggcgccatgttcccatacagcctgcggaactatgagccaattaaaccccctttttctaaattacccagtctcaggtatttctttatagcagtgcgagaatggagtaacacagagggaaattctggcacatgcgacaatgtggaggagccttgaagacactacgctcagtgaaagaagccagtccccggccaggcgcggcggctcatgcctgtcatcccagcactttgggaggctgaggtgagtggatcatctgaggtcaggagttcaagaccatcctggccaacatggtgaaaccttgtctctactaaaagtacaaaaattagctgggcgtggtggtgggcgcctgtagtcccagctacttgggaggctgaggcaggagaattgcttgaatccaggaggcggaggttgcagtgagccaagattgcgcctctgcactccagcctgggcttcagagagagactctgtctcaaaataaataaatacaaataaaaaagaaagaaaccagtcaccaaaggacaaacgccatgattccactcacacgagctttctagagtggtcaaagtcatagagacagaaagcgccaggggtaccaggggctaggggagggaatgcggagtcggtgttcgatgggggtgggggttcagtgtgggaaggtgagaaagttctggagatggatgccggtgacatctgcacgacgtcgtgaatgtacatagtgccacagaacagtgcacttaaacacggtgaagatgatcgaattcacagtgtgtctattttgccacaataaataaaggaatccatattttcctatctatttttagactatcatgtggggatttggcagtgatcaggttactcgatttggtgcagttagaaaagttcgtcactgtttaagcaaataggaaagccgtttatcctgcctagctgtgagaaaatcccctagcgtctttgaaactcttcgggagcgcccccctcccacacgcctccttcaggctccacccagtgccgggcatttgattctgctgcttcgtgcacaccagaccggcactgggcaccgggccgtcatctgcttctgttaataaagttttattgacactctgcccccatcatttttatgtatggcctaaggttgcttccaatggtggaactgagtcattacaacagagacctggagaccacaaaccctaaaataccacgtcagatccgcatgtggaacaccctattgccaaatatctgcttggagctgtgtacatttttcctcgatcccacgactaaaaccaattgtaataaaacacgataaaattaattttgaaaatccaaatgcttgatctaaaaaaaaatgtggccccaggatgtgggcctttgagcagaaagcctggccgcgcaaggaggggctgtggaggtgagggcagggctggtgggctagggctgagcggtttctggagtcccaggaggcctcaggagatgtggggagctgggcagtcggcccggagggcagggcagggaccacccagacatggaaggtgtggaggccagctctgaaaatggggtgggacagaaagggaagaaaggggcatgagccagcagccgggcagtcagagccaggggcccagggagcagtgtggtttgggtaacgggtgtttgcctgcatcaggcactgccctgtctggggaaaaacagagccaagaaaggactcgtgggtttggccacctagaggccaccagaggccttgaagagagctgctttggggaggtgggacagtcccgtggatgtggttcagaggaggtaggagaggagcacagcccagagcagaagcgctcgtcttcggagccagcaggtggaattaatggccgcaaaggtgtctgatcctcatctctgaatgtgacctaatgaggaagaagggtctgtgcaggtgtgaggaggtgaacggctttgagatggcaatccggtcctggaccatctgaacaccataaacgccaacacaaggtggttataagagggaggcagctggagatttgatgacagaggggcggaggaggcagtgtgaagacagaggcagagatgagaggaacgggaccacatagcatggaaccgcgggagcccccaggagctgagagatgcaggaagggttccgcctagagcctcagagagagctggccttagacacggtgaggtcttaagagagggtgtggtcttagagggggtgtggcctctagtgagggtgtggccttagagagggtgtggtttctagtgagggtgtggccttagagagggtgtggcctctagagaggctgtggcctctgtgccagcagattcactgctagagtgaatagatgggtgtataggatcctcatgtccccagctgacagttcaggccctcagatctgggaatcaaattaaagagtgttctgagtccagggtcccgaggaatgctaccacccgatgaggggcgagtgtaagggcagaggtgggttgggtcctggaagctgggcagtgactcatctggagcccccctaggcctggccagctgggcctgccaccctcatgccccaccctccaacacccccgatgctgctgctcagggccacctggaagctgagccccatctggctcctaaagtcagcatgaagaccccgaggccaccaagcatgccaaaaataattcagctaggggaggaaggtgaggggctaagttctaaatagggcacagccacaagcagcacaagcctcactgccctctgccccttgttgatgctgggccaacagaccctgtcgtaaggatgcctggtcctggactccctacccccgcatggcagggccaggcagacctgtggccagcagctgcctgagtttaaagggggctccagtcctcataaaggccatggggagggcgggcatggggtctgctcagcaggtaccccctgtcctgctggccacctggtagcctcctgacccctggcccctctcggctcacccaggagccaccacgccctacccactggattaactgggctttgcacatcatttccaaaagacactgggccacaaaactcccattcagccttgtgacgttatcggctctctgaccccagcctgcttcccggccccccggccccctccacaggcctgctcatctggctatgcagcctccaacatctggactgatgaaaagccaccgccactgccatccccacaggcaagtgcgcacagaggcaagcgggccgtgtctatgcgcacacttgtatgtccagggcttggctgtccagggctgagggcaggacaagagccacagcagctttgaagacatcggattctggggctgggctcagagtggccgccaccttgcagggtcccaccaagaccactgcagcctggaatttcctgctgacactggacgtaggaggcctggagggcctgcaggggtcagccagcgcctccaggaccctcactcaaaccttgtcccacgccttaccaccttgcacctggtcttcccacaccaggaaaagcccctcccatcctccagaccccaaaactctcaggcggcccccacactcttggaagcccatgacttgtcatatcttctggggagttttgggccccagtacagcccacagcacaacctcctgaggggcttggtttatttatatttttactgtaatgacttacttgaaattttgcttatttattatctttttatctctgacaccctgaggggcttgggaagggtgaacggagtgacactctggagggggccacaggctaacctgcaggcctcacatgtgggtggaggtggaagaaggggcttggattctgggtcctggctgcacagccccggtcggaggcctgtggggctgggggctggggagctggcccccaggctgtaattaccaggctcacctccacctgaagtggggtgtggtggcctcagccccaaattacagagcacagctgcatggtacagtgcgggcaggaaaacagggcctgctcctgtccggctcccaagcccttttcccagctggcttcgcctctgctgagcctggccaccccagaaccagcaggtgggctccagggaagccctgcagccaggccagccctgcccactcttgtgtccatgctctgacagcagccagaggggccctggcaaaggatgagcaagggctggagccccctctgctcccaccccacactctcatctcacccaggagtcctctgcatctgcgtcccctgtgggtgcaacacaggaccacaaactcggtggtttaaagcaacagaaatgggttctgtcccaattctggggggccagaatttagaaatgcaggtgtcagcagggctgggcttcctccaggagctacgggagggtccctcctgcctcttcccgcttccaggggctgctggagctcctgggcctgcgggtacatcactcgcctgtctctgccatcacagctggcactccacacccttactttgttcattcctgtcagcccacgggaatgtggacctcaagacaggagagccgggatctctgtcctctccctgctgcaccccagccaccagcatggctgcagagcccaagacagcagacggaggaggtagtgcggtgtgcgcctttggggccggtggctcgggaagggcaggcagagccctctacgggggactatgtcctttgtggatgggcagaacagtgcacagtgggagtgccttgcactaacagattggaaactgaggcacagaggggaaaagcgtccctggtcctccggcctggtggagcatgagaatctggcgcaactggctttgctgtggactgactagtggatgctctcaggcccagggtccggggtctgtgcctgccaagcacccaggtgatacgtgggatggttactgagagctgccagggctccaccgtgtgctgggtatgctgccaggggtccacacatgaggcccttcaccctcctagcaactatgagatgctcatcatttagaaggggaaactgaggctcatgttggagtattgaggaacgccttccagcaccactgtgcaagcggtaggcctgcctggggcagtggggagacagttcccggagggcagcagaagcagcaagcgcccagagtctggcccatgccaagccttggggcccctggaagaccagcctgatggcagaggctgaggcttccccgtgggctccaggggaggtgggaggccaggctggctttgacaagcccccactgtctccttccagcagccccagccggtcccagcccctgccttggggcttctcagcctaggactggctcatccccgcttgctgcccacatcagccccatctagtccctcctgcaagcccccgctccatcaaccctctttcctacaccccaaccattgcctggggtcctgccttccagctccatgctgactgcacaccctgagccctcgccagctgcccagggagctcctggggccagtgcaaagctatccatcccctctgcagccaccctggccctaagcaagcaagagctcccagccatgactggacaaggtcctgggtgaaggaacaaacaagggaagcttctggggaggctggggaggctcctggtcagcaggaggctgccaggtgcgggtagtaactgactcacccggtaagtcttctgaggaggcccgggccagtggaactcccaaccaggtccccggggaggaggctgcctggcaggctggatgggagccgaggccagagtgtgcctggagcagcccctggctcagccaggcagcagcttggggcctcgccaggtggtggctgccagcctccctgtgagagccgccgcctgtggtttgaggctttctggctcccaggctggcttcctgcccagtgggtggtgaggctgtgattgcagcacgtcccacctggcccctcctggggctgggccctgcaccagctcctgcctttaccggctgggtgatgaggaaagggggctgaaccccagcccagtcccctgacctgctgatgacagacccacctcgggtgggggctaaggaggtgctgtgtgggaggggcctagcatggtgcctactgaatcagatgccccgagatggactgaaaccacggaggagggaaaaaaatgagcccctgggaaggtctggaagttgtgtggaagaactgacatttgagctgggtacggaaatgcagcagggaggaaaggaggtggcgctcctcaccgagaagccagcccagctaaggcaaggtgtggccaggcgctacactttccagcatggcaggagcctgggtgtgtggatgtcagaggagagggccacgggagcaggcaggatggcgaggacccagagaaccaggccacagagcttggactgggaccaaaggtgctggggaaccctggggggtttggaacagagcagcgccccactcgccagcctggccatgaccaaacaatcagcaggaccccccatgcactcacccaagaggagcttcctgctggccacagtgacaagaattgcactcacccaagaagagggccctgccggccacagcgatgagactctgtctccaaaagctggcagtgccccatggactggcatgtggcttcacaagagagatgggggctctcagggaggtcatgtggcagagaggggaaggcagggtatgggcaaaaggcagagacaggaacatgcaggacgagtgcccaggacaaggaggaacccccggaccagaagcctgacttggccagggcctgaatgtcaggaatcgtcatcatggcctgacacgccgctggctgtagactcgtggagtccttgtggcacctggcccagaaagcttcccacgcacagcccagggcactctcctgggattatggtaagtgtctgtggcctctcaaagcctagtccccgagctgccaggcatggaggagggtggcagtggtgccccaggccagcctggatgctgggcggcacagccctgagctggatggcccgggaggctaaggccagctctgcccaggagaccccagcagctactggctccatgccaacatttgcgtgagggtcccgggggaaagctgggtgccatcgctagctaaaaactgctggcaaacaaaacggagggtttggttgtgcaatggaaaggtgaaaccgcaaaggagcccgtgtaacacttcccggggttcctgggctcttctgagactggcttggggctttgggtttggccgagggtgtaagatcccgggagcaggaggcaaggactagaggggtatgtgcacgccccagggcttggtcacaggcacggtccctgcgaacatgccatctgcacaggctgggatactccaggcccacctgtgccctggggcccctgggtggatggacatccccagaaggacgtggtccctaatcctgcctggtcagctcatcctgggaccccagggaccagaccagagcatgtcactaagtaggggacccccatcaggtggaggcggagcctctctattcctgccgctgtccctccccaggctcgaccccagggcctggtggcctaaagacaggccagaatggagctggagtcccactggacactgtacagagtggaaaactgaagcccgggagcagcttcccagggctccatgcccagcccctccccagggcccaggcacacagggatactccgtgcacccagggacaggtttccagtagggccgtctgtccaggccacctgggcacatactgggtcccccttccttgttcccagagtttcagaggtgcagccaggttgggacaggaaaaagcctgggggccaaagggccgcttggaccccactgtgccccgtgtggacaccacgtcaccctgtgggaggccaaggcccacctcaacctccctctccagcctctgtccccagcagcccatgctttctcatcccacaaggacccctcgcccaggcccgactggtcatccccagtgggatatggcacaactttgggggagcagccttggggttgtagcgttgggggtggaggggtaggtctaaggcacctaccccttaggtaggtaggagatgaccatgactgatggtcatccccatagaaccaccccaacacgctcttacacctcccagctcaacaaagaccttccagagccttctctggccagcccaggccagacaccaagaatgcagcggtcaataggacctgccctcaccaagtgcacacctatccgtgggtcctcactggccaagagctccttcctctcctcacccccatttctcatctcaccagccctgccccagctccctgcaggccctcgccctgcccacccctcttgtcccgacgggtctcagagtcctggccaccagaacccaaagatgtcaagacttccctctaacgaacctgatgtcttggattccttctagagaaggccaggtctcagccaacagcccagcggctccccaaggcttccatgtttctcctgacagcaagctcatccctccacagcacaacacttttcaaaggtgctggtggttagaaagttccaccttccagacccctcctcacaaaagcatctcccaggccccacaggtccggttactgggggaagtggcagcaccgattttgaaatccttttgaaaatgtttttcctttgttttgttttatttagaaatttcccaaatttttaccaagttaaagagacaaccacaagaatgtgtagccagggtgaacaattggcataaacaacccctcccccactgcccagcctccccccaaaccacggccccccaactcagcagcaaaaaatgccagacatgtataagaaaatagaagccgtgaggatagagctgggtgaggagcacaggccccatgcctgggctgcagcgtgcacacagggaccacgcacgtgcacccatgtacacacgcacctgcacacatgcacatacatgcttgcacatacgtacgcacgccagcatgcacatcacacacagggcctcagggtaaccttttccccagtcccggctgtgatattgcgaaaggagctcagggtggggggcgggctgctgggtccaggcccccaccgtcctgcctagcagtcatttggtttctctttgcctcagtttccctttctctgcccctcacacctcccaaagtcctttggagaatccgtgagatgggggggtgacaggccctgtatgtcagcacacacagccacgtgatgtgggaccccagcccgtgtcccgcagaggcccttgcagctggggacccagggcctgctccagggcacagtgggtcccctttggccatagcaaccctgccctggcctgccttagacctacccctgcaaccccaaggctacaaccccaaggctgcacccccaaagttgtgccacccaaggctgtaccagaggctgaacccccaaggcagcatgcccctcaagtctgtgcccccaggctgtctgccccacagcatccccagctcctccctagaccccttccatacccctccgtgaactgcccactccacaggaagctgccctgctcacgggcactgacagtcttcactgcctggggttctcccctggagaggcagattccttggcccagaatacgcagctttaagaaaccaagttgggatccgaatgcagggacttcctgctccaactgctggcccgagggcccgctctgaggctctgaggctcccagtctggggcacccgcacaccacggccctcccgcccacggtgaacgccccacccggccccaagaggcatcgggaggcgctgcttggcccagaggagaacagcactgatgcggaggcccagagagctggggaggccttgggggcgccaatgggagggtctaagagccccccgatctcccctcgggaagatgagctctggcactccacgaaggacaagctggtcttggggaatttcgctggcacagagacaggaaggagaggatcttggccttctaaaatgtttactacatcaggaaacgaacgcactacgcgcgggctcagtgatgaagaataaacacacacactcactcaggacacattgagtgcaggcccagccccgggcttcccgctgcgggggaggctgggagggttcaggcatgccgcagccacagaccatgagcttgggggtcaggcgggcgggggccaagggcagggccacgtcccagccctccccacccaggtccgggcgcctgcccgcccgccctggctgctctgatctggctgtcacggttacacaaggccagcctccatttcttcattaatgcctcaccaaggggggccgctaacccgcagcctcaggaatgtgcctttacagagcagaggatgcagccgctgaagggccgggcaagctgcaccggccggggctggaggtcctggcctggactgctcccccggccctccccactctggcccgtgctggtccaggccagggcagaaggaggtcaacttgtgcaatgcctctctgggtgagctctgcaccgggagctggtgatggggacagaggaggccctggaagaggggacgtgagttgagagagcagcacaaacccaggacatgcctccagcatctctgcctcccttcgtccacagagactgctgcggggtcaggcagcacagcttcttgcctgagctctgtggcctcgggcaaggaaggtccaggagtcaggtgctggtctgcaacatgggatcatctcgctctccagaaaggctgccaggggatcttaggggaggccctcactctcgtctctcccctgtagtcctgacacctgccgacctcacacatgggccctctgggcgcctgccctcccccctcgtccttgcatgcatgctgttccagccttcggaaatgctgttccctggtgaccactcctactccagccccctgtgccagtgtcttccaaaattttccttcatttctgaaaccaaaggagtgtctagtccagaaaggtcccctggagaaagggaaatgctgaccaagaaggggcctccaagggccagcactggaggcccctttgccctcccacgcataccccaaaccaaggatgcaaaccaatcacctgcctgggcacagaaccccacatgtgctgccggaagtcgcagagcgtccccccggctccagcagggccctgggatacaggcccagatttgagaggcaggaaggcccttctgggctgggtgcaggacagggcctttctgatgaagtcagggcacctggggaacctgaaagctgaaaattcaccttcacagaggtggactaactgccacgcgggggtgggtgaccctgtacctcttgtggcaggcacacactgggggtccctggtggacggtgggcaggggcaacccaggaccacgggcatcttgccaaggactggggcaggaggcaggggcatcaggcctcctgggagcaaggcttccaggtccagcaccaagctcaggagcgtcctgcccagtcctcatgccccttggcgccaccagcacccctcctggatcctgcccctccacggccatcatgacagacgagcattcacattgggtcggaccccctgcagggacctccccatcctcccggttgggatgcctcctcctcaccccacgcggttggccccatcctgtctgcttcagagtcgctccccttctagagtgagctccttgcaggtaggagccttatccctgaatgccccttgacaaagagggtgcgtcacagcctcctgcccggacagagcacctggagtggagaccggaccgcagggcgtctgaacatggccagaaatgcgggtccagctggggtggggacttcctcctctctcctcgaggctgtggccaagcttatcctgaacccagaactcccaccagtctcagcccacatcccttatcactcccccttctttcctggtgcctgctgcctgcccccacccagctcctgcagccctgagtaggtgatatgccggtgcccctcccctgctgtctcctgtcctggctggtgctgggcacagcaggccagctctgctctttttgatatccccaggttctaagaagcggcttggctgaccccagcccaccctcctgagggtcaaagctggcccagacacgctacagtgcccagcacctgctccctgggaccctccccatggccccctcccaccagggctcattgggatcctcaggaactgctgtccccacttgtggcgtgtccccaggtcttggccctcagcagacagctcctcagcctgccgcttcccttgtgaagtgtacgtaagtgaaacatccctatgctggccctgccagctggcacagggcagactctgatgaagagcagcgcctgggtgccagggggccctcgtggccaggctgctgggctgggtgcacccacacactcctctgcctgctcacctgctggccacgcctctcactgcagccctggtggaggatgccaagcgggagccgcacccccgccttgcctgacaacagtacccgtcacccgctctcagccgcagctccagcagctgctcccctgccctccccggccagcggaggagactggagtgggctacaaggaaggcaggccccacactcttggccctgcgcccgagtgcccttgccaggccaagtcagaccacaggacaggccacagtggtagcagggcctggaggacaggctgcctgaggctggcctgggtgggggcggggcagagtgggggctgggctgtgtgtgccaggggccctgcatcctgtcctcctctttggagaagcccaggctcctccggcctctcttgcctctaaatcatctgcttttcagcctcactaattcgtgcagggttccttggctcatccacacatttattgggcacctactgactgcacaccctgctgggcttcaggtcctgtgtgccccagtaagaacagctcagttctggcacagatcttagggggcgcaaggcagagccgcccctggggcctgccccgcctaggcctgcagacgtgttttcctcagccccaccggagctcactgcgagggtagcttttcaccgagccaaggtggcccctgtgcccagacagcccagattacagtgggcatacgctggggcagacgccggcagggccgccttgttatctcagacgctgacgtcacctgtctgcgggaggtgcaggggggccacttcccggggccaggcaggaagcccgcccagtgcagagagggaggtgcccaggcccatctcaagcttgctgggcccaggggaccagagcccctgggttccctgatgcaaccaggccccactctgcaccccggggcctcctaggctggcctggccctgcccctccgtctgcccttccccagcccaaagcccgcaggacaagtggacagcccaggccggttgcagtcctgcatgctctgctgagctccctgagtccaggttttggggggcagtggctttgggccagggttcaggggtttatttcacaggtccttccaggtgccccacagttgctgagtgggagactggcactggggactggtgacaagagacctcccgggcaggcccctggcacgggctgaaggacggaagctggaggcagggagaagccaagggcattgggtttgcagactccatggggcaggacaggagggactggatgcctggggaggttggggcaggactgtacccaagacaggggatcaagcctagtacagagccgagcagcgggagggaccaccctgccaggccaagggaggaagacccggggcctccagacacagtgtaccagaggagaacccttcccatccagcatggccaagcgggacccgtgtggcacttgaagctgggtccctggactcaccaccttccctcactggacccctcggcagccatgcaggtggggctcactcccctttctactcgccaccctgcagaggaagcttcttctcggccagctggcccacctgtgcccctccctcaggaaccccacctggcccaccccacagctcctgtgtgttcccaggggcatctgatccttcagcctggcccctctttcctctccagccacctgtgctgccattccagtgacagccaggccaaactccctgctgggtccccaaatgtcagggcgtctctctcacctctgttccctcctcctggaatgcccttcctgctgcctcatggcacgcttctcttgggccgtttcacaggtgtcgcttggggcttgaggatttcaacctcatgggtttttagattagagttagaaagaggggagaccttcacctggaggcaatgattcaaagacaggcagattacttctctccatcgacccgcacaaccatcttggcagcccattttacagagaagcctagaccaaaggaatgaggtgtctttcaaaggccacacagagccaggagagactcttccccacactgacgtccactgggaccccagccttagtgctccctgtgtgtgtctgtcactgtcattgtggaaaataaaaggtcctgaaaggacagtctcaggtcctggtcctggtcttagatgtgacttatgatgacttcaaatccataagacacagatgcagtgggtaaattgaggcagcctcttgtttcttagccaaagaacttgttcaagaagttttcttagcaatgggcttccaattatcaaacctggatgatatagaattgtggtggaaagggtggtagataggtgggtggatagatgggtgggtgaattgatggatggatgggtgagcggatggatggatggatggatggatggataaatggatggatggatggatgatcgatggatgggtaggtgggtgaatggatggaggttggaatggatggatggatggatgagtgaatatgtaggtgagtggaaggatgtgtgggatggatgggtggatgagtggatgggaaggtggtgtgtgaatggatgaatggatggttgagatggatggatgattaggatggatggatggatggacggatgaaaggatgagtgggtagaggaaaggatgaatggatgggtgagtgggggatgtggagacatgaggatgaatgtagacgtatgaataagtaggtggatgaatgaagagcaggtgggtagatggaagggtggatgaacagttggatggaggaatgaatggatcctcaaatagcactttctttggctaaggtgttgtaaccttgaatcatggagaatgattgccaggcaccctccactctgtgagtctctggttctctgccatgacccccagggccatagagcagtgtggcttctcaatccccaaataaggtggacaaagtccgcactggcaggcccagggagcaggaagtccgggtggggtgggaggccctgctcccggagctgaagtcagttccttcttttctaaacaatgaggcctggcctgatctttgccgcacctccaccctgctccacccaagctccctccacatctgatggggctctggggccctcagagctggatgcagggagctgggggctggagcaggagggccaaaaagagcaggacccacatagtttgcaaaaggctcagtcgtggaaatgctgccttccctgcagccaaggctcctggagccagtttcccccaagcttctttctgtagggagataggagctgggggtttgttggccaagacatgactttggtttcttgttttcgtctttcttcttcaagtccatagttggaaggccctgcatccccttctctctcctgtgtcctcttccttatggtcatcctgctctgtccccccacttccctttccttgcccctctctctgacccaccatggccagtctggcagaggaggagactggaagagtagagtaggaaggaaaaccaagtctgcccttgccagggcacggaggaccagactttccaacccaaccgtggctcccagtttcagtgaccaagctggggctcttaggcctaagcaggggctctcctctgctccagctctgtctcctgcattggcaggagagagcctctcccacagagctgtccctggaacagaaggacaagctgaaaaccagagaatctccccctctcgtgctaagggtagccagagtgttccacggccctggagacaccatccaccaccctcccagtgggcttcctggaaacccagagatggctccaggggctctgccctcctgggaagccacttagagcccaaagagcgctttccacatggaaataaggggtctcttctgagggtaggggtgctgcagtacagagcaggggcagggccgggaactggggacacaggcctgtgtggactcaaaatgaacgagggccgtcctgtgcgtgctccactccaaatcccatctgctcccacactgctggcccagggaaaatctgggtagtgacagtggccgtccctcacgccctccatggccaggtgccagtagcgtgttccacaagcatcaccttcgaaaccctgaaggagtcaggactgtcgctgttccagacaaggagactgaggatgagtctccattaagtggctttcccgcagacacacagtaagtggcacaagagtcaggagtttgagcccgggtcagcccagctccagccatggtcgcaggggctgcctgcaacccctgacgaggggcaccccggggaggcctggacccagcacctgcagcccaacctgggcagaggctgatccagcagctaggaagggcatgggtccaggagatggcagagcagggaacagagcgctgccgctcagggtactcccggggagctgtggttctcagtggaggccgctcccacactgacactcaggcaccctttcacctgctgatgcccagacactgctgaggccaacacaacagacccacagcctgggtcagcacggacaagggtgcttcctggctcctcctgaccattgctgaatgaatgatgggtgaatgaatgaattaacaaatgatggctgactgatgaaaagcaagaacacagatggaaccagagcttctggggcgcggaggcaggggcacaaccccctcccgtgccggagtgcgcacacacacacacaggggtacacacatgcacgcacagacacacatgcatacacacacatgcccacacatgcaaacacacattcatatacacacacgcccacacacacaaacacacattcatatacacacatgcccacacatgcaaacacacattcatatacacacgcacgcccacacatgcaaacacacattcatatacacacacgcgcagcaggcctccttggtcaaggcctccagagctttgtccttcctcacggttccagtggcccagaagactcaccatgttgccttgccccagcccagggccccaagtgagtgtatcaggatccctgagcccgccccgaaatccccaggtttccaccgctcccagcaggaagccgtgcttcatgcatgaggcctccctcacctgttaatttccgctgatcctgccaacccccaggtgagggcagccatggggaccccagtggcccagagctgggcccaggaaagggaccaaaggcccagggggccttgctcctggagccaactccactcaatgccagggcacagagggaaaccaggcactgtggccaggcccctgggaagggtcatgggtgcatgctcagcaaccctcggccatcatgtggctgcaggcccagcctgttgctaggattagtcccggattagcccactgaggtcccagaggctcgagtgtcctggtcaccagtgctatagaaacctggccagaggcagggggtggagactggttcctccttggtgggctcttccctccaggcccagtctgagccttaccctttcctgagccagctctggagtgcctggggcctgagctcccacccccagccctgcgggagcccttctccacagagctctgcacctagggaagttgtagctttccagaatcagctgttttccagatcccggaatgaaaacggatgaccgatcatgttgtgcctgatgtggaaaagcgaagcgtttgttctctcccttctcagatgctccttaatacagaaaacgtcagagctggttcaccctgctgccccaggagcaccctggagcttccctccccaggcccagcccaagcaccgcctcctgagaactctcctcccctcactgacccctgtcccatctgtctctgccctgaaggaacaccaagttggggctgtggggctgggaccaggcctcggagccaggtagcagcccattgggggacagctcaagaggctccgagagctccctgtgacatctgagaggccagcaggacgaaggccacagccagcagccaggacctgaccacttgcccaggctggtctgagctcctggccaggggcctcttggcaacatgacctggcaggtgctgtctgtccattattcccctctcacggatgtccccggcctctgtggacatgaccgcctagccctgaaactccaaatgtacctttctgcctctcctcttctctgtcaggtgatgccatccttcccaggggccttctgggctcttcactcctctaggccctcagcaaaggctctcactctgccctcagcacacaccagggtgcaaccaccctcactcctccaccagtccctcccagtcactcccttctgtgtgtatcccagcaggtgcctccacttctcctcttgcactctggtcactcagcagccacaggatcccttcactcctaagcagagacctccactagccccacttctctccaagaaaaagctgcatccccttcagggcttcctgatgccttcctgggcaagctccccttggtttctcaggtgtgtttctcaacaacccatgcttcctccctatccaccactcctcagagacgccacatcacctctctacaagccttgtacccgctgctcctgccatgagatgctctcccccagatgtccatgtgagtatgtggtgggggctagaaaggtatgtagatgggtaaatggttggctgggtagatggctggatgcgtgggtggatgcatggatccatggaaggaaggaaggaaggaaggaagagagggagggagggcaagaggaaagaaggaaggaaggaaggaaagaaggaaggaagagaagaagggagggagggaggatgaatgggtgcacagatgggtgcatggatgggtgcatggatgggtgcatggatgggtggatgaacagatggatggatgaacagatggatggatggataagtggatgcatggattcatggaagtaaggaaggaaggaaggaaggaaggaaggaaggaaaggaagatggatggatgcatggatgggtgcatggatggatggatggatgcatgcatggatggaaggaaggatggatgggtggatggatacatgaacaaatgagtgggtggatggatggatggatgaatgggtgggtggatgcatggatgggtggatgcatggatggatggaagatagatatatggataaataagtgggtgtatgaataggtgggtgaatggacggatgaatagatgcatagatgggtggatgcatggatggatggatggatagatagatagatacatgggtgaatgagtggatgtatgaatgagtgggtgaatggatggatgaatagatgcatagaggggtggatacatggatgggtggatagatagataaatacatggatgaatgagtgggtgtatgaatgggtggatgcatgcatggatggatggatagatggatggataaatggatacatgtaggagtgagtgaatagatgcttggatggatggatggaagaaaggatggatggatagatgaatacatggataatgactgggtgtataaatggatgggtggatggtgggtggatgaatgaatggatagatgcctggataaatggatggatagatgcatggatggatgaatggatgggtggatgccctttctctgaatgccagccaggaacgtagccaagtggaaaggcccaggtgggcagctgtcttcccagaccactcacactgacctgagaacaactgctgggccccaggtgttgaaagggcaaaaagagatgtacccagctggactgtgcaggtgctggctgcccgttgttttgagccatgctctgatttgttcctctgtgcctgctctggggacttggccactctgagccatctgcaggcttccctggtgtcccctgtacccataccacaagccaagttcctccaatgtcacccttgattgctgtcccttgtgtgactcacactggtcctccctgtgtgatcataggctattcgcctctgccacacaccacactcatcacccaggctaatctgggtgggaggcagacttgtccagcgctcacagctgctgagcctcagagccaggccagacccaaggccaggactcctgagctcccctccaactctccgtccttacaagccttccttgcaccagccttgtcccctctggtctagttgcatctatttcacccctgccagaagacggtgttcgttgcctatggctgcagaataaattagtccaaaacttaaaacaataaagacttaaagtgatggatatttatcatctcagtttctgtgggtcaggagtacaggagcagcttagcctggtggttgtggcttggcttggctgccaccccctgacaccccaagccaagccaccagccctgggccccagccatctgaaggtcctgctggactgaagtgtccccttcatgcctggcaacctagtgtggctgtcggagggatgctcagtccttccacacaaacctctgaggtttgcgcatcctcacaacatggcagccagctttccccagagggagtgaagggagagaggtgggggaagaagaaggatgctgcagtgtcaattatgacctggcctcagaagtcacccgccgtcattcccactgttggttacacaaatccatcctgttaatgtgaggggggccgcacagtggccgaattcctggaagtgcagatctaggcccatggctaccatgacctgcagctgacatgctcttctttcttccacaaatgacatgaagtgagagaagcagtgggcaaggtagccccagactgaccatcttcttgtggttccattgccgacacctggtgacctggcccagccaacacctccagccccctcctccttccccacaataggctcagctcaggccaccctgagcgccaggggcaaggtgtgcctggagctcttcagtgagacagtgactgtttctggggtagccctggaccctgaacccctccagtgctgagatagacgaggggtccctccttactgtccccttccctggccccatgactctgcagattccccagccacagggcaggaagggtagagccagcgttttgggtgggatagggaagggcccggctgggaggcagaacagctggtggagggtgggggaggcatcctgaggccctgggggacaccagggcaccgactgtacgttgttctccatccccagcctgggccaagagggcaacccagggagcccaggaccttgtccagcagctgaggcctctgaggggagagtgccagaaagagtgggggtgccagggctctgtcccccatctttcctggcttgggtttctgggagagggggcgggtgttgactcccggaggggctgccctggaagtcaggtggcctggcggttcccagacctgccagcccttgctgagggagcctgcaggctcttctccttcccaggcctccccggcatctgagaaccttctccccagcactgacccatggctgggagagggtcagggccctcagggagcccggctgagccagcacgggacgcaggggtcggctccttcagacccccccactttcgggcagcggtgcccacgcccagctgggcagggccgagtccatgagacccactgccctccccgggagctcccggccagccgcccactgcagcagcccgtgtaaaagtaacgcctgttatgccaggaacgtcacagggccctggggctgcagacaagctgggtctttttttttttttattattaaaaagcaaaacctaaaccaagaaaacaaagtgattaagtttctcctcagaacagcaggccccacagaaacgaggagcgaccgtcccactgggtgcttggaccctcacccaccactcgggaaaacagccgaattcttcacacaaacaggaagcagctggtcttccctgaacatgaggggagggctggggcctcagcatgcgggctgcctagaaggtggcgctgcagccaggccctcggctgggctgggcagtcccagccctccaggaaacggccaggctgcaactcccccgccaggaacccctgggcttcgcgcttgaccagtggagccgtgcaggtcagaggagggtgggctcccagcacacacccttctctgccacggtgggctcagctgctccacccaggctgccaagacccagcccagagcacacaaactagctgggcttctcatggggtacaatgggagtgggcaggagctggcagccatgctgggcaggtcaagggccttcaaagggctgccacagcccagctggggcgctgaggcctgcagaagctcactctggtggcattgagttggggaaggggtctctgtgagccaggttcagaaaggaagatgtgaggcaagttttaaagaaatgttttaaaatagaaggggcttaaagcagaaaagtttagcctgccagaagttagaacatgttctagagtaacaataattaaaacctcacggtactgatgcaaagatggagatataggctggggaggagaagtggaagtctggaagtggaaccagcaacctacacaaagaacattaaaactccagaaaaaaagaacgctacaatttaaaaccacagcgtaggatctcagaagcccttccagcagaggagcacagaggagctgcctcaggcattgtcttgagataatgtgttagtaatttgtaataaaattcaatcaaagagaacacttacatccacataaaaacctgctcacaagtatttatagcagttttattcataatcaccaaaaacttggaagcaactgagatctttcagtgcgtgagtgggtaaacacacagcggtacctctatgccgaggaatgttattcggtgctaaaaagaagttagctgtgagccgcaagaagacatggaggagcaccaaatgcatgatactaagtgagagaagccactctgcaaaggctacgcccgtaggattccacctctatgacgtcctcgaaaaggcaaagctatggagacagtgaaaagaccggtggctgccagcgtttgcaggaagagagggaggaagaggtgcagaaccatgactgtgggggcagtgaaactactctgtctgatagtctgatggtggatatagggcatgataacttgcgtccaaactcatagaatgcacaacccctagagtgagcctggacctcagtgtgtgctggtgctggctggtcaattctaagagaaggcccacatattgcaacatgtgaataacaggggaaactgtggtggacgcatgaggcaggaggtccatgggaactcactgtgctttccatgtgatttttctgtagtcctaacccagttttactcttgtccaaggaccgtctgtccatcactttttaatgccactctcagcagctccctttgtggagaacaaacccgagccaggctgtttacacgcgcatccggtgggagccccgtgctcaggtgctcgcttttgcacagggggacactgaggaacagaaaagcgaggcaacactccaggatttgaaacagtcaaaacacttgcccctctgctaattataagcacagctactggcccctaagcctgggctcttcgacctcggttctcaaatgttccggcctcagggcctcttgcattccccaaagttatgaacaagtccttaaagagagtgggttgatacggggtcacccctgctgatatttactgtcttagaagttacaactaagacattgaaatatttcaatatttaaaatattagaaattttaaaaataggttaaatgaattaatttaaaagtcacaacagaggctgggcatggtggctcatgcctgtaattccagcactttgggaggccaaggcgggaggatcacttgagcccaggagttcaagaccagcctgggctatgttgctatgttacccaggctggtcttgaactcatgggctcaagtgatcctcccaccttggcctcccaaagtgctggaattacaaggaggagtaatcaaaaagaaaatctacaagcacataaggccattaaaatatccttaattaaaaaaaaaagccaggtatagtggcacacaccagctactcgggaggctgaggcagaaggatcacttgggcctggaaggtcgaggctgcagtgagcctggattgtgccactgcactccggcctgggccacagagcaagaccctgactcaaaaccatatgaaacaaatgaacacaaaacagtaaaatcacaacagcaataataaactcactactacacattaacataaaatatttgtttacaaaagacaactaggcttttcaaaacaaagcaagttccgtgagaagagtgagatgtctttgcactttgcgaatctctgtggcttgctggaaggcagcggattcccatcacgcctctgcaggctttggccagcgcatgggaagaatgtagatgaggacatctacgaacatacgtggttgggagtggggggtggggggcgctggtactttaatggccttatgcgcttgtagattttctttttgctactacaccaaaacttgacaagtgtcatttcttcaagcttagctgcaatgcagaatctgaaacccatgacctttagagactccgtgatgttacagtccctcagtttaggaaacgacagaggcatcataaccaaatgcaccggggctgggcgtggtagtgcacgcctggaatcccagcactttgggaggccgaggcaggcagatcacctgaggtcaggagttcgagaccagcctggccaacatagtgaaaccctgtctctactaaaaatatgaaaattagctggacatggaggcaggcacctgtaatcccagttactaaggaggctgaggcaggagaatcacttgaacctgggaggtggaggttgcagtcagccaagattgcaccactatactccagcctgggcgacaagagtgaaactccatctcaatgtggccaggcacggtggctcacgcctgtaatctcagcactttgggaggccaaggtgggtggatcacgaggtcaggagattgagaccatcctggctaacatggtgaaatcccgtctctactaaaaatacagaaaattagccgggcgtggtggtgggcgcctgtagtcccagctactcgggaggctgaggcaggagaatggcatgaacccaggaggcggagcttgcagtgagccgggatcgtgccactgtactccagcctgggtgacagagtgagactccgcctcaaaaaaaaaaaaagaaaaaaagaaactccgtctcaaaacaaaacaaaaaaaaaaacaaaataaacaaatgcaccgtggaccctcaatgggatcctggaacagaaagaggatgtgaacagaaacattggtgaactccagatgaagcctgggttacattaataagtcgagaagcaatgtcacactcttaattgtcacaaccataccacagtcaggtgtgaccttaacaaagggggattgggcgaggggggctgtgtgtacaatccttgcaactcgtctgtcatcttgaaattgttccaaaataaaaggtgtattatggaacgagtcaactggtgtatcttgcactttccaaggatcttttcctcttttttgtttttatttttatttttgagacagggtcttgctctgtcatccaggctggattacagttgcatgatcatggctcactgcagcctcagcctccccaggctcaggggatcctcccacatcagcctccccagtagctgggaccataggcatgcaccaccacacccagctaattttaacattttttgtagagacagggtttcaccatgttgctcaggctggtcttgaactcctgggctcaagcgatccgcccgcctcggcctcaaggatcttttcctgtgtgtgcctctgtaacgttccgcattgatcgtttggaaaatatcaatctcacaatcaggcagctcttccaggagtggatgccattctttattgttatggaaaactacatttgtgactgtccccaccaggctcctcaggaaggtctttaaggattggaaaaccgtctggttcaagggggcagttgtaagtttctcaaaattctgctgtttgcatgaaagctccaaggtggtcaccaacagcaaaatccaggagttgtttttctctaagtggatctttttgttcttctctgaggaaacatccagccggtcgccggttcagtaaaagcggtgcacgcagcccattgagcctgcaactcaaaccactgtgcaggagcttttcctggggacgctggcatgcttccggctacagtgggagtgctttgagcgtgcctccgcgaatattaaaaagacacactccagggtcaagatttaatagaattaataaagtttaatgcttcatcaaggacattcttaagtgagactggcagctggcccacgtcccatgggctgggagacctgggctcagtcccacctcctgccccaaactcagccacaccaccctgtcaggaggctttggtgggatggttcccagccccgttcatagacctgccctctcccctgccccctccaccctccaccacctcaccctccccattagattctcctggagcttctcctcaaggttccagggagccctcaccgaccagcccagactagagaaattcacttcctggggctccctctgcccattccttactatcccgtatgttccttggcttcccccaccaggctgcgaacttggcagaggcagatcccccgacccagcacggtctcctatctggcagtggtttatctcctactcgcccaggccaggacggcctcctgcagtccatcccacgagcttgcagccatcccgtagggccctctgtctcaggcctggcagcagtgggattcctctggatctgggaattctcttgaccccctggtgaaccgcagagagcacagccctcgcctccttgctaatcacaagcagagagtggcgggtgcacgcctcctagctggacgggccctgccccaagtttcttctcatgcacaacgttcagtgaggaactttccagaacgtgccgggatgtcagatcccagtgctgcaggaaggagtttccggggagcgctgggtgagcgggaaagaccaggagtaaggagccgaccccctcaggcttcctctcccatgttttccacaagggagccccccaggcccagaggcgctcaggggaaggcctcgcccaagctgggcttgccgtctgccctgagcgcctggaagtgctcgtgctctgagacagtgccagctgattccccgactcatgccccggcattcccaggacagggatgcatggagggcctgacccagacacccctgggcacacgggccctggcctggacccagcgttcagacaggaactgggccctagtgggaggatcttgcccagctgaaagaagagacgactcagccctgagccagccacacctgatggggtcctgctggggcaccacagaagcccttcctcgccactgcccagtggtgggttcagcggcggagactggcctgttctgggagacagagaagggaggccgcacacaggatactggcctccctcctccaagccgccctccttccttgagggatcttccaagctccaggtggtgtttcctgggcctgagtgggggagatgcctggtggaggaggcgtagaggggaagggaggggcaccagggccagagcaatggcccagaggggacacacacagggcagcctcctggtcgcaccctgagtaaccccggcctgcccctcactcgccggctgcggtctcagtcttcttacctggcgggtggggctggtaagcacagagcctgcccctgacacatggggagcatttagggagacacacacagagggctctcggtacgcccagccccatgagcgggagaaatgtgatgcgaaagccctaccttcacacccagagtctggggaggcaggagagctgggcagcaggctgggtcctccacctgcgtagttcaaaactgtaccctcaagcaagccctcaggcctgacctggggcagtagggagaccccaggtggggtctagagctggtgccagagggtcctaagcctcagaacagcttgcccttggcctcaggtcagcagtgaggagtggaggcaaaccctagggctgcctctctgagtggctttctgagctggccagggttgggcaggaggagggtgaggctgcttccatttcacctgcacccagagctgtacctggtagaggaaggaagagatgactgtgctgaggccgggaactgcctggaagacacaggcccacaaacatctctggcctcagccttgggaggcaagatggcgtgggtactgcctgaccacaggaggacttgggggcactggggtgagcaaccccacggccctgctattctccgcagcctgacatcatgccatcagggcaatggactccttgttggctgtctgtgcctccagctgtgagtctgcagttgcccgtctgctacgtggccaatgcccagcacagtggctaacctggggcactcaagaacaatggaacgaccatcaacaggtccctgtctttctcagttggccatcaattaaaatgcggagaatagctctacttttgaggatgaagtgatagaacagatgtacagcaggtagcacagggtgacaccctgtctgtggaaacttctggagtgaaggctggcttgtaaggactaagacttgccagatagcaggttcattagatgtgatggaaggtaagagagatggggactgctaacacccagaattctggtgtcaacaactgaggggctgggatggttattccttgagatgggaggaagagcttcacatgctagtggataaactgagcaggcattggatctacgtgcccaatctcaagagggcgaaacaagagttccacgtttgggagtcttcaggacatatgccatcatcaaagctgtggtgtggaagagttcatccagggggtgaagttggaggaagggaaggatagaggaagcccaggccaggatgaggccagtgcttaatggaagggagagcaacaaggaaaacaaaatgacgggacagtaaaactggaccaagtggccacaggagccaaagggatagcacatttcagggtttaaggaatgttattccattgtcttccagcccccatggtttctgaccagaagtctgtggcaattcaattcaccattccctgctatgtggtgccttgttctcttctttcaagattttcttttttaattttcatttttatccatttgactttgatgagcctaggcatgattttcttcaaactgatcctattcagattttgtttcttcaaattgatcctattcagattttgatgaacttcttgaatccataagtttatgtttttaaaatcaatttgagaactttttcatcattatttctttaatatttttttttctgctccatttgctctctcctccccttctggaactccaatttcctatatattaatttttggggtttttttttcttttgagatggagtctcactctgtcacccaggctggagtgcagtagtgtgatcttggctccctgcaacctccacctcctgggttcaagtgcttctcctgcctcagcctcccgagtagctgggattacaggcacgtgccaccatgcctggctaatttttgtagttttggtagagatggggtttcaccatgttggccaggctgctcttgaactcctgacctcaagtgatctgcctgcctcagccacccgaagtgctgggaatacaggtgtgagccactgcacctggccatctgttaagtttttaacactattcacatgtacttgagtctcttttcatgtttttaaagccttttctctctctctcattttcgtattgagttgaataacttctattgctctgtcttcaagttcacagactttcttctgtcctctctacactactgatcctttcatccagtattttgttttttactaatttcagagagtgtatttttcagttcaaaacatcaatttagatatttttaaatattttctactggtctgctgaaatttcctgtcatttcattcactgaaagtgtatttttctttatcttcatgggcatagttataatagaggccttgtttgatgattccaacatcatggctggcctcagtcaattgtcttcccttgagaagaaaataccggtttctggccctgacatatgtcatacagtttgggatggcctcctggactttgtgaatattatgttgttggagactctgaaatgtcctgtatttgtctggagagcactgatgcatttgttttagcaggcaattaacttgattagctgccagttgcaaagagtctcacctgaggtgacaggagtcccagtctcagttcagattgctttctgccccataccagaaaccagggcagatttgacacataaaaggcccttctctagccttttttgagagtctcatctcactctccagcgactttgattgcctccagctcctttcctgcttcctctggccataataatggcaggacttcttttaatcccctctttttttcacaggtgttgaacatggcaggcattctattggaattatagatacccacaccataccctgactaccccatcaaaatctacctgcttttgctaactttctagagtccttggtagtttctgtttgtttgtgattcggggtttacagttgttatgtgcaggagtgctggtttgttaaagtttgctactccatactagaaggagaaccaagagaagtttccgagtggggagtgagagcaagcgggtgagcaggaaaaggctgctgagtggtcaagtctaataaaaaaaaaagggtgccctgaatttggctacaagaaggttggtggttgtcgtgaaaagtcctctcagtgggtgaggagatagcaggaaactgaggactaggtatcttctcttatgttgaggaagtttctttttagtcctagcctgctcaacacggtttataactggtagtgcattttagattttattacatacgtttttggcacttctcaatattatcatatggtttttcttcctttggcttattagcatcatgatattaatggatttcttcatgttgagtcatccttgcgttcctggaaacaaactctacttggtcatggtgtgttattactttaatttaatacactgctggatttaatttgctaattctcttattgacaatttttgcatctttctttacatgtgaccttggactgtggtttttccttttttgtgccattgtgtttgagttttgttaatcagggttatgctaacaccaaaaatgaatagaaaccgtgtccatcttctacacttgaaacattttgtatagtacaggcatgatcttgagtgtttaaaaaactttcccgtggaacactctgggccctgtgcctttttctggggtagcatcttgtaaccctcagttgacaacctggtaattggtatgttcagattttcagatttttctttttctttttttttttttttttgagacagagtctcgctctgtcacccaggctggagtgcagtggtatgatctcagctcactgcaacctccgcctcccgggttcaagcgatcctcctgcctcagcttcctgagtagctgggattacaggcgtgcgccaccacatccggctaatttttatatttttagtagagacagggtttcaccaagttgatcaggttggtctcgaactcctgacctcatgatccgcctgccttgacctcccaaagtgctgggattacaggcgtgagccactgagcccggccgatatgttcagatttttctaggtcctcttgagacaatttccaggtatatgttcacttaaacaagacctttacatttcatttttaaaattccttttaatatcattcccaataaatttcatttaatcgacaaatatcttttaatctctatgatgtgttggatcctaaaaacaggatatattcaacctgaatcaacacatagaatctctataagcacagacatacaatggattacagtctctttgctctcttccctcacaaggatcatgtcagaagagaatccaggtagacacttgttgacctacagctgacttgcacctatccacacatccatttatccatccatacatccattcacccacacacacatctattcacccatccatcacccacccactccatcatctacctatccatacatctacccatctgcccatctgcttatccatccaccaacccacccatccattcatggagcccacattgaaggtccaaggctgagaaatataagctaagtggctggaagaccaaactgatactttaaatggcctccacaggctaaaaccatggacagaatagaacaagataagacgatgttctgggatccagggaagatctgagtgaataatttacaaggtgctagccgggcccctcctcagccctgctgtttgttacatttatgttgatgtgccacttcctagagttgttttgagggcaggaatggaactttatccatcttcatgattctagggctttgtacagggcctggcatatgtgtattgaacagatgatgaaggcaggaaggaccagagtgtcgtggaaggtcccgcacagagcccggaacatgggacatgtggccgctgagggctgggtgctggggagggttgcggctgcttgcttcaacaccacagagggctccagtgtagatttctttccctcccacaaagctctgagcccaggtccaggggtgggggaaacccctgtggtctcagcccgctcccacctgctggggccggccagccctcagccactgcagcgccacggagcatcaggagaggcctcgaaagtcttcctccccacagtgctgctgagctggggccagggaccaggctggggcgtatcctaggccccgtcctcggcaggagaaaggtgggggtgggcactgcttgtcttctcccccactacctccaccgactctgcagagaaccaatttgccttatcagaaattcccgagagtggctggctaaaccaaatagctaggattcctgctcagaggcacatctgttcctgatagacgggaggccagggacgacaaggcaggggaagggaagcagaggtactcggccagaccttcccgaagtgatgctcccagccaggcgggggagccagccagcctgagagtgggcagacctgggttgcccccagggcctgaggcaggaggagctccctgctccccatactccccccagctgaggagccagggtctgcatttggtggggctgggggcagggtggaaatgaccccatccgtgcatgcgtgcgatgctgctgggccacaccgagctcctcccagctggggtgcctccctgcgcccggcccagcaccaccccttccaccccacccaccccacccgctagtgcacctccaaaccctctcaggctccaggagttcccacacttagaccatctctccagaattgatggctagagtggctcactctccccttaaaagcccctccccgcctcccagagctcactgaaggtcaagttcagcttcttggctcagcaccgaggccctttgagctgcagccatctccctccatgtgtgcacacctgtgcctgcacatgcggttccctgtgcctagaacgcccttcccacccacgtcctgccaatgcccacgctcctgtccgaccccgcgggaggagcacccctgtctgcatggtctttctcagccccagacctccaggtgcctttgcctcaccccgctcacaccaccaggtccccttggcccaggaattccttcttctgaagccctggctccccagcaccaggagcaggcatagccaagtgcgcgaacaaagaatgaagactgggaggaggcgatcaggagagggcagtggaggaggctggaaggagagaggggcaattctggctctccgaggactccgaggaggactccgaggaggcctggggaaggtgaaggtttgcaccacttttctgtcccctgggagagccaggcacgtgggaacagtctgaagatggggaggggcctgttcttgcttccagtcatggcaccttggggtcccacctgccccctaccactgggctccaacatgtgcctgcacccccctccctcaatgcagtctggggccaccctcctccacacccaccaccccactgacaccgccactctggggctgcaggctttcaagggcagaggcatccccatctctgtgtgctccacggccgagctgagtcagggggtctcaggctttggacaatcaaggagggaggaggcgagaggatggagtgcagtagagggggtgggtaggtaataggtcctgtcaccctgagggtctaagcacctgtctatgtgaagggggtactgaaaggcagacttggagaggggttccctggagggagcggctgcaggcggccgctctcctgccatccttccctgtgtagcctgtgcaggcagcatggagtccccactccaactcccagatggacatgcaccccggtacccccaacccccaagacacatctcattcagccatcccccagaggaagcaagccccaccctcgctccaggtctgtggtgcggtcccctctccccggcctcagcagccccttccaccgaggaggagcccagcacggagggcacggcactggggagagggccgggctggcggccggaatgtgccgcggccagtgtaaacagatcatttctgtctgccttggggggagggctgggagcggggagggagttgtcttgggctttgttatgttctgaaaaaaaaaggcaaaaaatttgggtcacaaaccacaaactgttttgctttcggcatgactggcataaacaggcattttctctttggtttcaggccggctgaggcctgggctggctggggctgggagccgggggacaggctggagactacactctgagcctggggctgcagccccggcctgggccagaggggagtgggcagggccaggggcccagctgagaaggtggagaccaggcttgaggggtggggctgtcagcctgtgggtgccagccctggcctggccgcacctgtgtgggagctgggaagagcggggaccctgggggccagacccagagggacaggttcctccaggatgaggcctgctgagcgggccggtgggcaacctcagcaaggatgcctggcagctgggtctccccggcaagctaacccggggggcagggggcaagctaacctggggggcagggggcaggggccaagctaacccaggggcaggggccaagctaacccggggggcaggggccaagctaacccaggggcaggggccaatctaacccggggggcaggggacaagctaacccggggggcaggggacaagctaacccaggggcagggggcaagctaacccaggggtagggggcaagggggaagctaacacaggggcaggggacaagctaacccggggagcagggagttagccattggtggggtgccagagtccctcgaggcaccctccagggccttctgtctgacccctctggtctgggagccccagacagagccccagggatcctggagaggacttgccagcaggcgtcttgggaccatggttagcagtgtctctggcggatggtggggggctcaatgccagaacaaacaggaagggagaccagggaggccagactcctgggggtcaggatggcacagtacagcagagggcgtgcgtgagttaccaggacaagggtgataccagagggcctgggcaagagggcagcaggtgcagcctgggactgggagtggaggggtgggtgggaggaccagggatggggccaggtgctggaaagcctggccagggcctggatttgccagtggcccacgggattcacggagggctctaagtggagagaggcagactctggccccactgctctggtcccatatggagcatggccagaggggctggctctacaggaggctggacagcagcaggggccagggcctggtggagtccgtggatctcctcaactaactcaatgtgaggtgtggtggagggcagtggtggaccggcagacgcatgctgggtgaggggtctgcaggacatcctggaggagtgaagctggccacagcaggtgccattggaagtgtgtcctcttcattctcagagcgtttgtgggacaggtccacacgggctgccattgtgcagaggaattccaaggcagactccatgccgagggtgcaaccacgccaagatgacctgggcaaaggtctgcaggggaaggggtctaggcaggggcaacccaacctgggaccactgtggctgggcaggtgtcatagcggtggtggtgatgggtagtgtgggtcaggtggcctcatgggtcatcatgagggtgttgcttgtcaccaaggaaataaggtaccactgctggactatgaaccgagctgtgccacgaggccacgtgggtgctgcgtggaggttgggttagggttagggttaggttaggctggagtgcagtgtctgttcacaggtgccatcgcagctcactataaccttggactcctgggctcaagtgatcctcctggctcagcctcctgggtagctgggattacaggttcgagtcactgcacatgacgggacagacctttctgagggccacaattcaccccatggcctcagggtcccatggtgtctgttgaacaaacggcatggcctatgcagcccaggccatctgccccccattacagctctgacctcagccccctacacaggccctccacctcttcctgctgcagctcccaccaacccaaacccccgacttcctgctgtggctcaaacactcccagaccactcatgttttatccctgtgaggaagaacgctctttctggatgcttcatactccttcctcagctccttccagtctctgcccccacgccaacttctccatgaggcctcagctccgtccagtctctgcccccacgccaacttctccatgaggcctgtcttgcttaaaagagcaccgaacacctttcgctttcttccctccatgacgctgagcttatctcttggctgaaagtccagcatgtgggtagtgcctgtccatgtgtttgtatacgtggatgagtgggtgggtggatggaggagtgagtggatggatggatgagtgggtgagtgagagtcaagtgggtagatggacagatgagtagacagatgactgggggtggatggagggcgagtggatagatggatgagtgggtgagtgggtagatggatagatgaatagatgaatagatagatgactgggtgggtggatggagggtgagtggatggatggatgagtgggtgagtgggtaagtgggtgaatgggtagacggatagatggatagatgactgggtgggtggatggagggtgagtggttggatggatgagtgggcgagtgagaggtaagtgggtgagtggatagatggatagatgaatagatagatgactgggtgggtggatggagggtgagtggatggatggatgagtgggcaagtgagaggtaagtgggtgagtgggtagatggatagatgaatagatagatgagtgggtgggtggatggagggtgagtggatggatggatgagtgggcgagtgagaggtaagtgggtagatggacagatgagtagacagatgactggggggtggatggagggcgagtggatggatggatgagtgggtgagtgagagttaagtgggtagatggacagatgagtagacagatgactggggggtggatggagggcgagtggatggatggatgagtgggtgagcgggtaagtgggtgagtgggtagatggatagatggatagatagatgagtgggtggatggatggagggtgagtggatggatggatgagtgggtgagtgggtgagtgggtagatggatagatgaatagatgaatagatagatgactgggtgggtggatggagggtgagtggatggatggatgagtgggtgagcgggtaagtgggtgaatgggtagatggatagatggatagatgactgggtgggtggatggagggtgagtggttggatggatgagtgggcgagtgagaggtaagtgggtgagtggatagatggatagatgaatagatagatgactgggtgggtggatggagggtgagtggatggatggatgagtgggtgagtgggtaagtgggtgagtgggtagatggatagatgaatagatagatgagtgggtgggtggatggagggtgagtggatggatggatgagtgggcgagtgagaggtaagtgggtgagtgggtggatggacagatgaatagatagatgactgggtgagtggatggagggtgagtggatggatggatgagtgggtgagtgagagttaagtgggtggatggacaggtgagtagatagatgagtgggtgggtggatggagggtgcgtggatggatggatgagtgggtgagtgagtgggtaagtgggtgaatgggtagatggatagatgactgggtgggtggatgggagggtgagtggatggatggatgagtgggtgagtttgtgggtaagtgggtgagtgggtggatgatgagtgggcgagtgggtagatggatagatgagtggatgggtagatgggagggtgagtggatggatggatgagtgcgtgagtgagtggataagtgggtgagtgggtgggtgggatggatgaataggtggatggatgggtgagtggatgggtgggtgggtggactgttgggtggacgaatagatgggtggatggatgagtgggtgagactgggtaagtgggtgagtgggtagatgggatggatgaatagatggatgaatgggtggatgggtggaggggtaagtaaatggatgaatgagtgggtgagtgagtagtaggtggggtgtttgtggatgggatggatgaataggtggatgggtgggtgagtggatggttgggtgggtggatgaatagatgggtgaatgggtgcgtgggtgagtgagtgggtgagtgggtggaagaatagatggatgagtgggtgggtggatggaggggtgagtaaatggatggatgagtgggtgagtgagtggtaagtgggtggatgggatggataaataggtgaatgggtggatggtgagtggatggtttggtgggcagatggaccagtggatggatgagttggtgaatgagtgggtaagtggatgggtggagggatgggtggatggatgggtggagggatgggtggttggatggttggatggatgggtggagggatgggtggatggatgggtggagggatgggtggatggatgggtggctggatgggtaggggatgggtggagggatgagtggatggatgagtggagggatgggtggagggatggttggatggatgggtggatggatgggtggagggatgggtggagggatgagtggatggatgagtggagggatgggtggagggatgggtggatggatggggggatggatgggtggagggatgggtggggggatggatgggtggagggatggggggatggatgggtggagggatggagagttggagctgccaggatgaactgagaatttgcaaagcagggagaggggagaagagagggccctgcagtctcagaagccctggaatgaggctgggcccagtgaagcaggatgaaggctgggcagccctgagtgggtgtcaagagaccaggctaaacccgggggaaccagggtgagtggctttgcccagttctgcagagaggtcagggaaggtcacaaggggtccggggaagcagagggcaggcaggctgcaagtgaaaggaaagaagctgcacagaagctcctggctgtgggcaagagtggctgagcaggcccagggtgcggggagagccagtgtggaagtgacctggggccagtggggacaggagcaggagggcccaggctcatggggctggaggctgggccctgaagcagacccagagaggaagcgagaccatgaggccggccctgcgtgggcctgggggactgcagggctgggggaggggcacagggcagagctgcctgggcttgcagggaaagcaactccacctggcctcaggaaggtggacaggactaggcttccatctacatctacagaagggcctcagagcagccccgaccccctgggggtcagcaatgccacctgggccctggaccctccagcttagacctagcactgaggtgcagagccagggaccagctcaggaagggcatggtgccccccatatccaatctgctcttctccaacccccagccctcctcatcttcaaggctaatccctcctcctccaggcaactccccaaaccaccgcccaccctctcccttcccttggagtggttctcagatggtgtgggcagtgacactgtccgtgtagacgtgtccccaggcctcagaggcttgggtgacagcccagcaccctccagtgcccggcacaggagaaatgctagggacagaggcagccatcaagggacagggcttgaccaggggcagaccctgggggccaggatgcaagcacgcccccaacccagtcaggcccctccccaccgcctgcccagcactgaaggctgcagggccctgggcacacttctgggctccttctgtggcgcccctgtccctccatccccacagcaggcggggcacaggcagatccactgcccaaggctgctggaaagttcctggagggggatggagagaagaggctgggccaggctcccagcagcccagcctacccctcctcccatgctcagggacccttgaaagctagaggccagcacccttgggacaggtgggtacaggctgagccctggcaggaggcagtggtactaatgacatctgggcagcctcaaccttggaagggggctgagtccctgggtgagagtggccctgagcccccatctccagccacagatacggtttccagaaccttttagaggttgcccagccccagtcctctaaggctgttggtgggggaggcattccctggagttggtactgatggtactttgctttttctctgaaaaagccccccaggctcctacccttcgtggcacccccatctttgagaacttggtgcctgacactgtcccagaccccctggcttcaggtgcacgacagtgagtctgagagtctggcttccagctctctcatttctccatgtatgtgatcaggggacggagagaggtgtccacacccctaaggccttccttccccttccctcttctatccccctctgcctgcttccaggtgctcagccccttccctccctctggcagtccagtacccaagtcagagagtggaacactcagaagatcatgacttttaatgctttattgggattgcaagcgttacaaggttaaagacaaaacccaagcatgggattttgccggaaatattagcgttaaaggagttgagttgagtcaaacacgggccgcaaggtggaccgaggcggcaggcacaggtgacattcagtgtttggcgtgggggtcttcaggtgatggcagaggaggggacccaagagggggccccccactgaagacattggggacacggggaggagacaagatggagagccacgactaggcacggaggtcagacaggcagcccgggccaggatggttagtggcccaggggagagctgcaaacctggggacgcaaggggctggtcggcaagtgcccccgggaacacccactccggcgaggcagaatataacactgggtgggtgggtgtcctgacgaatgggcaggtaatttggggtgcctcgaagcgttttggatctcaggccaatgtgggttccacaattgtgacaatttggctctttgggcttctgtccaatgttccgaatggcccactcacagggcgcttgccgagggaccctctgcgactgaggcggactggcatggacgacccccggggtcatgccagccccgtcaccaggacccagaagcctcaggcctctagactgctagtcgggctgcgtgcaggggggctgagctgggggcacaagtgggggcgaggtaaacctcccagaggccgagtccctgccgcagccctaggcgccgcggtggtggctgctatggcatcaccagacccgtgggctccggggcccaagcaacctggtcgatgggcagacctggcagctctcctgctctgtgggctcagacccgcctgacctccctactccccggcctcaccccaccttgcccccaagaggtcccacagagcttcggacctcctggagacaaggcagggtgctgaggggcgggcaagatgtcaccgagggagaggggagggttcctcaagtgtgcggaaggcggccaccctgccccagcctgatggaaccctctgtttacacacctgctagccccttcccctccggccagcctcaggccagccaggagccccctcctgtggcctccgagcaccctcctgacacctgaggagaccctgcccaacccccccctccgccctcaggacttctggggaccagccactgtccccagaagccaggccggacagtggccttctccactcccctctgacttctccaagggggctcagtggccagtgccccccaggaggctccaccctcaactcaacccaagcaacagggacagatgaaaaacaaaatccaatcagggcgataaatggcggggggcaggacgtggtggtctccaggctggcttcgtgcgttcttgcttttgtcactgcccccctgttacatggggggggggtttaatttggtttctgagcgcataaagctaaggaggggtaaaaaaaaaacaaaaaaaaaaaaaaaaggaaaaatgccccaagaaacaaagagggggaatagatcaattgacatgaaatttgggggttcctaatttctctatgtaattctgcaagtctgctgtcaatcctcctgacttttccatccaaaatctcccgggaccacttcctaccccagaactccccccgcccagcccccactgccccccacccacccctccaaccgccagacttcccacactccccgcatcagtgcacggcccccgaggactccacatttcttggggggtccccaggagacgggcaaagatgatccctaggtgtgctccggtgggggggtccccaagatcttccttccaggagcacaccagggagtcaggctactcgtgggggcatgtctgctcagctaccgccatctccaatgtggccaaactccttcctcactctggctgggccaacacacagtaagtaaggtgtatcgggaatgggtggggtatggggagcatcgtggctcacgctgcgggggccgtggggacaggcgccaaggaggccagcctcacaagggcatctctgtcatggtggaaagatggaattaggcctgggacacaccccgcccaccctacgggtgtatcccaaatgccgccggccgcacactcaggccgcaccatctgagccccctcctctgagaggcagggcacagacagggccgaggggcagtggagatgggaacaggagcggggctcagaccatgaaaacattggagaatcttagcgggactttggcctgatccatacagatatcgtagttgcttagatatgcttattgttttcatccaattttgtgggggtgtgcgtgtgtgtgcgcatgtgtgtgtgcaggtgggtgcttgcgtgtgcaacgtgtgtgctgcgtgtttgtgtgctgtgagctgtgttcatgtatgtgctgcgcatgagtgtgtgtgctgtgtgtgcatgtgtgtgctgtgtgtttgtgtgtgtgctgtgttcatgtgtgctgtgcatgcgtgtgtgctgtgtgtgcatgtgtgtgctgtgtgctgtgttcatgtgtgtgctgtgtgtgcgtgtgctgtgtgcatgtgtgtgctgtgtttgtgtgtgtgctgtgtgtgctgtgttcgtgtgtgctgtgttcgcgtgtgtgtgctgtgtgtgcatgtgtgtgctgtgtctttgtgtgtgtgctgtgtgctagtgtgtgtgctgtgtgtgcatgtgtgtgcgtgtgctgtgcgtttgtgtgctgtgtgctcgtgtgtgtgctgtgtgtgcgtgtgtgctgtgcgtttgtgtgtgctgtgcgtttgtgtgtgtgctgtgtgtgcatgtgtgtgcgtgtgtgtgccgtgcgtttgtgtgctgtgtgtgcatgtgtgtgcgtgtgtgtgctgtgcgtttgtgtgtgtgctgtgtgctcatctgtgtgctgtgtgtgctgtgcgtttgtgtgtgtgctgtgctcgtgtgtgtgctgtgttcatgcgtgtgctgtgtgttgtgtgtgtgtagctgcggggatgcataaagtatgagtgctttttaggatgggaattgagatgtaagatttgggggtgagggtcgtgccaattacatttcatttgcatggattttggttttcatgctctgtcctcccctcctttggtcttactgggtccctctgactgctctgtgatttttagtgatggaaaagggagtgaggagccagtctgggttgttgctattttcggatggccagtttaccctgaaaattcccgtgagaagggagatggcggtagcagcgacgtgcccacctgtgatttctggggtccttcttttctctttgctggttcagggactcaagtccaggccaatttgactcaaagtccaagggagaagagaaagaggggggtggggagtgccaaattcctttattttgccaattgtttctcagccaattcgtttttaatactttttttttttagccaattgattttttttggtggttgttttttttaaagccaatttctgagcttttgtggggtgtttctaaaaagccaattagttttaagagggttgttgtgggggggggggaagggggttagtttaatgttttgattttttatgtgtggggataattggggataatttggggggagggtatgtgaagggtgtttaaagccaatcgattttgtacatgtttgaagatgctgctgtgcttcctcagcccgatggagggggccgaggagagtagcctgtttcggggaggcggggcacggggactgggtcaggagaagccccagggggacgtggaaccgagagattttcgggatggaacctgatggaaacgtccgtggtcaggaggaggctgcaggatggtggcgccgggctgcagacttgcggcagttttgctcacttccgattgctggccatctctgggggggcgcccccgtgggcggggtcttgggtgggtagagcaatcaggggacggtgacgtttggcctccctgaacgcctcgagctccttggcgagcacgtgaccccggcgggcacgcaggagggcaggcaggcccctgcgcaggcgctgggtggactgcttccaggtgtcatattggaagaacttgcccacggggtatctggggaagttgtcctgggaggggaaggggctggtcagcaggtgcctgctctccacgctcttccgcctgagccgcccgcctgacctgacaggccacccctgtgactgatcagtgacttgagctaatgtccacgggcagagggacagaaggagccagcgtctgagctgctcccgggccacacagcaagcaaggaagtcacgggtccttgtccctggccaagaggtcccagaggccacaggaaacgctgggcgcccgaagccctatttctctgtctctagagagtgggaaaggggcccaggaccctcaccggaagcacggtcggaggggtcgacacgtccctctcggacttggcgggggtagcacagtacgtctccaggagggccaggtcacagctgcggaaacagcactcctcaacgatgccacggctgcgacggctcacacggcttgcgggcctgcctggaagtcccacagcacagagagagccgtgttagcaccgcactgaccccagcccccggaggctgaagggggagcaaaccacccctgccctcaggccaggccctggaaggacgcagccaccctgcgggtcaggggagggaagtgagagctggcaggcagaggcgtcccaggaagaagagaggtgagaggggaggtgagtgggacccagaccagcccgtggcctctgctgcctccttcctcagatgaaaaatgggcacaagctcttggtcccacaaccagagggacaccaccaggaccaaaggctcacaatgggagtggtttggaaaatgtgtgggatgtgagcccagttcaggggcccccacaggagggactgctgtccctgagcttggactctggcctggcaccacctaggaggctggaggggcccacaccacccctggagctgctgagacagggagacaagggcaggagaggagaagacgggaggagaggagtgaggaggcgtgatggaaccactcccttctttcctcccgtcttccccctctcccccacagcaatgctcagctggaaggggaaggtcgctgggggctccaccttggggtgccaaagggcaggtgccatcagccggaggagggagcaggagccccatcacgggggtcccccaagtgggggcttggccctcccctcctctcaggaaagcctggtgcagggaagcttctccctgggcaaggactggctggcaccaggccctgcagtgccacttcctacccccaaatggggcaggcaagagagagggcacaggagaggccagggcgggcaggggcttccagagtcaagcagcaggaacttttcagagagaagctttgaagtgcatttgcatcctgtgagcccatttcacagcgtgagtaagcagtggtggtaaagatgtcacgtggtgagtgtcaggtggaataagccgtgcggcctctgccagtaaggagcggcccctcccctgccccatcaggcatgcccaggcaccatgcctgcctctgcatccacccagcccccctatctgggggtggggtctcaaggacaatgggccatgcacccacctgccagcccccaggctggagaaccaagagagaaacatgaggaaaggctgaagcgtccttgaggtcagcaggtgggcaccccccacggcagccttggggcccaaggaggcgcatgcaccgctcacccctgccacccaccaactgcacttgtcttattgattttaattatataaatcactttattgattttaattctgatcattcaccgaacgcacgtcccttgtcagaatgtccaaaaggtgcaggaagaaaggcaggctcttcctccagagcctgaagccctgcactaggcgtgcggtgcctcaggagcaggagcctcacggcccccaacagaaattctgatgcccagggagacccctgtgagtgcccctgacgtctagggggcacctctggcccacccttcgaaggaggcgtgtgatgggaaaggcagctggtgtggatgccctgggacaccgcacgtgctcagaaacgcggcgggaaggtcaaagtctcagagcaagcggctgggctgctgacctaggagtgtgctcccctggcttgaggttgggcgtcctcaccggtcactctaggggcctgaccaggtctgaggaagcccctcccagctacttactgaagtagaagccgcggtccccacagacgaactggagggtgtccaccagctccccgccgcacagggtctcactggggcggtaagcagcaatgcagcacgaggcgaaggccaagaaggtgagaagcaccagcatcgacttccccattgggattcccattggtgtctgggggcgggagagaagtggcgtgagcggggcagccaggccaagccccaggccagaggtgcccctcccaaaccaaatttgccaacctacaaattcagttgaaaattgaaagcacggctttcctataaacattatttttattacaaaagtaacacacaggtcataatgccgaggtgagggcgcagggccatgtgcagaatgaagcgtccagaagcacacagaaaaggcccagttccttccatttgcaagaagcactagtaattttacacgaggggtgaccatctccacggtcattattgcaggagctcagcggcatccacagctgcaggggcccaggctggacacccgacctggcctccgtcctatgacaccatgggggcagggccagcccagcgtcacatcgccacttctcaggcctccagcgccagccaagatggcagacagccccacccctacagagcatgtgcatccaggaggaccagtcccttcctccccacaacccccagctgagcagggggggtccaggaggaccatcgccctcaaagcagcaggccagtcctgctgggccagccccgcccctccccctggcttttccacctttccagtctgcagctgagccaggcctgggtcaaggactccaatggttaacacaaccacgccacccatgctctagaaaccttgttttcccagtcacccagttctccaactccagtctgccttgggtacccccaaacacacacacacacgcccagagcctcctttccaggcctcaaatcgaaccagtaaggccaggggcctccagaacatctccctatttgcgctaccaaactctccccgtgggagctggagagaccagctcaggccacctgggaagtccgacaccaggttccccagactacaatctggaaggggaggccagtcttaggacacaccccctccacaggctgcagggccacagggccgggttaacccactcgggggtgggaggccgggagccaccacagcaagttggccctgcccctgcagaaggtggaaccctccaggcgggcagccccagccttcgctccgcagacccaggggagtttttgatgcaataaattatgtgagcgactgagcaggcagtgggacagaagcacaactttgcatgccctctctaaagactagtgggcagctgcgccgaggatctgaaagcctccttggtcatctccttgactggaccctggccagtcctctcaccgccccctctgccacccccttccaaattctaagagcacactccgccagctggccactctagccctcgccgcgcttccgcaacaagccccaccactctgaacttggaggtccgggtcaggggaccggcagaaagcaggacaggaagcatgcagcggtgcggagcaggtgagggcccaggaaaagtcctgagctgggcaaggagggggccgaagggaaggaacagaaagggaaggagcaggtgagggagcagagaccaggtgggggcaggggcagaggaaaagaggggaggggggtgctgtccgagaggcagcgggctggcggctgcagggcccgaggcccaggcgtgggccgtgccccctgctgccctgcctcaggctggagtgggatggcagcgggggtcctcactccacagccctggttacctacagctcagcagaaggctcgctggggcaggaggaggaggaggaagaggaggaggaggaagctggaagtctctttcacaggagaagctaatgtccagtttgcaggctggtcagtgcctcagcttttatgtgtgagccgactcctcccagcccgggctccaccctaccccccacccctctccctgctgaccactcccccgcgcctttgctcccgccctctccctcctcccagccagtctcttctctcctgcacccccaaccgggagccctggaccatcccgtagcgaagtgccatgggctcccatcctgcacccccggctcatctctgcacagggcagtgaagggggggggggtctccttcccacctccttgtatggaaacttccacgctgcccactgggcaggggccgcggcctctctccgggtcgaaggctctgcccttcttagcctcagaccagcagcccctctccccctctcccgggactcctgtttggaaatgttgcggacagagccagagggggtgtgggggagatgtcgcgaatgtggcgtctgccatgactcctgccaactcggcccctctccatcctggccccgcccacccccgtcttcctctcgcggtctcgctggcaccgcgtcaacataccagggtgggcttctgcggctccgcgcccctcctcgttacccagcaccccggaggccagggcccgcaaggcacgaatcacacatgtgaggcggcaccccctgcacccacagaccgaccgggaagtcgcccctgcagacacctcacacctccctcggcccttcccgacgcccccaccccacccccagctccgccgccagggtgagcgcggggctccgcgcagggaacgggacccgcagccgtccgtcctcctcctcctcctcctcctcccccccgggctcagccgccccgccgagccccgcaggccccgggccgggagcgggcggaggaagggccgggcgtccggcgcaagcccgcgccgccccagccccggccccggcccggcccgcacacgccgcttacctggaagccggcgacgctgccgcccacctccctgctgcgtgtcgcaaaccgaacagcgggcgttggccctcctgccggacactcctctgccagcgccgctctggccgagtcgcgggggccgaatgtgcgacggggcagagcggggggatggcttttttttggggggggggggagaattcgtctgattgtccagggaggacgggctgtcttcgggctggggcgggccagatgttgtacttttcgggggggaaaaggtatcgggaaatgaggtcagctgttgtatcaaggatagaggggggcagagatagtgggagagacagagtgaacgtgaaaggggggggccgaagagagggcgagggggagagaggacagcgagaggcgggcaggcgcacagcgggagagaacagcacggagagaaacagaaagcgtgtaattaatccactttggttcggcgaaggcgagagggcgggcgtgagggggggagggagtcggaggctaggagctgggggggacgggagggagcgaagggaaggttgcgggagaaagagcgggggccggggccagacgccaagaggggcgcggggagcacagagaagcggagggaagggcgccacgtcgaggggccgggggaggcggtgactggggggcggagtggaggctgcacccggaccgcgggcgcccagctcggtttgggccgacggagccctctgccgtcgcgagcccgggcctcgggagggggacaggcggtggcggcaccggggccgctccgggacgcagcgcggaaaggggagcggcccgaggctgcgcgccggggggagggctggagggggagcgcgggggggggtgacaacgccggcggcctgcgagccggactgcctgcggggggaaccgcctcctcgggcgaagcggggatggggggagttgaggtagatgaagaggaggcggcggggaatccgcaggcccggcggagcgcgaccccgcggacggcgcccgggacgggagtcagcagcgaggcagcgggcggcgtcgacgcggggccgccttgcccgatggaggcgctggtgggcagagcgcgggcaggcgtgggccaggaggcgggggcggccggaaggggggggccggggccggccgggcctcacgcagctccgccggagagcaggcgaactgcgggcgcccacgcccggctcttatagtcgcgccagcccgcggcccagggcccgcgcgggcctcgctggcctcgcgcccgcgccaatgggcgcccgcggagccctcgccccgcccccggcccgcccccgcaacccgagccaagagcggggcggggggtgcgggctgggggccctggggccccggggggggggcggcggtcgcaggggctggggggtgcgcgggggcgaggctgggtggggggcagggagccgcagagcgccaaggccatgctgaatgcccgttctagagaattcaggggccccatcccgggtttctggggtgcccgggcggcctgtgctcgtgagctggggtctccgggcaggcaggggcaggcgggctcccagcgccccaccaggaggctgcactgcgggtgcgccccgtctgagtgcagatgcaggtggcttggggctgagtcggggggtccttgctggttgttgcggctgagggggcccctgggctcgggcggggcgcgcagccgccacctgccccagcaggaggagccggccacgcggcgcttggagcctcagccagatcccgagcgccccccggtgccgcgccggagccccggagcccccgccaggtgcgggacgcgcggaaggccggctgcgccgggccgaatctgggccaggcttggagcctacggaggctccggccgccagaggagagaggatcagggcgggaaacacagctcaaatcctacctgcatggccgagctcaccggggtgcgtctaagtagctcgcctttgcggcccacccaaaatatctggataatggttaccccgtcctcagtgcgttggacttgcatagacgcgagttcggtctcgggggccaccacgataatttgggggtctggggaaaccatctcctggagagtttgaacgatgtaagaaagcactgtgatttttaccaagtcaaaaaccacgcacaaaatcccgcaccccgccagccccccgccgcctaagcctagccaaggggaaggggccgccggcggaatctcgcgcccccctggcccccctcgcccccctcgctccgccatcaatcacttcgcccgcgctccgcgcgcgcctcccggcggagtcctaggcccgcgggctagaggcactttaccgcccggcgggagcgcctctcctccgcgtccctcgccccagccccctgcccgccccactttgggaccctccagccgctttccccacaaatgagatctttgcaatgagcaaacgaaagtggcgcggatttcggggcgcccagcaggagcgagcgcagccgccagccgcaagtccgcagccgtgtcccgcgccccacgccggcctccccggcggcagccggagacgagcgccagcaccggcgggacagcagcagatgcgggccgagagccggtcaggggcgcagaggcggaggggatcggcgcggcggggagctcaccgcgaagctggaggctgcgtccgcgggcgcaccaggagctcaggcagcgagcgatcgaacgctctgtggcaggcggtggacgctgctgaaggtgagcgagaccccggggccagtcctcagtgtccgggagcaacgcccagtccgttggaagacccggggacaatgcccaaatttgggggagactgggggcaatgcccggtcgctttcctggacacggggaagccctccctgtccacgtcctgagggcgcgcggccgacccaagtgtgtttgggcaacgctagagagaaatttcccaaatccgagttgctctggggacttcgtaggagacagagaggcccgaaaccagtgcccgctgtgcgcggggttggggaagctgcagtgggtggccggcgagccgggaacaatgcccaaattttggggaacgcaaggcagagttctttctgccttgcgggcttagcgaatgggtgtcctggaggaggggaccccggggactccgttaatgtgggaaccgtgattaatgactaaactcgagactccagaaaaatagattacaggtttgggggatgagagaagttgctccatgcaattgggaacatagagaaagaggtctcaaataggggccagctagcttgggggaccaatttgtgaggaggggtagttaaagaaaattctccatatgaaattgggaattttgccgtagagccatattacgtaaaattggcagatgaaagcaaggaacacattttggggatccaaacacattcttggtgtgttagggggaagctgagattaattttcacatcttaagaatataagttagtggcctggacgctggcagcagccggggaaaaaataaccttcataattactgtggcttcagggaaaggttttaacacccttcagagatggaagaaagcactgtctagattttgggggagcctggagtgtgatcagtacatttggggaaagcaaaataaaaaataaaaaaataaaaaatcagtattatttttctatgctaatttttaaatgatttccattagcttatttttggtaaataagaaaaagactatatattttcctggatgtcgtctgcatttgggggagccccagtgaaacacatttcaagtttttgggacacatggaaattacccaatggagatttgatatctaaatttctggaaacctagttagtagctaggaaacttataggtcgcaggtttttccatgcctgggatttcttgggacccagggacattttttagtgtgctttgggggtccatggaacattttctaaatgtagggggacccagggcagggaccataaagtcaggagactcataaatcagtattaaaaaaaaaaaaacctcaattgttttgtgaagggaaaaaaatctcaatttgctttggaaggctgggagacaataccgcaatttgggggctccaggaaaatcgtttttgaatctaaagatctagggaagttgctcagagtccttggaggacttgggggtccatatgtacattttaaagaaaggggattcagaattcctaggtcttaggacttaggaattttcagattttgtgatagggagtgtgcagtgtgcttgaaggaaatattgcttaactttgagatgactcagtgggttgtttggagcccaagaaatcagtgctgtcctgtgatccgagggcaatgctgaatgttcctagagggcctggagggcagcgtccagaacatccaagtatgggggaccaggaaaagggtccagtgtgatcctggccgttggggtttcagaccaatgcctgaattttagaaaagcaagattcttgttatgaagctcctgggacccagagaattgtttaatagtcaatatgttgtgatgcagagaaagtgctcggaatgtttgggaactggggccgttagcaacacctggcataacagaaataaaagtaggctctgcccaaggggtccttttgtgcttggtgtagcccagagggacccgggagaccctgtgtgatttggggggacctggagaatcctgggtcacacttgagcacctcctggtaactgctcagtgtgctccagggacctgggtggcactgtctacatcttaagggacctgattcgtggccaggcagcatatagagccatagacgttaatgccccaaagctttgtgactcacacacccacaacattctcaatagctttggggaatcactggggaaatccctccattttatgaaactcaggcaatcagagggcaggtcgtttatgattcagaaaaggattcaacatgctctgggtgtaatgaccgaatttgggggaaggtatgggaagcaattttcatactctgagggttccaaccttccagccctgctgagtgtcatgagggacttgggattcaacgtgtaaagtttagggaacccaggttagtgtgaatagatttgcgggacccaacagcaaatgtcccatgctgaggtgaacgggaaggggcgcgggggtggggtgggggggcgcggaatggggcggacgtgtgccggaaacagtaagcttaggagaccctggagttaatattcaaaattatgcgggaaagttccacttgttttggaaacaatgcctaaatgtggaaaaggcactgtccacatcctggggagccaggcaaattggtcagcgcgaccaccacggaccaagggcttcgtctttaaaattagggaagccgggttagtggcctgtaaatctgtgggacctggagggggtgtataaaactgtccagagcctgggagaaagcacatctggggccccaggccacatagtgtaagtctggaaaagcccgccgggactgatgtgttttgacgtccccggaaattaacgtccaagaaaattattgtgacccgtcgaaatggtgagtatatttagaagacttgggaagcaatgcttaaatttagaggatcccagaaaaagtaaaatgtccgagttcggggaaagcagggaagttgttccgtggattggaatcccccgaggatcaagggctaattgttgagctcaagcttcccgggcagcggaaggaaggcgctgccggggattcaccttggctggggcgcgcgcggagcactggcgccctccccgggaacccgagcgcgggcggcgcgggcaggtagcgcggagcgccctggcgcgcacggccggctgaaattctgcttttcgttctttggggtttttcttccttttgcttttatttttttttttctttgccttctccacacggagagcgcgtttgtggcggcagcccgagcttagcgggcgtccgggtgtaaggaagaaacccaagggccgcgagggagcgaccaggacgctgcttcccgggcgctcccgggactcccagatacctgctcggtccccgcgtgggaggtccgcaggctccccctcgccactgcgccccactcgcctccgcgctgcgagcctaggcgaagccgcggccgagccgccaccgggggcaggctagtccccggcttggcttgggggcccggagcacccccggtggccacctccggcctgccccggagctttgcgcgcgccgttcgggccttcgccagcaccaaacaagggtgaaaccagttttgtttgggtaacactgaagagcagaggaagtggggaggaaaatgagaaacacggggcccgggaggaggggggtgcagggctgcacgccgctggggtgccaggggtctcttttcgttctctccaagcgaattttcagggaaagtctgtccactccggctggggaaagcccagttccttataggcaaatattaaacccgcatgcaggcgcccaacggccctgtcggcaggaacaaggtcaccccttggcgttgggcaatgtcgggcgatggggcagtggccctaaggggacctgtggggtgggtgggggtactgccagagagggggcaccgctggggaccagcagaatggtgggggatcctggggcaactacagtgggcattgcttgtccccattgtcaccccataggaggaccccggctagaaggggggcatctcaaagcctgacactggggaggcagaagttaatggccttggacaggtgtggggagctgggcaggatgaggcatctctttcacattagcttggcaagacagggagaacccgcccccaccatgaaaaacagcccattttccacccacagaacaagacacgtgggaatgtccccttcaaatttctgtctgcatcaatcacccccatgtcccattccaagaacatctggcccatctctccccacccatcactgccccccttcccaccagccttctgcagcctccccgtgtccccagctctctggcctctccggctgtgcctatagaagggggagcctccagcagagaacccctggctgtgttgatgttttcctctgcagggtgacttgtaaatttgggggtgaggagcatttgaaaggtgcctgtctgcaaacctggtccccgggagagcggactaggttgccgaggctcccgtcatggacaaaaccagggcccccagggccagctctaggctccccccaccttctcctccacgcctgcttcccaggctggggacaggttgggcatcgggggtgagccccagttccgagttgtgggttctcctcctctttgggggtgctggggacaattacaccagtgacctgtttgggggtcccttccctttgttctgccctgccgaggtgccttcccccagggggccaccgctcatgcttgaaaatgcatgcctggactttttaaggtaggaagaaggctgagggtcaccttggggtgcccacagcagggtgtagtggccctgtagggagggaggagcaggtgggggagtgggggtgcacacatgttccccctccctcgtggggctgcctgctgagtgctctccttatttagtcagaagtgaccagggcaggctggaggctggggcagacgcgggtcaccctgaggctcgaaaagcacaccggctcccctctagtcaagaccagcatcggggttcttcctcaagactggctcctcccccactacttccagcccccggaggtaggaagggtcccgccagcagtccaagggtgttgggagggggccagggtctcctcccacccagagcttggccggcaggaactttagccccaagcagcgtccgccccccagccctgaaccagcacctcaccagggcaacgctggtctcctctccactggcaaacccacattccacagaggatgaacatcccctcaaggactcagactcaccccatggagcctggcccatgccccagcctcggcctgtggctgctccccatcccctcgctcaccagccctgaagtgggcctttctcattcccatttcctccccagctctggctctgagctcaccgctccgccgtccgtgggaccaagcccagcattttacaaacccagctcctttctccaagggtcctcagagcgcccctccgtcaccccctgcagggcgccgcagacgaggcgctgaccttgcgctcactcccctcgctggggaaggacacactcgctggcgtcagcccggccggcctgggaagtaggactaaggacccgaactgcaaccctccacaccagacagcacagaccaccccaaggctgctcaatctgcccaaagccaaaagtacgtgggggatatgggtccaggttggggtgcttgggagagggccctgggagaggggttcagacggtgcacactccaaaggactgaggcggcgccactgtgttaccattttattgagtgtctaaggtaaagacacctttgaaagaacactcccggcttctatctgggatgggcaaatcagcctgaagagtcacctgctggatccctccctgcaggccctgtcgtggggcaggtacagggactccaatccatgtgcctccagctccaacgctccccaagtcctggagcctcccctgtcaccccagtgcctgaccagtgaatgggtgctgcccccactacagagctccctctggctgaggcagaggccactggctgggcctttctagccacctttcacccctcttgcacacgggaagccccgcaggctcctgaccacaatgggatcctgacgccggagccccttaggccctttgctcagaaggcctctggttattacctcaattctgaacagccaggaggcctgagactgtcacccactttgataaatacagaccgacagaaaggtcaggccattggtgcaagaccccatggccagcagcctggggcggggagaacccgggggtctcacagcccccagcagagcccagctttccttgggtttttaggttcttccccaatgatattttccctttttccctctctacccactttctgccccccatcttctcccctttggctgcccgctctctccctgcccctctccccttctttgccctctttcgtctcccaggagctcccctgccaggacctcggtgccgtggagactgcggggaacctgctctgcccacacctgctctggcccctagacggaagcacctggagccaaccacggaactccagatcccagctgtgtgactgaatccacgccagcctctctgagccaaagctgcttgcagaagggggagatcccagttcgaagactcccgcgcagagcctgtggccctctctgccaggcctcagggtgcctgagacactcacctctctgcctcgcagttggggctgaggctggggctggctgccagcctcagttctgggagcgctggggtcgcctgggccacaggccacagcagctcacctcaggactgggctctctggcctgctggggctcaggctgtggggcaggctgggcagggggctgagctggcagcgattcagagccctggggctgggggctggaatccacctcctcccacacaagctcggtggtgactcttcggcccctggggaaaaacaaaaagatattgctgagatgacctcttttaaaagcaaagcccccctccccatacaccccaagcctgagccctgtcccatccccctccccgggttccttcaggtcaccttgtcaggatctgggcagcggcttccccctctagcccctcccctgcctagagctccctctttcaaagtataagggagggaagaagtggtgagaagtttgcctagaaagggcttcccggtgctgatggagaggccgagacccttctgttggacaggctgccctgttcctgggtgaggatgggcttctgcctggcactgggggtggagggtgcacacgaatggcccgccttgaggggtcatggcacggaatatgaaagcctcctccacctccaaacacccccaccttggaaggagataaggagggggccccagcaaaagccactggacacacagctctgcttgacgaggccagtgagggacggcgtggctgtgcttcctggggaaatgaaccccctccccacagacaccaccctgggtggatcgaggagtctgggtccagggtgcaacagagaaaaacttcatgcatgaatgagcattcccagggaaactgccttggccccagggcgcctctctgtgccagggaggctgggagagcagcaagggggaccaggtgcgccatcaggaggagagaagctaaacctaggggggacatggagggcggttgttgcctctcccggcatttctcctcagtctcctgtccaatttcttgctggtggtcaggaggcatagggaggcaggagggaaggaagctttacctgtaaaatggtgtatatatgtataaataaaatctctgcgccagaatctcgggcccctggctcctctgcaaagtctcctgtttgtctctgggaatgggatgggggatgcaacgggaggaaacttttcacacagaaagactcttcctttcacacttgtgaagacagctgtgtgttcccgctgggaagagcggcctagccctcctcccctacccctcccattttgcttggtgaattagtcaaggaaaacctattttccttgcaaaagcctcagtggctttgtgcagccctaaaggagaaccctctccacaatggcctttcctgcacaccccatccctgaagttgaggctgctctcaggaggcttccctgcaccctccagcagcagaagttcttcccctccttcagaaaccaggatcctggcagctgccccaagctcccggcccacccacgcctgaacacttaaagtgcagcttttctctcacactcaagggatgggagcccagttacctgtactctagtccctgcgcagtccccgcagctcctggacagtggataaagaggaccggggagtcactggtgcccaaggctctctgccgaaactgcctggacgatgatccgccggcctggccaatattagcagtcaccaccaaagcagggggtgccctggctgtggcgtccagaccctctggccaggttgacgtggaggaggagagggacaaagctgaggctggagaaacgaagggcacttttagagtgtgcatgttaatacggcccctacagatgggagagcctcatctccgctgagcatggcacctgctcaaatgccaactgaaatgatgggtttacccctcacctcctcatcccctccactcgtttccctgagcccctccgaatttggggagctttgtgccaacttggtagtgctgaggccgctggggcagctggctcaggcactttccagcaccagggcatggtacattagcgggtggaggtttggcccacccctgacctggcagaaaggcgcctgtgggcgtgggcataagccagaagctccctgccagctaggaggtgggggctatgtggaggtggtggggagtgggtgtagctttacttagagtgacacttggcagttacttgacaccctggaatgttggtggacgtggcactggtaaaatggcggggggggggggaataagggggacaaagcagggttcaagaatcagcagaaaaattggattttaggtgctcccggtacagttatgtactgtgcagttatgtccttccatcttccatgagcaaggtactcagctggggggtttttcacttcactggtcacgtctgatctgacctcagacactccctgtgtggtactaagctctaatgacactgctgcagggggcacttgcaggcatttctggattgggcgattggacaggttcgcagcctttctaattaaagcacagactcaaagctgacagcagctgggtgagggttcatatagaagcatccaccagattggactaaatcacactggaaatttctaacctcttccccaagctagcaaagactcaggaagaggcaaagacgtgtactttccagagagccaccagtccccccctccaacacccacgcaccccaaccaccttcagtgtgattagttttactagcctgtgttgggatttaattgtcccctctccctttttctttcaagccctcgtcttaaatcccttcattagctggaggaataggacatctagtggggacaacaaggatttcagcagggaagagagttagacttgaaggggattcaaatctggcatgtgttgggggatgtctcaaataagacgtagatgccccagagccatgccctcccatgggaggagggaaaatgggatttttcactcggcttttgggtggggagggatgttaatggccctgtcaggtccagagcactgaatgggttcacagtctttccagctaaagcacagactcagagctggcagcagctcagggagggctcagatagaatcacccattggattagatcaagtcttactgggaatttgacacctcttcctcaagcctgcaggaagagaaggcacaaaacaaagactcagggaaagaaacaaaacaaagatacaaggaggtcagcatgaagcagcccttgctccggggctctatggcttagagaccccgtagcatgtgctggtcccagtgtctgctgcaagatgcccaaatgttgcaaacagcgactgccagagccctctggagacacttggctgggactttccaagctgcagatggacctagagagagtgacgggctgacacccagccagatgaagtgattccatgggatgcccccccaaatgaacagtccccaggttgaggaggtgggcagctatggggctgaaagggaagcagcccacaggtcaaactcctggaaacctggagcctcccaggcccacaatggtgtcttgaatccaaactctgccctggactggaattccatctctggatgggcccaggaggagctcactctagtctccaaggctattttatcccatcaggatcttggaacccagggtgtgtaaacaggagaaggagagcagggagaagcggtcaggatagaaagggcccccggggagcagctaagccatggtgccaccgaggcaggactagaggcattggggatcagtgagttggggtgtgagggctgtggccccacagcactacattccacagattttccacgcaagggtctgggggacacatgctttatggagacaggtgagagggaccgcaaaatggacaaaaactggggtgcaggattgagggacacgacatagaaaaacctccttgctccactgcctcttaggcctgggagaggctcagcccacccctgttcatgcatgagagtcttgggaacccccagaaatctgctacaccaagctttcgccatttagcctcttaagtggccttatgctgacacctggcggccatttctagaattacagtggcataacccaaaggtcttgggcgccgcaatttggggcactctggagggggactctgggggcaaagtcaggacgcctccctacagtgtcagggtgccatgggtcctgcacctttgtgtttggaaccggggctcttatctgcttctgtcccggcattacaggactgagagggggcgctgagggaattcctcccttcgggtgtctcctaacccgagggggctgtggcctggtgagcatcctaaagcttagggcctaagccacaggataggtctggaacacctttctgaagcatccgttttgttctaagagaggaaaccaccacattagcatgaacataaaatgagatctattactgagaggcccggggcagaacgttgagaccccctttcagagacagcgtccctaggatgagcccagatgggctgaatttcgttcttaactcgcttccccagccccacccggctccacctgtaaagcggagatttcctaatctggcccgagcctgacaccatgtggccacttgtgagaattgcatccacagcttcagaaagcaccgccagtaaatccatattgccatgaccgtagctacagggccgcttaacaaaccttgggaattgagagaagaggaggaagtaacccacaacctagtcctgaaaacaccagactgtggccccagagccctacaccatcgaggtactggaaggccaggctgcctctgctggggaagtgaggccgtccttcaaaggctatagggccacagcccgaggggctggcagggccaaggggaccactgtgccactcgcacatcagtgcttggaggacggatgggcaggaggggcctgggggctaacccagttcacagccgcgctctgccaacgaccttggacaaaccagttcatgcctcccctctcccttccaacctcacggctacagtggatgggtctgggtagccacctctggcacaaaatcaatgttaataaacgttcgattttatcctccccctgacgtaaagtgacatttgcccctgcctcccctacccacaggtccacaggtgccgaaaccttttttggtggtcatgtgctcagcaactcttcggcaggcctaggcagctcgggagctcgctgcaaagactcctccacctgctccagcaaaacttgctggctggcaggggttgcagtgagctgagatcgcaccattggactccagcctggatgacagagcaagactctcaaaaaacaaacaagcaaacaaacaaaaaacaaaacaaaacttgctgcctgggaggactctggggttttcacagcctgtggcccatgaacaggagggaggctccaggagcacagatttcagcagtgggccggatctgcatccctggcagtgggggcccagtatggacccatcctcaaggcctcagtgccagcaaggcgggagacacgtcttccaggaagcctccccagccccactccctgctaatttctgccttctctgttctgagctctgatggtgcagctgaggtttctccctgccctgggcttccttggatgctgggctgggggttgaaagagctgcaaagaccccttccctgtgatgggcctcagggccacggattgtacctgggtgttgcaggcacctcagagcccctcctgcttgtttttttgattgttttgatttttttgtttttgtttttttgagacggagtttcgctctcgttgcccaggctggagtgcaatggtgccatctcggctcagcgcaacctctgcttcccaggttcaagcgattctcctgcctcagcctcccgaatatctgggattacaggcatgtgccaccacacccagctaattttgtagttttagtaaagatggggtttctccctgttggtcaggctggtcttgaactcccgacctcaggtgatctgcccgcctcagcctcctaaagtgctgggattataggcatgagccaccgcacccagcctctcctgcttgttttactctaagatgtgcagaggcctccgtaccccagccccgggctcctccctcgaggagctgctcctccctccaaggtcccttccacacgccctgtgcatgcccggtagccatggggactgccacttcccacggaggacatgtcagcttccccttgcctgtggtgcccagacctgaaccacacccacggggctgtccccgtgatttgaaggcctgggcacagaaagcagctcacgggtgtactgaagccagaggcgcggctgccgaagggcctgcctctcacagacaacactgagctacaccatccagcagctgaggcaggcagggccttctttggttcccttctgatggatgaggaaaccaaggcccagagatgctaagtgactttcccaaggccacacagccactggcagcagagccaggatgtcagccccgcctctcagctctcacccttcagccccacactggcccaggtggacactcactggccctgaggatgctgagggcccatgacttcttggcacccacagatcacaacctgttgtagaccttgaggccacagctaccccttctttgttgtcgagaccagcccatgcccagccagggggagggacccaggtgctagctctgtaagggtccctggcaagggcagcatgggcagtgctgggctgggtctgcggccctggaagcaggagcccagcgtggcctcgtgctcaaggctgcagtgctggcaggggcctgggacacctcctccaggaagcctcccagcctgctggctcctgcctcctctgctctgagctctggtgctgcagctggagctggcatggggtgccccagccctccctctctccctgagttctcaggcaactcttccccctgcctggagcccagccgcctgctccctccttccccacagctgggcctaggttgggaagtgctctcacggagcatctgtcctgggcccgccccccaggtggcaagggaggaagcccaccttccactcacccctgcccctgaaagcttttcttgcaccttgaaggtcagggctcggagggccccgtggaagcagccatcgctggagttggggtttgggtgcctcattgcctccaccatggggtccccaggatcttctcccagccccgtcctcaccacccaccgagccacccatgtgtaacgggcccatgccaggaaccccgcgctctagagaggatcaggggatgcccaaggtccctccgaaactgggcagcagcgggcctggatgtgggcaggtggtggccctgtggaggccgggctggggtgggaccgagctttgaagtgaaggtggactttgaagacagaagggtgcgatttgagtcccagcgtgagcagccgcaagctggcagggccgcggggggctctggctctgttttccaaaaacacagatgggctgggaagggggtcagagagaggcctgggcggaatgtggggcccgcggcgcccccgaggttctgatgactcagcagcctgggccacacagggccacagggagcagagcctccccgaagcccacaggcctgtggacccccagggcttggcctcctcgaggccggtctccatccctggcaagggctgggctggctctgcctaggggtcacagccacccgggtttagacattctcagcccccctgggcgaggagagcctggcaggcaccacctacgttaccctcggcctgagggaccccgactctgacttagtccttgatccatgggcaccctgagatccctgctatcaacctgccttggagtggggactgtggggtgaccttttggtacagccccaagccagcttctaggggcagcctcggggacactgggaggcttggaggctgcctcagcagtccctggggtcagggagagggtctcccaacagcggcagatgggcaggaagtggggagtccaagcgaggtggggtgaggactggggccacctgggagcagaggagtgagctgaggacgcggaggagcgcgtgggaggccggcggggagcttggcgccagcacagcacggctgggccgcgagagggacgatggggtgccgcctccggccggccccactttcgaaggaatctgccttgctgttcctgcggccgaggccagaaacaatagtgggaggaagggcggagggtgcggaggcggcaccccagtgtgtcatctccgcgttcccagaccctgtctacccctgccctcaaacattctttccagagtggacctccctctcctcacggcgctggcggaggggagcgtgggaacgcactaaccctcagccgcctggaccccagctccaggccttcggtgcccccaggtcccagcccctgaagccccctcctcacatagaaaccaggactcgaccttctggcttgagtggctgagggagggaccctcctggccaccgctggcctccagcctcagtagcccccaggggccctggggaccctcagcaaaggccacagcctggtccaccaccggccacagtgggctcagccacgacgagggtgggacggagtccccctggtcttctcaccctagctctctgtgattctaggggctcgcaggtggggctcagagtccagccagaggctttcttggaatattagagacccagaacatttgtcccggccctctgagaaacccaggctggtgagaggctggcctgaggcttgacttaggggccgagactggacctgagcaggccgggggcctctgcaatgcccccaccatcatcatcagacagctcctctcattcctaagccccatgcccttcagagtgcccagcagggccccccacagcccccatagtccctgggagtgcctggcagggccccccacagcccccaagagtgtctggcagggcccccacaggccccacagcccccgggagtgcccggcaggggcaggatgcagctgctcagaccctgggtggtggccagaacctggacccgtggctggtggccggagtgcatcaaaagtgaggctctgatgccatctgctggtcgcacccgtgaatggcggctcctggccacattgctgggtgtggaaaggtgcccatcctggaaacagctacctcacagcctggctggagagagacactggccaacgttcggcccaagttctgcccagggctacctttcccagaaactcaggcttaaacactgcctgtcctggcctcagtctcttccctgggctggacccctgctgggcaccaggacccgaagggcagggggctaccctcagcaccgctgagtccacactcatccccccggggtctgctcaggcctggagagtcctggagacggaggacagtaaatatttgctgccgacaggggaaggcaaacactgccccaacggccaggcaaaggcgccagttatccatgccaggagcagacgcaatctagggggccagcctggaggcagccacaccgcagtgtgtcctgggtgggtgggagcacgtgccatgtgcctggctccaggcttcagtctctgcttaaggaatgtggtataagagtttcctccctgtgcagcatgtgtgaaggcaggacgcccagacagaaggctgtgtgcgggatggcatgcaggctgccctcggtcctccaggaatggacagaggcttctagaggggccagcaggtttggggagacttggggagcagctgccttgtgactggggagcagttagatggacccaatgccagggtgaccgccggggctggaggcagctgagtgcccctgccagcccggtgggcatgtgaaaccgaggctccaaggccaggcaggtctctggacactgaagggctgtcttttagcttcccagaaggggtggagcatgggcagcagcccagcaggcattgcagagccaagctctgtgggcctggctcacatggggtgacctgggggctccgggagcatgcacactccccgccagggcatctggggaccggcacccaaggtggtgcctgacaggagactgggtctgatgctgcctctgccacctggatcaccttggccaactgcttctcattgggcctggggggatggaggggcgatacctcgccctggctgcggtctcccgtgtccacgttttccaggacacagtatatgaggggtggggtcaaggcgctggcgaagacaggcttgggggacagagtcctgggtctcaacaaggtgaaagctagccccagctctggcccagggcagccgagggcaccgcgaaccatggctgcatctcttttgggtgggcggccttgccctctcctgaggcctcaggtcagaggtcccccaggacagaagtcacagaaaatttggcccctcaaaagacactcctcagcccccagcaccagccagtgccagctgccctgcaagtcctggaaggctggggcagctccaggagtccctggacaccaaagggctcctcctgctgccctccactccaacacacggtcccccacagagcactgaccctcccctcccagaaggggcctctgcccatcactccctacggccttgttggccatcagggtcagccagggcaacagcttggccgatggctgactggtgggcagcctcccagccggcccaccgggccccgctttggcccagccccgcgcgagctcacatacctcagctccagcagggcgcccctgtctctacccgtgcgagtggggccggctgggtgttcccatggacggctgctgccgatcccagccaccgcctccctcctcttccggggccagtgtccggccgtccacccgcctgcccagccttggcccccactctggaggcggggctagctgggggctgtgacatctctgggtggaggggggctgatgtggtcatggggaaggggtgagctcagagcttcaggaacagggctgccccagtggccaggtccccagctggagggtgagctcctggcctcgaggcccaagctggcagtggtctgcagccacagcccatgccagccccaggcccagccatccccagcccagccctgggtggagctctcaggaaaggtgcagattggtttggcctgggtggcaggcagactggcccagccacagggtagctagggtcacccgctgacctcccaggccacagtaggcccaggcagcccctaggttctcgtctgcccactaggctgggtgcccagcggagccaccctgtcctcaggggtgctgcagaagaggctctgtgtcaggacccccaaggacctggagccacaacgaccttgtcaccagggcccgtgggcccttctgggtgagcagcaggtctgtagcaaaggaagccagccaagcagccctgcttactgggagggggtgggctaaggggctgcagggggaccctggccctggtctctgcccctgtggccctggcggttccctgcttctcctgggctgcaatcctcagggcctcatggccggggtgcccaaggcatgggttctgaggccctgccaggtgctgccacggtccctgcacctgccccagctcatggtgccatctgacctctcctgcttcctccaaggcaccagtgggtccctcaggtgtctggctggacctgggctggcataagctgtggctgcagacggctgccagcttgggccgcgaggccagggtgtgtgactgtcccggggctgcccagagctggggatagcgggtggctctcggcagcctctccccaccttcccagccccccgccctgcaggaccccctccctcagcccagcctcctccctccacagggactccatcagaaataactctaaaaatagaacctgggagggctaggtggggggaaaattgctggaatgttctcattccctttcctgaacaaggtctctggggactccaagagtccagagctactgaacaagaagtcacttctcagtggccccaccacccctggcccctcagagacccccgcagctcccatactggaccctgagccacagggtgggggcagcaggcagccgacaggcatggccgctttggggagagccactgcatgctgggcctggccggcgttggcacctgtgggcacccagagagcgtggagagagctgggaggggctcacaacagtgccgggaagtggggcttggcccagggcccccaagacacacagacggcacagcagggctggttcaagggctttattccatctctctcggtgcaggaggcggcgggtgtggggctgcctgcgggctgcgtctagttgcagtagttctccagctggtagagggagcagatgctggtacagcattgttccacaatgccacgcttctgcagggacccctccagggccaagggctgcaggctgcctgcaccagggcccccgcccagctccacctgccccactgccaggacgtgccgcgcagagcaggttccggaacagcggcgaggcagagggacacaggaggacacagtcagggagacacagtgcccgcctgcccgccagccctaggtcgcactcccacccatctccagccgggctggacccaggttagagggagggtcacccacactgggtgtggacctacaggccccaacgcccacatgtcccacctccttcccccgccccggggcagcgtcacagtgggagcctgaacaggtgatcccagtacttctccccagggcctgtccccagcatcttccccatctcctgactatggagctgccgtgaggcctggcgacaggggtctggcccactcaggcaggcagccacgccctcctccgggcgtgatggggtgttcgcccagaggcaggcagcgtggggcaccctgtgaccccaggtcacccaggactttacttaacaaaacacttgaatctgcggtcatcaaatgagggtggagaaatgggctgcggggcatttgtttgaggggcgagtggagggaggagcgtgcccaccctctgatgtatctcggggctgccgaagccaacaccgtcctcaggctgagattctgactgggccacagggagctggtcacttttaggacgtgaccaagagaacttctttttaaaaaagtgcacctgaccccctgctgggtggcagcctcctgcccccttctgcccatgctgggtgggagcgccaggagcagggggtggctgggggcggccaggggcagcaatgggcagttggctcaccctgcaggtcctctgcctcccggcgggtcttgggtgtgtagaagaagcctcgttccccgcacactaggtagagagcttccaccaggtgtgagccgcacaggtgttggttcacaaaggctgcggctgggtcaggtccccagagggccagcagcgccagcaggggcaggaggcgcatccacagggccatggcagaaggacagtgatctgggagacaggcagggctgaggcaggctgaaggccaggtgccctgccttggggcccctgggctcacccccacatgcttcacgagcccagccacgtcctccctgctgcagagctggggcctggggtccagccaccctggaatcctgagcccacctgacgcaaaggcccttggaacagacctgcttgatggcctcttctgatgcagcctgtcctggagggctgagggctgctgggcccccgctggctttatagtctcagagcccatctcccctacctctcaacccctgccgcctggcccattagggcctggggtgggggggtcggcagatggctgggggctgaggctgcaatttccggaccatttccctggtgctgggtctgtgggaagatctccttggtcgtcagcacctcttcctcaggaccagcgggtcattagagtcttaaccaggggcccggtggccagacctgtccctgctcacagctgggggcaaatgtctccaggagagcaaagccctcacctgggccactttccacattagaccaggagagctggaggctgcagggcggggctctttgcgctgctgtccccagacccctgtccccacacccctgtccccacacccctgtccccacacccctatccccacacccctgtccccaggacccctgtccccacacccctgtccccagacccctgtccccacacccctgtccccacacccctgtccccacacccctgtcccccggacccctgtccccagacccctgtccccacacccctgtccccacacccctgtccccacacccctgtccccacacccctgtcctcagacccctgtccccagacccctgtccccaggacccctgtccccacacccctgtccccacacccctgtccccacacccctgtccccaggacccctgtccccagacccctgtccccaggacccctgtccccacacccctgtccccaggacccctgtccccagtcccggatggcccaagatgccgccatggatgggccaaggtggtgggggtgggagagtgggagtgagggaggggtcccctccctgctggctgcctagttcccaccctgccttaggacagcagccccagctgaggccctcagctccccagggtggcagaaggagggcatgacctggggacctggggacaagcagcaagtcctcagcaggccactcggacctcatcttccgtgtgatctgggggtggcggcaggactctgggggtgggcaggtgtgggaagctgtgcactggcccagctccgtcctggccccccaggcaccctctcagcccccactcctcttctgggagcccatctcccctctcctggccaggtcccatgacaccatcacccccatagtgtcatctgggctgagcccctggggtacacccctccggccctcccagctccccagaacaggcacctggaggtccagcctgacccatggtgagggggcatgggctccgagccctgctgcctgcagcccctacctgcctcttagcaccaggggcaggatcaggaggtcccagaagcaggaggatgagaccatgggggcaggcaggttggagtatcctgtgccccggcccctcgcatccctatgtcccaccctggcctcagcctcggaacctctcggggccgctctgcacacacccagcctttggctctcctgccccgagcgggtttggtagtgggcaccagctatctgcaggacccctcccttccgccctttccaccctgagccatgccacagcaggacatgcggtggctgccccaggacgccacagtgctctgaggcccggcagctggagaggacatgggtgcctccttgagaggagtgtgtagggagggaggctggatggggggagcccaggtaggagggcagagccaggcgctggcagggccggggggaggcaaggcaggcacttccccagggcttcctgggggctcacagcccttcagagacacccccagctgcaacctcaggggctgggcactaacaaggtgtgtgaggaacagactgccaggctgggaaggaccaccatgcccaggagggccttcgtggatgagtaggagtttgccagtgttgtcggccggggagctgagatccaggatcccagcagcgtgtagtggggtggctggagggaggcagagaccttgaaggccagctggtgtcccagcaccccctgcaggatgccctggggctgctctctccaaggtaggaaggggacaccctggccggtcaagcctggagggtgttgggtgctctctctggagggcaatgtccaggcccctcgagtaagccaggggcatcttacagagtctgaaatccagcccccatcctgcctcgctggggagacaggcccagaccatctgcctgggcaccagctcagccagaccctccccatcagcacacatgctgggggccacactgaggttccccttggttcgcagggcctgctccgggtgggtgagggcatcagggcagctgttcctccatccctgtttctctcaagggctgggagccctgtcagcagggagggttaggcctgcaggcccacctctgagaccacccccagccagcacagtttgtgacccctgctccctgccaggcctgagagaggccctcccactgtcacgtggctccccaccttgggagggcaccccacggagatggggcagctcggccagggtgcccgagcctctggagctgcttggggctcagagctgggcggggcctcagggtgagcggggaaaccaggcccggaggggccagctgcctggccagggcggccagccatctcccagaggaggaaggaggccagggcgaaacctctgagtgaggctggggtgggggtgtgggagtctgaggatcccagggtctgtctctgtggcacagatgtggggccaggcaggtgtagagaccacagtttcttttattgtgacggtgattggggcagcagacagtgtcagggaagggcggagggcagtgcagcagcccccaggaccctgggagccaggacaggacctcaccacaggcagcacaacctcaccacgggcacacacagctgttgcgctgagaagcaggtgcaggggcagtgggagcctggcagcagggagggcatggggggcacccgggacccagcccctcaccagggcctgagctccgggacagtgcaggaccaggggaggttgggaagggccctcagggacgccgtgcacctagccaatggcactcagcgcatgggcaagggtgtccagctcatcctggacaccctccagggagcgccgcacggcctgggggctgtccagcacgtcgatggccagcgtgtacgggtcgaacttcacggagaaggggcgctggatgcgtgaggcatagctcctggggaggagagcggcagagccctcgtcaactggcgggcagagtctgcagcctccaggagaggggaggccaggggccgcgtttccaccttcacagtggctcagagctcccagggcttttctgagccaactggtcacaggcgggacactgaggcctcttccagggctgggtgagggggttcatgggggagataggctaggcgccttttccactagagactgccgggcaccccatccctccctgaacctccactgggcctcctccaggaagctttccttgaccatatccctaagcctgtgggtggaattcagcacccctgtccgctggacacatagcccctggcctcagtttccccagtgcataagaggctggagggaaaatgatgagaccttttatgaggatgaggctagagggctttgctcccctctcctgacactctggtcactgcaccaaaggcccccagccctggggaccccactcccgccctgtcccccaccttgactctgtctatccccctgacttctccccatcccagggcagggggccgggacaggttccacaggacgtcctcacaaagctcaggctctgtcagcacctccaagactggccttgacccggccacccagcagcccccagtcctgtaggtctgcccctccccagacgctggggtccttctcacggatggtgtccctgctgtgtgggggctgctgcaaccaggggtcggttttctcatctgtgacctgggctcacaggtccagccctgctcaaggccagaaggaaggcctggctggcccagtttgggggcaccatggggggcttgccctagcagcctagcccacctgagcttgtccttggcgtcactgaagctctcagacacgaagtagactgactggtacgtctggtcttggtagggctgcacggccgcagcctcagggtcgaaggcccgaatctcaggctcctcagacaggcagtgctggcaggaggccaatggcatcactgactccactgcacccaggtccccgagggaactggggcaccgtggcctgacgctgggtgggttccttgggtagagtcacccccatctcccccgccgggccttcggaggcctgggataatgtggggtgaggactgggcagagacaagccttctcccaaacagagcctgagtcctggaggtccaggcctcagtttcctcccactgggagcctgtcccctccctgcaccgtcccccagccctgcccctctgctgggggctgcagcaaggagagactctcaccaggagctccccgtaggaggacagcagcccggcaccataggccttcacctccccgttctgcttacacagcccgaactccaccgtgaaccagtacagctgcggggaagccgggcagcatcagcccagagacagctgccgcccaccgggcagcccctggtcacccgtgaccaggataccacccccagggaggccaggccaggatgcaggcaggccagggtgagggtcacaattcgtgggtggaaggagaggcctcagcctggacggcaagagggtgaggcctggattcagacccccaaacccacaccccaggccctgcagggaggggtcaacccaccgtggacagcttctcaatttcctcatccgaggcccccagggacgccaggccaatgtcctgtggagcagggaggatgaaggatggggagaggcagccctgggtcatgctcgaggtgggggcaccgggggtgtcagcagcccctccaggggtctctgggacacttccctggcggcagagaccttccctggccgcccaggatccgcacctccaccgggcctcctcctccaggcagccctccttgaccacattcctaagcccgtgggcgccgttcccaggtagccggcaggtggcagcacaggccgtgggaggctccgctccagccccgccctatgccgcgcgaccctcggggcgccgagcctccttggcggggcccgggagcaggcagcacacttcacccacccgcacatcgatccccgcccgcccccggcgccaagccagcccctgggtgaccccggctccctccgaggccgcggcgtacctgcgagaactgcgcgaaggtgcggtcggccagcatgggcacgtgccccagcagctcgtggcagcagtccctgcgcgtaggagggagaagggggctgaggggccgcccgtcgcaccccccaccctcgggctggcggccagggcgcgcactcacggctcaggggagtgcatgggcgaggacgcgtggcggatatactgggtgcactggaacacgcggaaggccaggctggccaggaagtcccgggcggacagcaggccggccacaggccgcagctggaagcccgtgcgctctgcaaggggccacgcgggtcactgccgagccgggacgggctggagccgcgctggggtggggcgcttggctgaccatccccggccccccggctctgcgcccctcccgtctgggcacacccttcaggaagcgggagacgtcctccagctgggggatattgtcttcccggtagccgctgaagcgctccagcaaagcaaaggcctccaggtgctccccgcaggcgtgcgtggcgtagaggcccttcagcgtggtgtagacctccttcctgcgggcagccaggctcagggccctctaatgccccaccccagtgcccgaaacccccctcctgaactgtgggtgcctctgcctgcctgagcccctaccaacgcaggcctcttggggacccctgaagacccaggcccccgggaggggcttttgctggtggctttagggaatcccaggggatagggggccatgaggggcggtccctcagcacactggggatggcccgacaggatgggtagcctcttcctcccaacccaacattctgagccctgcaagtccctcttcttcccggccttagtctctcctgttgtgccaaggtccctggaggcggccctcacacgccaggattccaggaggcatcccccgggctcctccccagcccctagctgcacggaggtctcaccaggtggcaatctcctcggcggtgtactccacacggggaatcgggtcgccgctggggagggggccagtggtcagcaggtcccctcggggagtgagaagggcaggagggagggagggagcttcactgggcacaggtccacacccgcctagtgcagcgaggcctttgggttggaggatggacaggagggtgcaccccagctgactgtgccgtgagccggctatgtggcctcggcaggttgctctagcccccctgggcctcagtttccccactgggatttggggacatggaaagccctggagcagagctgcctggcaggaggcactgatgctggtgacaagatgggtcctcccctttgtccttccctcccaccccccaggtccagcgtcagcctgcaggacggagtctgggtcccgagcgcaggggcccctcactgcctgtactggaaggcgatctcagcaatcagcttcctgcgctggcggtacacctggtccgagaagccctgagggcagaggggatgcacgggtcaggaggctgtgctggggtgggggcacaggccacggaggctcctggagccgacagactcctgtccagggttgggctaagggtaggggatgtgatcaggggcaggaggcctgagtgaggggcgcaccactcaccgggtggtccaagtccaggtcagggtcgaacttggtgaccaggtgatgacacttgtccagctctgacacttttcttgggaaccaggggactttatgggtgatggaggaagagatcttggtgagctcggagccgtggggctgtgtcacccaccttgaagcagcctcccctacaagacttccggggggcagaggcagccggggctgtgagagctgcggggggatcctggagtggccccaggcccggacacggatgtgtagcaaaacggggtgcggagtggagcccgcagagagggaaccaggccaccaccacgtggtcactgtagggtccccctgcaggagcccctgcaccccagcctctcaaggtcatttggtggccctcaaggacagaaaaccgcctcacccttgggccccgcggggctgcgcacgtcctctgacacctggcgcacaccactgagcagggcggccaggtcccctcggcgcacctcgaggcgcacgaagtactccaggtgggggcccccagctcgcggcctctgggcgggccgggtctctagatggtggattttggcttcaaacgtcttagggagcaaaagcaggaagagagagagaaggagaaagagacagagatggagagagagggtggggtgggcggggaggaggcacatctggctggctggccaggccctgcccttgacttttgtgctagcagcacacagatcccgttcttccaggctcaggtcagctgtcggccaccaggccagggtttgccactggcaagttggattttgtgttacgtgcctaaccaggagttgtcaccgcttgaggcttaacctggttctgggcggctcggtgtgtgtgtcccaaggccatgccacacagtccggctcctcagccactggtcagaaggtgcccccaaccctggtggcctcatccaggtttgtaggatgggccctgagtctcactggcccctgagcgtccaggacactggccagaagggtccgctccacccccacctcctgttgcctagcaacaagggcggtgggtcgcagtggccctcgggccacaaaactggctctgggagctggggggcggggagtctggctttaatgtcatttgggagcttcttccgggagctgggtcacctgcctcccggggcacagtggggccggagtgactaatgcaatcagtggtcacctgagccactgtgctgggtgggtgggagagggcacactgccctgcccctgcctcttgtgctgccctgctgggagccccccacgtgggaaatggtgggtgagggggatccaggggatgggcaaggcaagaggcacagtggggcttggtagcctcagccctaggggtgggctcaggatccctcaaaaacacgggggtgtggctagatgccatgggggctgagctgaggcctgagactcccctgctgcatcctgtgccggcctcgggggcctgggcagctgcacctctgctatagaggggtcaggaactcagcccacacagccccacccacaggtgaacttgccccagggacacgaaggccaccagctcacctcaaacaccttcacagctcgggacagcgccgagggcttggtggccctcggggagaagagcaggtttagcacggccttcccctccttctcctcaaaggccacagcctccagggggtccccgggctccgaggggactgcagcggccgctgctgccaccgccgcctcccgctccttgcgggcgtcctcgatgaggctctgcctgcgcccaatgaaccgcggggactgtggggacaaggggcacccatgcctcctccacctgctgagacccggggacctccacccacagctggtcccacagtcgggcagcgctgatggcacacagaggcaggggatgagagcacgtttttgagcgcctactgtgtgcctgctggggcagatgctagccgaggtgcctgcgggcattgcacgcccttcccgatgggggcagcccagtcagaagcagtggtggtgggggaggagtgggggctgggaaggtgctcgcctgctccccactctgtggcgagcagacagacagagacgctgtgtcactcatccccaggccaggcgctaactggattagtgatgggaagagggcgatgtcttgatggacagtggcatcggctgccggggagggaacggcagctcaggaaggagctgcccccacagggccccagtgaacaacccccctaccctcctggctgccgcacaggggaccctttctcacactcccatcaggacacctgtcctcgggccctgcccctctgtgccaccccgcaggcgcccgctcctggctgccttgtcatccctccaccctttgtcatagctctgggcgcaggtgtctctccctgggctcagcgcctctgacccctcgatcccagagccgtcccaggcctggacagagggggacttggcagacacctggggctcatcccttggagctgaactcccaagaaggctctgggccccttgtaagagaagaatcagcttcatcctgagcttccagggttgtggaacatgaaggggagcagcagaagcccctcccagagtcccctcttacttacccttggggtgggggtgtaggatgcagctggggctgcagttccaggccacggagagcctgtgaggctgggccccggggcgccctggggaggggatgcctgatggggagcctggtgggggagggtaggggagggcgggggaggacgggggagggcgccctgtgtccctgagaaggtacctggaaatgacactgctacaactcacaccacatttcaatcaaggtccataaataaaaacccattttaaatgtgccagggagcccaaggttctgagtgcccaaggaggcaccgaagacccctcctgtgggctgaaaagctcccgattatccagcctggcccacacagtcccctgtacacagggcttccgagtgcaggtcacagggaacacagactccatggtgaatgaatgaatgaatgaatgaatgaatgagggaaataagggaggaacaggccaatgggaatcaccccagagcccagataccctttgaattttgccccctatttgcccaggaccccccaccatgagctgctgctagagcctgggaagggccttggggctgcctccccaagcaggcaggctggttggggtgctgactagggcagctggggcagagggaggcaggggcaggtgggagtagggtgggggctgggtgcagcagccggggacctctggccatcttggattttttggatggatttgtttccacattccgatcgttaagattcaagatgaaacaagacacagagacccacacgacccccgagagaggtcggcctaagaggggcacacacagggacaggcatcacctcaccctcccccaacagggactcaaacaccaggcacaggggatgccgctgtgcccaggcctccacatccacgccgcgtcccaggggtttgcatggaccctgagcctggggctgccagccaggctggggagtagcagaggcagctggcaccagccctgggctccggtccactgcggccgccgggcacctacctgccctcttaccatgatggcctctgcctgcttggcgtccagctcagacacggccctgcggaagcccttggcctgtggcgtggtggcgtcgggggtgggcatggctcagtgtggaggtccgggctccgtctccacagccctggcccagcagcctcttataagctgagctgacgtcaaagccccctctgggtcccccaccttcccctccttacatcccccacccctgcctgctgtgcctgatggaggcgggggtgggtgaggaaggagggaggcgcaggagaaagggctcgtccgtggaatctaattgccttcactccccagccctgtctgaatcatcctcagcccgcgggcttgcggggaccaggggctcgtgctctgcggggggctgagacagccagggtccccttggccccacagccctcaagagagcacacagggaggggctttctggcagcccaggggcacacttttaatgaacaccagaacctcgtggcagaccgacccagaaagccccaagacggggaatccagcctccagcctcagatgtcaggaggcaatttgtttgcttctccagaagattccaggccgtgtgtctcatagacgtggttcctaggagtgccatctgcccacagcccccgggccctgcaggtgtggcccttgcagcggcttcccaagctcgccccgtggggtccagaatgtcccaggagggcccacctgtccagtgtggaggaccctgggaggctgaagaagacatctctaaggagacgccacgcgtttccaaatggctgccacctcctgcatcacagtccccaccagggttgccagggcgaccagggccagggacggcttccacccaccccactcagcccctctatggcccactgctagctcctggcttccctcggggtcctgtggccccttctttaaagagcacgcacgtccctcagtgctgagggccctgatgccttccccttggagagacctttgcagtttctcctctaccccaccaggccccgggttgagggtgaccctggggtgacctgagaactcccttgaggacaaccccagcctagagcctcccccaagttccatgtccgccccgcaggcacccgcatccagcccacgcccactggcacctcctgctcccagccgctgccccacccagggagagtgatgcccctgcccagggtggcttctggcccttctggtggaaggggaggcctccccatccctctggggtcagcagagatggccagagcctgccttgacaatgctggactgtacagagggaaggacgtggccccagagtgcatggcctgcggctgaacgctgccaccgctgtccctcctggagaagaaccgtttccgacagggcttggggcttcctgtatctgctgggctttctggtgttggcagcccaagatgacaccctgggcccagcaggagccagaagccctagacgctccctgacttctcgaaggcctaccccggctggtcactgtggcagccagagctggcatctctcagggcccactctgctcctgtcagctgtgggactccccgctccccgttctctcttcaacaatagcccctgggacctttcctaaaactgcttcagccatggcatccctgtcccacacccctccgtggctcctcgctgccctctgcaggcaggctgagtgctcagtcaaagcaaagggaagaccccccaacccttcccacttcctggcccagaaggatttggggctccgtgatccccggtttgcagtgtcattcctcacccacctcttatccgggtgaactcctatgcatcccacaaaacccagttccgtcgctgctcactctgcaatgcctgccctttcttgccacgatattaatgcccctcccttgcgctcctctggaacatccctgggggcagggaagcctaccgctcggcccctgctgtctctcagcacccagtgcagaccctgtcctctctcggagatgctatgcccctccacagtgttccccaaaggcctccacctcctgtgggtcctgcccacagtaggtctgggtgcctgctcagaagggcgttggagggatttgcctccaagacctcagcctgaaggctcagcctctggcctcgccctgcggcccgtgagcttctgtcacccagggctgaggcccacccacctgagtccctggtgatggcccttgggtggcccagcctccatgcccagtgtccaggcctggtgaagctctgcatggctcccccgagctcccctcaaggtccccagaaagagtctcatttgcctcccccagggtcggctgctgaggatccctcggtgaggcagctccaggccccccagcaccccgccccagctctgcccagggcggccccagtgctcaggtgcccaggccaggaggagagacatgcctgatgaacaccacgccggaggctcatggcccacactgccggatgtggatttaacctttcagcaaatgtcttccactgatacaaatattgctttttaattcggtttcctgccgggccagttgtgctttcatggaagcccgatgggaactaagcttactagactcttccttggggccaggctctctggaggcaggagcccaggccaggtgctgaggctggggaggcccctggacccctgtggaggtgagtgctgccctcaggtgcctgcacctgccctgcctccagcctcccgccccaatcaggcagcatccatccctgcctatccattcctgggaagcctgtcccacacgccagccccttcagggccggggaaccatgctgtaccccagatccaaggcccctgttggcacagaggtgcccccgactccagtcctggccctggccccgccctcctttgtgccgtgcccctctccgattccagatggtgagggtatccatggaggccccaaaagtctaccctggccagcctccccgctcccagcccgagggtacctctccagtctggaccacccatgattgagccatgccccgtgtcacccacctgcctctggccctctccagagatgtccacaaacaccaggaaggctccactccagcgcccacgggacgaggcctctccacgctgggcacaggcctggagggagcacacggctggcccctggtcttggtagagctcagtgctgggtcagcctgcggcatccacgttcgggcagctgaggtgttcacagacccattctgcagatgcgaggactgaggttctgaggtgcaacttctcaggggtcatgcagtgagtctccagcccaggtttcccaactcccaagacactggtctttcctttttttctttttttttgagaccgagtctcgctctgtcacccaggctggagtgcaatggcgcgatctcggctcactgcaagctccgcctccccggttcacgccattctcctgcctcagcctcccaagtagctgggactacaggcgcccaccaccacgcccagctaactttttgtatttttagtggagacggggtttcactgtgttagccaggatggtctcgatctcctgacttcgtgatccgcccacctcggcctcccaaagtgctgggattacaggcgtgagccactgcgcccggcctgacactggtctttcaaagatccggtggcatccatcccctggcactgtggggctcaggaacctaggccacagggaacaaatcagacaggctgctgtgaccagcgtcccatctacagagaccccagagggaagggcagagctgggacagggttctctggaggccgaggtcacgccccaagagacccctggggccagcatactggcccctgggaaggagaagggctggagcggagccccaccagggggggctatgaggtggggccaggagtgagggccgacccaggccagatcagagacaaaacaggtgaccaggggagtgggggccccgcagaggtctgaggagcccttgctgtcccctccattgcaccaggctccaccttcctgcacggagccctctgggcttccctccataccccaccaccctccaccacttccgccgtccctgtggttacagcccctgccaccatggccgtaaggaatgctgagccagctccacaatggagcgtgttctctctcaacagcctctcagcccgaggcttaatcacccagattaatcacccagcacgtctgtgccctgggactggtgcccactccccgcgtggggcagggtcagagtgctgacttcgacctggctgtgaggctgctccgcccacagggcgagtctctgaggccaccaggcctgctccccagcaccagccttgcccaccacgggcccttcccaaatccaggcctgctggaggagcccagccatgtgctggggaggagcccaggaggtgttctgggtcccctggctgacaggcatcgccctgtggctctgcagggtctagccatggcctggctgtggtgtgcacagggctcaggtggccctgtgatctttgagagccagcatggtgtcctcttgcaagtgcctaggcaaatgcaggcatctgtgtgaggcacacacacatgcacacatggggcacacaagcacacacacaacactccatgcacgtgtgagcacccatgacacaggtacacaccacaggtacaagcagcatccacacactgcacatgcaagcacactcacacatgacgtgtacatagcacacatacaggcacactcagacataacacatgtgtgcaccacacacatgcacacacagatgcatatgacacatgcatgcatatatgtacaagcacacttacatggcacctgtacacaccacacatacaagtgtactcatgtacacgatacacatacgatgcactcgtaatgacccacggacacaccagatgcacacacggatgtgcatgcactacacaggcaaacacactcatatatgacacagtacacacaacatatacaagtgtgctcatacatgacacaggcacacaccacacacgagcacacactacacatgtgcgtgcatgcatgacacgtgtacacatcacatgcacacacacaggcgatacaggtgcacacgtgtacatgcacacacacacacacatgctggagcacacactgcccccccgcccatgtctactccgcagttctctttatagcccggggtccccagggtccccagagatgccccctctagagcctggctcccagggacaccggcctgcagcctcccagacccccactcacatttgggagacagtgggggacctcctgaggatttggggtgtcatgccaccctgggctgtccctcagttcccattgtcccaagaaggcaggggacagtgagtcctgcgtcctcccctcacgccatcttgccccgcctggggtgcagggcctttctctgccgtgtaaggaagcagctcccctccatcccccaagctggaagaaccaagacgccccaacacaggacagaatccgccgtccctgtcagacccaaatgccagagcaattagccctaatgaggccatcagatggagccccacagcagggcgggcggagcgcatggacgaggtgggccccggaacagccgccctgccagtcgatcggatgcacttagggataattgggtgtttggaagtcaggcccagagcgaggccggcagagcaggcaccacgcctccttcgggctctgagcctgtgggctgcctctcctcctccacaccctggacaggcagccggaccctccctgtcccccacagacggctccctgccccccttctgctactgctgctgcccacctggggctccactttcccttccccaccaaatcctgccaggccctcaggcccgggctgccctcctcctccaggcagtcccccagtggcctcctctctgagtccctccagcctggacagccagtgctgtccttccatccttgttgcctgtagggactgcctcagtgttgagacccaccatgtagggggccgaaaagagggtcctgactcagccccttgggccctggactcagttttgccatccacacagtggggggcatcagggattagcagttgcaggcccttgtgggaggaggggtcagccttgagccccttgtgtgtgtgggacccccaaaggcccacagacacagaccagcgaaaactccaggccaagctctggtgcgtgggttcccaagcctggctgcacacacaaccagggtgctctcggcaattccagcatctccatacccctggagcctcttgtcctggtgtgggcttcctggtgatgtgggccagccaggtatgggtggaaccgtcctactccccctccagccctaagcctgagccagcctgagtctggcatggagctcctggagccaggtgagcagtgaggggtgcttccagggaaggggatccagtggccagagggtcctgtgggaccgagtcgggcagaggtggaggcagagggagggaaagggtacgaagggggcaggttacagagccaagcaagagaagtcaccgtggtccctggcagccaggcattcagctggaaggaagggcatccgggtgggcggggtgcgcatctcctacccacagggcatctccccagctcccagcgcccctcactgctcacctggctccaggagctccatgccagactcaggctggctcaggcttggggctggagggggagtaggacggttccacccatacctggctggcccacatcaccaggaagcccacaccaggacaagaggctccaggggtatggagatgctggaattgccgagagcaccctggttgtgtgtgcagccaggcttgggaacccacgcaccagagcttggcctggagttttcgctggtctgtgtctgtgtgggagacagagtgtgcattcaagggtgtgtgtgtgtgcgcgtgtgtgtgtgtgccaggaagcatgtgtgggagtgcttctctgcgtgtacatgtgttgtacatgcttctaaaattattcatgtgagtgtatgattttatgtccacatgcatgcatgcgtgtgtttgtgtaagtgtgtgtgtgtgtcctatgtatgcatgtgcatgtgtgtgtacagtaggggcttagaagagctgaccagccattgatatggaacaaacagggtgaccccagctcctgtgtccctccggactctcacacgacatcatggccaaggtccccaccggccctgagttcctgccaggtgctcctggtttcttgcagacccctccgggcacccagcctcgcccccatgccggtgactcaatcagacctccggtccccaccctctgccccctccccctggctcttgacagcctctgacaaattagtcgagtgaaaagcaataagagcggcattcagttctcattagtcactcaccgaggcggcagctgtgctttgacagcaaatcacatctcattgcaaggccacagcccgccctggccccccagcagtgccagtgccacgggcttgggtgctagtcacctggcctgtggcagggagaagatgtggtcccaccgctgctctgagctgaggcaggtccacacccagggctcatgtgcttcattccatctgtgctgtgactccccttcccagccacacgtgtagacttggaggccccacctggggagaggagccccgcctgtggcctgcacggccctgggctgcgttcacaggggacctgggcaggcagctgcatgcatggaggatggtgggaggcactggggcatttgcccacaagatgcagactctgggaggggaggaggtgacctcaatgccacctctcccaagggcgatcagaggaaggaggcccagcttggacatacagggcctgaggagaggggccttggaggcagccacatacagacatggaggagaggccgcacactgggtcagagccggggaaacagaacaggggtgcggaggaccccttgcatcacctaggacccgtctggccagccactgtaggctcctctgcttggccccacggcctcgccagggccttctgtggccccgcccctcttggccggctgtccacacaccctccaccctgggggcagctgggctcagatttgggagcatcctggaacagaggggaccccctgtgtgtctcctgtccctgaatcctgtccttcccttctgcacctgcctgactttgggggcctgcaagagcaagagcccctcgcccatggagttcacctcctgccaccctgtgctcctgagggcgggaagggaggagcagcccaggcctctagttcttgtttcagatgagggttggacgtggctgctgaggtccccagttggccccacgctgacactttacggacaacacggcagagacccccaccgcctgagagaatgcaaaggtcccactgcggtgagatgagtctccagggggcttggtaacgcttccatgggcaactcgatcgtaaacatccttattttccctccacccgtgctcaggagaaacgtgttgctcccttgggctctggaagccctgagccgatgggcagacctggagggaagcccgcaggtggcctgctcaggcagtggctgctgtgaccgccttgtccaggggctggtccagatgccctaggttccccgaaccaacatcaccacccccccatggccgggtggccccctctctcgaggactcactgggcctgcaggggggcagctttctctgcccccacccgtgggctgctggtttgggcctggaagtgcgtccgccccactccggccaagctcagtctccccactctcctcagcctgctaccccatgggaaccagcccgggctggggctgaaagaagagcccctggccccagtgagaccctctgagcccctccccaggtgccccgggctggcccagcccaggtcctgagcaggagcaggaaggaggaggtgggcgcattcacttcaggtacctctgctaatcccggggctcggaggagcccccacccccggctgacatttccaggccgctgcgtgccgctgccccagccgccgtgatatttagacagggcttgtttgccatgtgattactttggggcctgggatgaactctaccaacacctgagcttgtccgctttgctccaaagcttgtttttaatacactcgctgtcagctaagccggctccctccagctgtggggtccggtcccctcctgggccagagggaggactaagcccaggttttcctcaggaagacagatgcctcctcactttccacactgagggcaggtcccaggaggctggaaggctccatcgtccccacccagcccccaggtgaatgaactcactcattcactgattcacgcagcaagcatttcctgggtgccctttgggaaacagcacggaaagggaaacagcacggtcccaattttggaggctctcatagtctgggggaagggaggcccacggtcctcacatccagtacagccgagaccctgccaggggcggccagggaggtgtctggaacagccccctccaagtgggaagcacatggcccctgtccccaccccagcatggccttgggggtgggggacctgccatgcttcagggagggtgaggccagtggccagcacagcacagttcggggcacacaatggggaggtggaagggctgtggtgtggccacactcccctcaccccacagtctccaaaagaggatttaacttctattttttaaatgtttattttgagagacagggtctttgtcacccaggctgaagtgcagtggcttgatcatggctcactgaagccttgacctcccgggctcaagccatcctcccatttcagcctcccaagtagctggagctgcaggggcacaccagcacgcctggctatttttaaaaatttttttgtagagagggggtctcactgtgttgcccaggctggtctcaatctcctggcctcaagtaatcctcccaccttagcctccccaaattctgggattacaggctcggctaccacacccggccaggattccaaatccttgcaagttccccagattctgggcctggggagcctcccgggatcttctgggcctctgttctgtctgccaaggctgctttctaggggaggaaaagtaaccagaaaccaggaggcctgagctcctggccagcaggtctcaggaaaactagggcctgagaagcatcaagagccctgtcacagagctggtggggccacaacccaggccactcccatccccaggagccaggagaaactgggcgggcccttgggatgaagaactgtcaccaaggctgctgggccccccaccctgtgcaatcagattggggagcgagggcgtcccggagatggagcaggtggggcagggtgtggaccctgtgtccctggggccctgggggccacaggtgtagggagacaccttggtctctgcacagcagccatagtggcttctggctccttccctgcactgtcagcctcagcctcagccagtccgggtcagtccgggccaggcgggcagccaacccaagaaagcccctactcgtgcagccgaggacacagagggggcaaaaactgcatccagggaagaaagggctgtgggcaggtgccacaggccagggctgagagggcgggcaccctctgtggagccgaccttggagcaaggctgcccgggcaggagtctcccagcgcagggcacggcccatgcagaagcttccgaccggagagctggtggcacgcccaggaccctccctcccgccagggcctcggtccagacccacccgtcctcatcttaggcagggcttattggccgtgcgattactttggggcctgggatgaactcagctggacgcctcagcttgccgcctgtttttaataaagggtcccccaaacaggggaccttccttctgccccgcccccgccccacaggtccccagcagcggcacctttctgcgtgtgtgtgaccgattcgttcacgtcgactcctcccctggacagaggcttctggaaaactaaagttggccccttggttccccccttgccaggcagggctggccctcagagcctggtggatgaacagaccaggagggaagtttgggaacacccggctcagagatgagaagagagggtggatcagccgccacatggcaaagccatgggccagctctccctgccacggccagtggacccgggacttgggttctccagcatgggcccaggcggctcggagcaggggctgcttccctccggccctttccccgaagcccgctcccttctccacccccgtccctgcccactccccgcaggccggggtgcacttggagccccgaggacctccgaggctgtcgccaccctcctctgttctgactgctttctattactgggcttgtaaaatgattattgttttgctgtggtaagatgtacataatataagatttacctgttttttttgtttgtttgtttgttttcgtttttgattttttttttttgaggcagggtttcagtctgtcccccaggctgcagtgcagtggcacaattttggcttactgcagcctcgaacacctgggttcaagcaatccccccacctcagccccccaagtagctgggactataagcaggtgccaccacatccggcttttttgtagagatgaggtttctctgtgttgcccatgctggtcttgaaccctggcactcaagtgaccctcacacctcccagcacctcagcctcctagagtgctaggcttgcaggcgtgagccactgcgcctggctaaattttaccattttaaccactgttcattgtccagttcagtggcattaagtacattcacatggttgcaaaaccgtcaccactgccatctccaggactcttttcatcttctaaaactgaaactctgttccccattaaacactcgttcttcagctcctggtaccgacaatggctctctgtctctacgcctgtgactgccttagggactgtgtctaagtgggatgctgcagtacctgtgcttctgaggcttatttcactcagcacgatgccctcggggtcatccctatgcagcagtgtcagaattttcttcctctctaggatgggccatcttttgtccattcattcacctgtcaacacacacttgggttgcttccgctttttggctcttgtgagttctgaacctatgaacgtgagcatacaagcatctccttgagactccccctctttttttttttttttttttttttttttttttgagatgaagtctcgctctgtccaggctggagtgcagtggcgtgatctcgactcactgcaacctctgtctcccgggttcaaacgattctcctgcctcagcctcccgagtagctggaattacaggcatgcgccaccatgcctggctaatttttatatttttagtagagacagggtttcaccatattggccaggctggtctggaactcctgacctcatgattcacctgcctcggcatcccaaagtgctgggattacaggagtgagccaccgcgcccagctgagacccccctttctgtatacacatacacacacacatacgttttttaagagatggggcctcactctgtcacccaggagtgcagtggcaccatcatagctcactgcagcttcaaactcctgggctcaagcaatcctcccacctcagcctcccaaggagctgggaatgcaggtgcgcaccaccacgcccagctaatgttttaatttcttgtagagataggggatctccatatgttgcccaggctggtgttggactcctggcctgggtgatcctcctgccttggcctcctaaagtgttggaattataggcatgagtcactgcacccagccttctttcaattcttttggggctagacctagaggtggcattgttgggccatgttggaccattacacactccccccaacagagcacaagacttccaatttctctacatctatattatttttaattttagttacatgagcaacagattctcctttgaacacacacatacacacgtgcacaaacacaaatataaaaaggtgcgtgtgctcctggccccccagcctggatactggagggtgagcccctttggggaggagggaaatcatgagcttatgagctctgggagcccacattcatgttcttaggaatgccccagcacctctcccgtcacactccgccagcgcgacccaacagcgtctgtcttccaggtcatcatccacgcccgacattacaaagcttgaatgacacttcagcggcatctcaggtccgcttgcttcccgagcatctctacttctccctctctcgaacgatcccttcacttcctcccctcatcttccctttggagcttacacttttcctgatgagatgtgggaattctttacgcattcccgacatgaatccttttcggcaggaagtatcatctcccagagcctggtccaccctttaccgtgtttatggagactgtggtcatcaagaaggcttggcaatgatgtggcttcggggagccacgcttgtcaaccgtctcctttgtggtttctgccatccggatcttgtccaacaacctaccccaaaaacagcaatgttcccccaaagaagggaagcaccagcacctttctcgtgcacactggggtaggggactgtgttcccagaaaagcacatgtaatgtcatagcgcagttttgcatttagaagcaatagcaaccgatggtctattgtttctcttttacaaaccacagatggtgggctgggcagaatcttctgaattggggtgaatgtatctgtgagtgcctgtgcaggggaggcagcatggagggcatggcctccaggcaatgctgatgctgaggttttgatgtttatcaaagggatcaagggttaggaaggcagagagagctgtcagctccacaagcactgagatgccgcagggagccctgcggagggagcaggcaggccatgcaccccaccttccttggggagggcctgggcgccagggctgggcgacatgaggaggctgactctgtccaggccacctcgggatccccgccccctgcgccagcgcgcctctggagtggcttcccattcggaccagaatggggaccctcaggcttgcatcctctgagggttcgtctacgggcacagggggcctgggctggccctggactcgaggccgatgtcattaccgctgccctgacagtgtcagagcctgcgcctggctcgcgctccagagaaggagctgcaaaactcagcctagattggcagtctcccaaggaagctgggcgagggcgttcagctggagctggggtgggggcatagggaaggcggtggtgccagagcgggtttggctgtttggaagggggtggggatggcaggatctccaaatgacctcctctggaaggagccctttccttctagattcagctcctggggtccccacccttatgatcctcagagtgctgtatgccccctccccactgtccgcctgggcagggagcagtcacggggtggagctggcgtccaacatcctggcccctcttcctggctcccacctggcacccaggtgtaaatggctgtggtttggggcgttccagtccctccccatctgacctctgcttgccaccttctccgatccaggctattgccccctcagccccagggcctctcaccttctccacatccccacggagagctgggagtccaaacaaatcccacggtccatgcagcctgccacagctccatgagacacccaggcttagtgaggacccctgaaatgtgtacacaggcctcacggttcttcccagccaccctcactctatctctttccagcaaacacctcccaatacaggtgcttcattgatttcatcaaacgcacgttgccttggccactctcttactcaagcactttcaatggctcccactgcctgaaaatgatggcatgacctcaggtcttgccaacgcagggcccctggtgggccggaccccccactctctagcacttcccctcctctgcgtccttctgctcacaacccccacgctccagtctcagagcccatgggaggggcctcctttgacattaggagtaaaatttccaggcatttttagacaacaacacgtttgaatattgactctgacctgccgtagatgccccggtaagcttattttataaaggaccccagcacaaaggccttctcagcctgatatccctgtgggcaccacaggatggcgcccagacgcaagcacttgggcagccttcacccagaggacgcacgtgtgctccctcggagcctccaggtgaagccactgcaacccccgctgaggagacaaaagatgagggcggcccacccaggcctccctggagaggctgctgaaaagggcggctgcattcgaagggcagcagaggcaggagcaggaggcacggccgggcgaagggggcccttcccaggatggcagcccgagaaggaagcggcgccaggcagccagggactgactgctctccatgacaagctgcgaacacaagatatctaagtgcgtgcacacacacagacacacacacacacaaacacaccacacaccacatacacaccacacaccacacaccacacacacacacagatgcacaccacaccatacacacaccacacgccacatacaacacacacaaaccacacacaccacatacacaccacacacatgcacaccacacacaccacaccacatcacatacaaacacaccacacacaaaccacacatatacacaccatacacacaaacaccacacgccacatacgcacacatacgcacatgcacaccacacacacaaacaccacatgccacatacacaccacacacacacaccacacaccacatacacacaagctacatgccacacacaccatacacacaccacacacaaacaccacacacacctacatacataccatgccccacatacacacaagctacacgccacacacaacacacacaaaccacacacaccgcacataccacacacgcctacatacataccacatagacacaaaccacatgccacatgcaacacacataaaccacacaccacacacacaccagacactacacacacaccacacatacacaccacacacaccacacaacacacacacctacatacacgccacacacatgccacacaaactacaccaatcatacacacacaccacacacaccacacaccacatacactacacacaatacacaccgcacacacaacacacttacctacatacacaccacacacatacacaccacacgctacacaccacacacacaaccacacacaccccacacactccacacataccacacacaccatataccacacacatcacaaacacacatcatacacacagcacactcaccccacacaactccacatgtcacacacatgaacacaccacatactacacatgccatacccacacacgtgtgctctatccacacagcctctgggcggggaggtaggaacctggcacagggctgtcccgtggccctgttgtgtgttcgtggaatgtgtatagatccctattcacaaatacgtagaggagagactggcaatccccctggcaaatgcagtcccgtgatctttggcacaggtgccaaggccattcagtggggaaaggacagcctcctccacagacggggctgggaaaccgggatgcccacatgcagaagtgtgacgctggaaccctcccttcccatccaaaaattacccccaaacaggtcaacggcctggacgtagggcctgagacggtagagagaacacacagggcaaaagcttcatggcctcacacctggcagtgatttcccagatgtgacaccaaaggtgcaagcaacaaagagataaattgggcttgaaaattaaaacaaacaaacaaacaaacaaacaactttgtgcatcagaggacatcatcaaccgtaaaaaggcaactcccagaacaggagaaaatgccgcaaatcacacacctgatcggggagtagtacccggaacccacagagaacccctaaaacacaaccgccaaacaccagattcaaaagtgggcgaaggacgtagacgggcgcctctccagggaaggtgtatccaggacagcagccgcagggaaaggtgctcaatgccacgaatcattagggcaatgccaatcaaaatcacggcgcgacaggattccacacccgttagggtggccaccgtcaacaaacccaaacaatgcagaacacaaaatagcaagtgctcacgagaatgtggagaaatcagagcccctgcggtgggtcgtgccgcagggcagccgctgcggacagcaccctggcagctcccccgcgggttaaagaggcactacaggctgccgcaatcctgttcctacgtggatgcccagaagaaatgaaacctatgtccacccaggaacgtgtgtgtgactgctcacaacagtgttattcactattgctggaaagtggaaccaacccagtgtccgccggctaagagcaaaatgtggtccacgcatacaacggggcacgattcagattcagcctcaaaaaggaaggacattctttttttttttttttttttttgaggcggagtctcgctctgtcacccaggctggagtgcagtggggcgatctcggctcactgcaagctccgcctcccgtgttcacgccattctcctgccgcagcctcccgagtagctgggactacaggtacccaccaccaggcccggctaattttttgtatttttagtagagacggggttttaccgtgttagccaggatggtctcgatctcctgaccttgtgatccacccgcctcggccgcccaaagtgctgggattacaggcatgagccacggcgcccggcccaggaaggacattcttacatccgctacaccgtggatgaacctcgagaaccttacaatcagggagaggagccagtcacaacaggacaaatgctgcccgagtccactcccacgtggtccctaaagacgtcaaatctgtcaggatggagaggagaatggggctgcggggggctggcggaggggatggggcgtgagtgtttcaggggacagagttcggtttgggaagatgacagagttctggagatgacggtggtgatggctgcccggcaacgtgaatgtgcttaatgctgccgaaccgtgcactggaagtggttcagatgagaagttttgtgttatgtgtatttgaccacaaaaaactggaaaaagtataacacaaataaagggagaaaagcatgttgacaaagagaccccagagcgaactcttctgctggatggcgggctgcctcacgtgtttttctttgccaggcctggagtttccaccgcagtcagcgtgcacagaggcctgggctggaggcagagaccggccgggtcagtggcaaggctgtctctcagcaaccctggggcagagcaagcagctcctcccgggaggccaggggggcactggacacaggcccactcaggggccgggcagctggtgggcacaccccccgggtgctgggagtgcacagccactgaggcagcacctcagggagccctggggcgtgtcccctctgggtctacacagcactaaggccgcccctggggcataaggtcggcagcctgcctgccacggcactgcgctgcctgtgccctcctcatgggcagagtgggcatccagagcctggcaggaccccctctggcttgttgtccacaagtccccagttacacagcccaggccggcttccgaggggcacggtgacagagcctctccccgccctctgcaggaagccgggaaagaagggtggacccttcccgttccaggctgctcccgccccacagggatggccgtgttggcggtgaagcctgaggctcagggtccaggcagaaagcgctggttcctccagactgccaagcgcggttgctatttatttcttctccattaaaagcctcgggaccgtttattgatttcttgctaagatgtgttatcgtccatgatacagcaaagtgaacaaaactggagaaaacaggggcagaggcgaaggcgaacgcacacgtggccgccctgctaatggggctctgagcatcttgtttcgctgtcaccgcaggtggccttgctgccatcatcccgctgcgtgtcagaaaccttttccatggcgtctgtatcaatccgcttttaacaaggaggaaggaagggcccgagcccgtgccagctgcctgggggtgagggctgcctgcccctgggccttcggctgagtaggtttggaaagcactccctttgtctaattacgcctgatccggtatccagggaaacagctgcatcttaatcctcagggcaggacgttagtttgtcttttatctgtccacaatcggcaccggggccacgtggagccaaattgtgttgacttcttgcacgcacgcggaggctaattgcagggacacggaaagccagagacccctgagagtggagcagcctcccagtgtgcagggggcagagccgggggctgcccatgctgagcaagcccagggcacctgcctggcgggaaggtcggggtggaggaagcggatgcaggtggctgagattgcagagggagaaagcaaaggaggaaggagagagagggaaggaggaggatgagggaggggaaggaggaggccctgaggctgtctcagggaggggcctggggcctaggactctgaggaagaggaacagaactgttccccagtcccctttgtctgttgactttgtcaccaggcacatgctaacctttcggtggacgagggtgttggtggcttcaatttgttattgaggaagcacagatttttgttttcgttttgagacaggtctctctctgtcacccaggctggagtgcagtggcaggatcatggctcactgcaatctccatggcctcaatcaatcctccgacctcagcctcctgagtagctgggactacaggtacacgccaccatgccctgcgaatttgaaaacaattttttgtagagacggggtctcactgtgttgcccaggctagtctcaaactcctgggcttaagcgatgcccctgccttgaccacccaaagcattgggattacaggcttgagccaccacacctggcctgaaaccacagttttttaactgaaaaaataggtatatatatatttacgattaaaagagtaaccccacgctcactagaaaaatgcaaaagatacagaaatgcataaagaaaccaaatggcctcagaactcctaaagcaaacacacggactaggtaaagtcccctggggaacaatctgtgacccctcctccccgagcctggataaatcaggtgccctgtgtggacaccccatgggacacgagattcaaagtggtggctatgtctggggaaggagggaaggagggagggaagcacagtgagccaggggcgtgggcagggctggtttcttgttctttaaatcaaggtgcacatgaggctaagtccaggtttgacagagctgggcggtggccactccatggtgctggtgatgactatctttgtgaaccgagacggccaatcattaacatcccctagacccctggggtacaccctggaggggcccctgctaggtgtggtgtgacttctcaggggggaagcagaaatgcaccctcctgggtcaccccctccaggctgagacccgagggggtctcagttcactgtgacctcggcagcgagaggtccccagccataggccctgtggtccagccagggctcccgacctcccagctccccgcccccccatattccacacccaaaggaggtgatttttctctcagaaagcgggggcttgttggcttaacctgggacactcctggcccggcagtcaatagagcagctgtctccaggctggccgagggcatgcccgtgggcaggggtccatgtcgtgagctaccagggtgccccccatggttgggtgctctccccacagcacaaaaactcggctccaaggaggatcagccattcccggagggagtggaggctcagggaccccccaccaagggcctggtctggggcagctgggactgagcagtcttcttcaggggagcagccttgggaaccccagaaggcagagcccggtgtcttgagctgactctgcaggggggtgcacagcggccgaccactgcatgtgggcccccctccctccctttctcccctgtttccaggggtaaggctggctacagccctgcccactgaggggccagtgttgtcctgggcatcaggcactggtgcagggtctgacagtgtctaggtaaacaggagagaggctgcctgggggcagctcagaggccagaacagggttggccctggggaggttgctgtgtaaaaacgaggcccagcttggtggcgcatgcctgtaatcccggccactcaggaggctgaggcaggagaatagcttgaaccagggagtcagagtttgcagtgagccgagattgtgccaccgcactccagcctgggccacagagtgagactccgtctcctcaaaaaaaagaggaggcccaggctcgaggcctcatttggccactctccggtgggcctcagtgtccccacctgggtggcatgtgtccttataccaaccccgtgggctacggtgggaatcagcggagtgacagggtgcaatgatggctcaggcagatacagtggcgtcacagggcctggtgggtgcaccagccccagacggtcctgctggctgtggcacaagatgttctctcccaggatgtgcatcctgaccttgcctgcgggcaccgctgagctgctctgctctgcgacacagtggccctggtctgtgtcactgtgacaggtgacaccattgctccgctccactgggaggtaggcagaggctccaggcaggggcagggtgtgccgtgtgctgtcctcagcagcggggagaccgaggaaggcacagctctgtcaggatgcgggctgggggtcaattaaggagagaccgtccatgagggcagcaggggcccaagtggacacagggaggggaaaagcaggggcaggaatggaggcaccatcgggccggcctggagcagggagtacagggtggagcacggggcgggagctcggcacagtgcccagcaggggcccagccccacccttgttcttggaagggcctcagctacaggcctgcagggaagctcctgtttactgtccggtccaccctcgctgggggctgctatgaaccccatggagggcaggcccctgggaatccacccacagggacaccccacctgaaaccccatactcgaggcctagccctctgtaccctcggccccacgttcttctccctcaagaccccagactccaaacccggggggtggggagctggggcctgtgcccggggacttatcagagtagtgctggtgttgaaacagctgcgatttgtgcgcacacatgggagagtcagagcgtgtgagcccggccctgtgtgcacacacatgtgagagtcagagtgtgtgagcccggccctgtgtgcacacatgtgagagtcagagtgtgtgaacctggccctgtgtgcacacatgtgagagtcagagtgtgtgagcccggccctgtgtgcacacatgtgagagtcagagtgtgtgagcccggccctgtgtgcacacatgtgagagtcagagtgtgtgagcccggccctgtgtgcacacatgtgagagtcagagtgtgtgaacctggccctgtgtgcacccgtgtgtgcatgccgagggtcaatggaagaccaggccacctgtgaaggccagcttagcctgctgagagcggtgatggtggctgcaagcggggacagggagggaggggacagcagatggggaggcgttgggtcctggtcctgccgcccagctggatctgggacctgcctgcagggacagggacaaacctgagcaggctgtgcgcccttcctgggcacaagggtctccatggtgtgcacgggtgcttctgcagggcatggacgtgagtttgctgcagatgggctgagtgtgtgtgcgtttgtatgtgactgcgtgcatctgtgggctgagaagttgcaagtatgtttctccctggatcatgttgatctgggatatggatggggtggggtcctgggtcctgcagcttccctggcccctgcaccctgagctcaccccagggaccctccagcatgcttgctcccaggggctccggcgcctgccccactcccacttgtccacaccctctagctccgtggatggggatggctgcagccacactcaagcccatgccccagctaagctccgctggccaccgctcctcttctctgcagctgtcatcctctctcttgctgcctggggtgcacacttcttggtgggtggcaggtggcaggcatgctgggccatctctgtccttgcagactgaggcccagccccttccctggtgttccctgaggctggcacccccttgcggccatctgcggcataacctcgctcccggccgcctgtgccggaaagaggctgggggtccacaaagccccctccctgcccggggaggggcctggcaggcaaacctgacagggcagtctgtggggacatttgtgggcacctcaggggcccccgggccagctggcatcgggtgcactgaaggtgggtgcccatgggccccaatttcccagatgcctctgggctccccaagtccctgacatggtcagtcaggggtagaattttctagggacacttccacacagctcccagacacccaggtaggagcagggggcttctcgaaaggtctctggaggcctgagaggacctctgcccctcactgactcccaccaagggctctttcctcccttctgaattggccagcccacccttagcaaaccggccatgcagtgagcactcatgcagtcaggccctggcttgttctggggggccacgcggctccaagttcagaccccagccctgagcaaggctgctccccgcttcccgcccccggggagggttgcgctgaggtattcgcaatggggcaccccccagctttgcagggcactggtggcctcgcaaatttgtgcagcaccacgacgccctggggctgtatttccatcacccccattccacaggtgggaaaacggaagcctgtggacagtgagtggcagcggggcccaggccttcagactaggggagccaggctgcttccacctccttgaggaagaggcatcttgggaggagggcgtcctggcctgccaagatggggggccggtgcccacccctgcctgtgagtcagggcatcagatctcgtgggcaccactcacaggggcagatgtggcaggggtcagcttgggcctgggctggatctggggtcttggcatcagggggctgaatctggcctggtagagggtgggccgtccctgggctgtgctgtggcccagctggctctgggctccagccaccgccatgctcactattatcctcgagaaaccggtgggcccaggaacactggggggaggtgaagacctgggttctggaccacacaggtcatgggggtctccatctgtagcagggagaggggtagagggtttgaggtgaacagaaggatgggtgtgtggcctcatcagtctctgtttctctgtttgcctctgtctctacctgcctctctccccatctctgtctatctctatctgtgtctctgtctgtctgtctccatctctatctgtctcttccccatctgtctctatctttgcgtctctatttctctgcttctgtctctgtctctgtttctcttcccatctctgtctctctctaattctgtctttgtatctccatctctttctccatttctgcatctctgtctccccatctgtgtctccctgtctctgcgtctctgttcccccgtctctctgtttctgtctgtctatctccccgtgtctgtgtccctgtctctgcatctccgtctgcttgtctctgtcttcatctctgtgcctctgtctccccgtctccttccctctgtctccctgtctctctgtctttgtctccctgtgtctctgtctccccgtctctgtctccatctctgcatctctgtctccccgcctccatctctcttctgtctccctgcgtctctgtctcctcatctctgtcttcgtctccgcgtctctgtctccccgtctccatccctctgtctctctgtgtctctgtctccctgtctctctgtttctgtctctctgtctccatctctgtgtctctgtctccccgcctccatctctcttctgtctctctgcatctctgtctccccatctctgtgtccttgtctctgtgtctctgtctcctcatctctgtcttcatctctatgtctctgtctccccttctccatctctctgtctctctgtgtctctgtctccctgtctttgtctctctgtgtctctgtctccctgtctctgtctccatctctgcatctctgtctccccacctccatctctcttctgtctctctgcatctctgtctccccatctctgtgtccctgtctctgcgcctctgtctcctcatctctgtctctctgtgtctctgtctccctgtctctctgtctctgtctctctgcgtctctgtctccccgcctccatctctctgcatctctgtctccctgtctctgtgtccccgtccccgtgtctctgtctcccatctcacatgtacagtcggagaggaggaggagccctgggtgctgaaggcagaagtcaggccgaggagccgccctgcagggtgtccaggtggccacacggtggggccctcgtcccatgtccaggtggccgggctgcaggaggagggtgctggttcctcaaggaggagaggggctgggaaggggtcaggaaaggggagctggggtgggactcagggggtctccatcagattgctctcagggaaccaggctggtccccaggaccccgagggagggacaggaccgcaggaggtgcggctcaaccgtgactgccacaggagtggggcaggggaagggtggcggggccaggcgtgggccgcccgaggtgctgacactgccaggcagggcaggggttgctcacgtcccaggaggcccccataagactcccacagtcgagtgcagaggtctccgaagcaactcagtcccgcctacaatctagccatggggcttgggcttaacgggggtcaatgggcgccaggcctgaggacgtggggcccccagacacactttctctacaggcacgtcgcatgccacacaccacacatgcacacacacacttgcgggccctgcaaacacgcgtgcgcagatgccagcacacacggccctacgcgcagcacacacagtcacacacacgccctcggcggcctcctgcacagctgtgcactcttacaccacaggagaaaggaaagaatcacaccccagcccagaaagagaccaccgtgtggcaccacagcccagcctgcagggtagcaggggagaggccagcaagtgacaaacgggggccggtccgcaaccccagctccctaaccaggcaccaactgccggggcatcttggcccctgggcttcagctcccctgggaggatccacatggccaggccgcacacatgccccacccctccccacccagctcaacgtcctccatcacccacaccccacgtgccctgtgccatcccactcaggacctcgctgcttcctttctcccagggcaaagcccagctcaggggacagaggagggggccagtgggggcccctggagtccccacagtcactggacttggcatgcacgtcggggtggggacatggcatgagtcgtctgctgaggtggccttgagcccacctcaaggacccagagacctggcaggcggcacctttctaggggctgtccagggaccaggcctggccagtatcttcacctgggatcaggagggctcctcctcaaaacccaccccagggatgtcgggtgcatcccttccccctccaggatcctgtcctcacagccactggcagggaaggggtcgtggcccctgctccacagaactaggagctgggcctgccatgtggtcattcacaggccagcccagccccatgtcgtcccagttctggtggacagcaagacgaggccacctggtgctgggcctctcgcctccacagggccagcatccctcctttaactagcgctaggcctggctactggctgggaatacaactgttccagcaccaaaagtcacctgtgcctgcagggtctcgcgcctgggtgtccgaagtcggcacagcacagccctcacagacatacctagccccggaccttctgagctgagcagtgggagccagggcctggctggcatagctcactgtctgccctgggcaggttgaccaccacagacagacagccacagaccaatggcctagaggactgccagccaaggcacagccctttgtccagcacagccagcacctgcagacagggacaaccaggagtgggtgagagtcagacaggctgacccgcagagggcctccagctggggacatgagggcagacgtcacaaaaccacagcatctcctgtttccctgccgcaggcgtgaggggacgtggtggtgcggggaacagggcagctagcggagcccggggcagctagcggagcctggagcaggaggcggcctgggcaggcctggaggagggagcccttctcaccctcctgcccagaatacctaggtccttcctggctggccagctccgtctccactgggctccctgaccatactttctatacccacttctctgccgtgcaagggaggccatggaggcttgaaagcatagtctctgactatgtcccctaaggtcgggccatcctcccctcctcagcctgggccttcccaagacaggggcccttttgctggaacttttggacagtcaggtgacctggcatccaccagggacctctgaggctgagcacagagaatgccccacctccaggagcagcccgttgctgcagtgggccctggacagaacccccaggccacagctggggcccatcccatgactgccctgctgcagacttgttgctgggccactctggccgaggcctttataagcgcctactgcatgctgccccactctgaatgtggtatggccggcagggtggcaggggcccggggtcagctcatggtgcagcgttcagcgcaggtgcgctgttggctcctctgatggctcacggggccagccctgcagctagcagggtgtgagcccagagccccaaggtgtttctgggtccccagactccccagttgcttgtttcagcccagcagcccccttcctgagctggataggaccggggctcctccgagaggcctaagtctgcatcctaaggcaggccagatccccctccccacccgtgtcccagcccatcctccaccctggcacctacccgggcacaccggtgagcactggatggccgttccacctggagaaaatgtcccctgtgctgagcaggacagacagggtgtggaggtgagggcaagacagaggcaggggctggacagggagcgggcacagaacgaccagggctctggacaggccagggcagagaaagcagtggcctgcacaatcttgccctggtgggcggcctccgggactaaagacgctcgctatcctgagagctcagtcaactcaggcagccagaacaaagggccacagactgggggcttaaaccctacgcattcatttcccatagctctggggtctgggcggcccagatcaaggggccagcagatgcggttgctggtgagaacccgcttcttggctccccgtcggggcctccccaggctcacatggacagcaagcaagtgctgtggggtctcttcttataaggatactcactgtatggggtcagagcccacacttgtgccctcatttagccttgactacctccaccaaggccacacctacgccctttacagaacccccacgatgggccacggtcctgttggatcctcaccctcttcccacaaagcagacactcccagacttcaccaaggagacacggaggctgcagaggtggacgcatgggcaaggccatcagctggggaaggactgccctggcgtctgggcttgttgcctgcctcctggccccagacagcctattccaacagcccttcctcccagccgcccacccacatctgtccaccttcccgggggtgtcctgtcatctgccagttccttttttcaccctcgagcagcccccacaagagaggacggggaccacccaactgcagaacaaacctggactcagagtcgaccaacaaccaaaggtcaattctctatgaaggtgaaaaagagatattttcaaagcaactgaattaataaaacagtccaactgctttaggaagatttattcatgaaagaacttctgggacccctcccatatgattatgggcacactgagacatgtactctctggaccccaaaagctcttaagctaataagagataagttgtgatttaacccatgcccatctgctcataaaagtggtgagagttaatggatagatggatgaatagatacataaatgtgtagataggtgcctaaagatagatgcacagacagatcaaaggatgacgggaggaagagagggagagatgggtaaagggatgaatgaatggatggcaaaatggatggatggataagtggatgggtggatggatggatggatggatggatggatgaggtggatggatggatggatagatggatggatggatggatggatggatggatggatggatggatgaggtggatggatggatggatggatggatggatggatggatggatggatgaatagatggatagatggataagtgggatgatggataaatgggtggatggaaactgagaagaaagacctttgctgtattccaaacaccatatccttagtctaaagactcaactctggtccctgccagcttggacatttgcctgggttgaccctcttgtaaacagacctaacagacctccagttctctgaaaccccaatccttaccaatgtcagacttggtagctagttaacgtaaccctgaaaccctggcccacctggggcttagccatggtaggggggctgcccactgctaactgggtaccttctaagtcctctgccaagcatcagtataccacattaagatttagtagataaatgggtgcacacatctgtacaatgtctccctgtaggggaatctcaggaccccgctgaggggatgctaggagctgtgtgctgtccagtcactcttgtcttctaggcccagcagaaaggtcctctactcctctgaaacagaggggatccctcaacccttcctcctctccctcccccatgggggccattaagacccccatgagttctagaccacatggtcctctagtgcttggttcatcccaggtgtctgccaggccctgcccaaaaatgcaatgtctgggcagcaaggaggctgaggccagaccccaccctcatccatgcctggaacctgcatccacgtggcaacccctccctccaaacccagctcatgccagggctcagagcatggtggagagggtagccctgggcacctggggcatggcaggactgccctgcctgccccgcctgccccgccctggcccgtgcctgcaagagccacctagggaaggctccttcacctggccctgggcctacactccacccaggaatgtcctgcacccctggagtgtggagatgaaggttacggggtccagcctctgggcaccgggacatctggggtaggggctgaaggccattcaaagcccctgccccgaagtctaccttccctcctcgcccctcccccacccaccctgggggaggtttgtaatcttcagtgtcataacctgtcaggcctgtttggaagggaagggccgccagcttcctaccagggagcagggagctcaggcgttggttagagaagaggtgaagcgtgcacaggaagcgtgcggggcccccctgggcatgggggaggggcgccggccgacgggagcttgggcacgtgctcacacacgggactggaccgtgtgtcacagcaagcctgggtaggtgcagacaggtccgcgcgtgtcacctgcgcagtgcacaggggcctctgctgcggacgcagggcctgccggagtgactgcctggctgcccaagattccaggggttccactccatccggtgctgagtggtgccccccaccccagagacctgggacagccgagaaatggaggagaggaacccacccacccagccctgtggcctccaggcttgacttgggtgcagctggcagaggccctgcccctctggctgtctccctcctagaggggtctaggagtttcaggaactggggaccgagggaggtcttctgcagagacaagagggcgcagggcgcaggccaggaaaccccttcacctgcagagccatcggtgtggggaggtcagccacggggtgtcttggtgtctcaagggggccttaggtagagctgttcactccctccttgtggccccccgaggcccaggagggacctggagcccatgtcccaggagtgcccttgggaaggtcaactccaggaacccttgcagcccgaggctagggctctgaagctgggatgggcagcgggggccctgcagggccccacaggcacagaaatctctgtaatcctgaaccataaaggggccgccttcccttttgattctaaattttaatagcaaaatgaagagataagtcagctttgatctgagttttattagcctatgcctttgttccctctctcctttaggggaacagacgggtttacggctggtctccccatccctctgtcagctgcaggcgggtggcgggcggccgctctgataaggcctggtccctgcccctgtgcctctgtggggtgccggcacagcaagcctgggacctggccgccggcccctccgccaggtcaccgggaggcctggggggcaggtaccctcaggttagggggactctgggatacagacccctgcaagcccgtggcctcctatttctcccatcccacctccctccctctgcctgatgactcccgtgggtggggcttctgccttcccaagcccctgtgcctcagtttccttacctaaagaacagggtgctaatggagacaagggagaccaggagacagctcagccaggggccaaaccagcagctattgctatggaggttcagggaggtgaggatgttggaccacaggctgggaactggccctccagggacccctgaggagagcaggcctgggatcctggggctgggctgggggagccggtggactccagggtgaacgcggtgttagcctgtgtctgctgggactgggccacaagagttcccagcttcaaagggccaggggaggcctcggggccccgcccacctgtgagttcggggacatcaaagggccccacccaaggggcggctggcagtcggagcaagggtagaaacatccagaactctatctccagagggagcggctggggtcagccccacccctgggtccactggaggccccctgcagtgacccgaggcccctgcctcaccctgaggttctggccaggccggtgacaccccacctctctgggtgagggccttgctcccaggggtggctggggagtggtgggtggggcttctgggggctgtgacacaaccgcactccacttaatgatcacccagttttaacggggatccaggagcttctggggggtgctgggtgctgggtgacaccatggccccctcgtgcgtccctagcctggcggcaggtgctctgggccctctccctgggactatctgcctggacggcattttctggcccttttaacaccggggtccctagcccagccctgggcctttacgatcaggaggtgaggaggacccctcaccccaagggaagcctcaccctgatgggacaggcctggcctcggctgaactgcacagagggggggcccttgagagctcccctgctacagcctaggtgcccccttccactgccctggcagtagcaaaggtccacagcatgggtggacatgcctgatggcagccctactgtgtgccaggtgccaggacgcagcctgaccccaggatccggttcgctcctctccacaaccctgggcggggatcctctcctaggaccctccggagcctgagggtcagaaggtggtgacatccagtcacacggagagggacttggagtgtctgtacggcaccatcctgtcccgctgcctaaagggagcgcctgcttcaattcctgcccccagggccgtaggagcaggccttccgggactccgttcctaggatcaccgatggaattcctggtgggggtgggactctgccccttcaaggactctagaggattccatgacagggtgggttgggcctgaagggcaggggccaagtatgggggcctccccacagatgtgaaagcagaggtttccctacctcctgccagagggcagggagcatagctggatgctgtggctgggggcaggactcctggcagccttgttccccaaggcagagggtgacaaatcactaattggcctctggggcggtgctgcacctgacctgggctgtcttcaggggctagtgattcgctgaaaaaagcccacattctgccaaggctcagcctccacacctcctcacatcccagccagccatcctccccacctccctccctcccagcctccagcctccccacctccctccctcccagcctccagcctccctacctcccagcagcccagccttccagcctccccacttcccagcccctctgccttccaacctccctacttcccagccttccagcctccccacctcccaggctccccacctcccagcctgcccaccttctacctccaagcctccccacctccccacctctcagcctccccacctcccagcctctccacctccctactgcccagcctccagcctccctacctcccaacagcccagtcttccagcctccccacttcctagcccctctgccttccaacctccccaactcccagcctccccacctcccagcctgcccacctttctacctccaagcctccccacctccctacctctcagcctccccacctcccagcctccccacctccctacctctcagcctccccacctcccagcctccccacctccctacttcccagcctccctgcctccttacctcccagcctccccacctccctacctctcagtctccctacctcccagcctcctcacctccctacctctcagcctccccacctcccagcatcctcacttcccagcctgccacctttcagcctccccacctccctacctcccagcctccccatctccctacttcccagcctccctgcctcccagcctccttacctccctacctcccagcctccccatctccctacttcccagcctccctacctcccagcctcctcacctccctacctcccagcctccccacgcccctaccttccagcctccccacctccctacctctcagcctccccacctcccagcctgtcagcctccccacctcccagcctccccacctcccagcctcctttcctcgtgtgagtgttgtggagggacattgggagaaggggcttatccgggacacaatgcactgatcctaagacatttgtttacacttattgtctctgaaagcaggtttcatgtgaatgctgccaacagccaggttcatgacatggtggccccagctcaacacggatgaacctgactgtatcacctggcagtgacccctctacacttccatcccaagcctcaagggcccatctagggaaggacagtgagtctggggcgccgtccagagatcatttgctggcacctgctggtaagatctagataccggcagagcaagcaaaagttcccgggtcaatcgtggaggcccctcttggggaacgggtgtcccccagccctgtacatggcccaaaggaagagtgtatgagggacagcctcggtgcaatgactctagacaaaattgacccggaggaagtggactcaaatgtggggacagtaacccttacttgctggtattttctctctacgtgtgtatacaacagtgatttatgaaaatccctccctcaacccatcaggcaaggtgctttcaataagcaagaaacaaaacaaggaaaacactatttccttgtttaagttccatttctttttttttttttttttttttttttgtgagacagagtttcattcttgttgcccaggccagagtgcaatggtgcgatctcggctcactgcaacctccacctcctgagttcgagtgattctcctgcctcagcctccccagtagctgggattacaggcgagtgccaccatgcccagctaattttgtatttttagtagagatggggtttctccatgttggtcaggctggtctcatttcttttctcatcatgatggcaaaatgatggtaaaacttgacatgggccttagatttgaagaaccaagagggcgtcgaacagccaccctatcttgtgtacattttccattgtatttcactcttgcagctgccttataaggtagggtctaccgtggtcctgatttttcacatgagaaagctgaggctgggactcaggtcacacatgcaggcagatgtcccttatcagagtgtcccttcagggtcacccacagctgcccaacagcagtgactacagccaggaagtcgtggaaccatcgcctctcacagttctggagttgacgggtcttagctgggcagtgctcactcagggtgtctcgtgggcagtcagacgacagctggagtggacgtcggctcagagcatccttgctggcaggtctggtggctggtgctgactttgtcaggttctgccagggccattggctgcacatctgcatgtgccgcctcggtggcacctgggcttcctcacagcatggcagtcaggctccaagggcagctgcccgagagctccaggaggaagctgcgtggcctcttatgatgtggtctgggagttccagggtgtcccttctactgtggttgtcagcctgccccagttgtaagaggtgggagaggccccacatctgcgtgtccacaccataatggggaaagggtacgcaccaccttctgagagagtcatctgccacggggtggcacaaggtcatggcatttcacatggttgtcacccaaagaaagccctcagccgtggagccttgccctctccagaagcgtcataggagatgccccgttacgtctgcagacaacccgtgtgggttcacagcctccatcagcaggtcagttgtttgttccctctgaggagcaggagcaggggcccaggcacgctcccagtgggcaccgaacacctgctgctgggtgcctgccccgcacgtaggagggacacagcggtgagcaggcgctggtcctcatgcggctgcctgctggtggagggaatgtcacgatcagggaagaagcagatctcacatagagatgtcaaacgctggcatccaagaaaaatccagccgtgtggcgggagcagagggctccgtgaggagaggcaggttccttgctcttcagcctccctgggaagctgtgggaggaatgtctgcaccgtgcagaggccctgaggcaggagtgagtgtgtctgcagctggtgggcagtgagtggggaaaggtgcaggccaggccagaagggcggcctctgagaaggggagcctgatgaggacagcccacgccctggcttgaccccgggcagctgctctcagcagtgcctgcagaatccatgaaaatgctgatcccaggccctacctgtgactcacagtctgcggccaggcctgggatgtgcattttgcaggaatattctcagagctccagagctggcagaccagggtgagcccatggcctagaaaaccagaaggaccgggaggcattcctcaaaggcaggaaggtttggaatatcagagaagagggggatgtcctggtgccccctggcctgctgggcacaggctcacatagcctgggcttccctggtgttccaggcagctgaggagtttgaggtctgagtgccctggggtagagcgggatggcaagccaggtgccaagcagaaaacggggtcactcccccgctgcctgtgagcagccctgagaagaagctggcagctgtccacacctcacgccaaggctggctggccccatgttccagaaatcacccgtcccaggctgcctcgctcgccgcgcttctcagcctgtccacctggagtgctggaggctgtgcccagtcctggtccggcatggcctggccctttttcttcctggtagggagctcagcggctggccaatgggcagcagagggggcagcagacagccagggcacaaggaggcggcggcagggcaggcccaggccagtggaggcagaagccgcaagctgggagcggagaggatggcggagtctggcaagcacccaacaggtggcagagacagagcctggcccggtggacagtgcaggtgggggggcaccagtgtagacgggcagggcggccaaatgagaggagcccagacacacacagaggcagacagggccacgctgcaaaggctggagacactgccagctcaggactgggcacggagcggggcaaggtgaccaccctgtcagagcagggcaggggccctactcaggagatggagagaaggcgaagggctgggggaccccctctggccccaggcatggccggccccttgcctcatggccaggctgatgccttcccagcccaggctgggcgggggccgagcatgaatgtggccccatggccaagggtaaggcagagtcagggccccaggtcacccaccccacagccactcggccttctctcaggtccccagactgcctcctcaccccctgtcggcccacaggcctggacctccctcctgcctgccctcctccctgccctggctgcccacgctcctctccagggatcaagtccgccccagccaccctggccctgcttcccagggggtgggctccagccttggcacttgcacacctgaggaccacgcactcactccctcctgagcccattctgacagggaaagtcccgtaacagggtccaagcctaggacttccgcccagcctgcctggctcccgctctgtggacacccgagaccagggtctcttgtctgtcctgcctgaggtccctctgtctcatctccaagaccccagaggcccctggaggaggtttctcaggagcagagaatgagtattagtggtagctatgaaggggtcctaggcccggccgcccaaacccactcctccccaggcagatcttcagccagtggctagggcagcaggagagccactctcaccagccctctggccactgtggcctctgcccagctctaacagcccaccctgctccgcagctgtgcccttgcgtcctgtcacaggggaccccggcgggaagggcagggcctgagccggtctgcgctacccatggaggttggcctcgttcttcttgctgtggtccagcccctctggagcccatgggcccacctcccaggccccgtcctgcggggactcccaccttggatgtggacaggacctcctggctcacttctaaccaataggatgaggcagaagtgacaacattgcttccaagcttaggtcacaaaaggacgtggtttttgcctgctttcatttgatgatcttgaaggagtctgccctgcccacaagggcttggccgggcagcaaggactgcgctccatctgtctgtccagtccctccctgcgtgtccctgaggtagctcctggaggacagtggctggcaccttgtcagggtccacacctggttgatgcaagaaggcacaggtgagcccagtccacgcagctccacacgggtcagaaccgggctgtctgctgggcaggcaggtgcatccacctgtgtccaatcacatttggaaagtggaaagggaaatggtggcctgcaaaaggcattggtgcccctcagaccccagggccgaggtccctgggcagcccggcccacagacccatcaccctgcactgccagccgaggctgctggccctgggctcagtactctggccatggctgggctcatgtcgagacctcccttcccctgacttccatgctcagggctccttcgtgcaggtccagggatgtggtggaggcccgaggtacagggacaaggttgcaggcagcgctggtggggcaagtgccagggcccaggccgtttcatgcaaagacacccactggagaacggaggccctaggtgcaggccctggcatgaccctttccttcactggaggaggactcatgttaaaaaggacctgccaaggggacatagacagaggagctgtagataaaaagctcctgagccaaccaggttccaggcagcccaggagccaaggggtggggggagcaggatgccctggggacacactgccctgtgcagcccggcctctgtgcctgggcaaacagcaaagcctcagtgagcgggctgcaggcaagggaggccccatggcccagggaggtttatggcctcccagcagagcacccggccccagcagctggcctggcccctgcacctgtccctttgtttgcacaaatcccgtccctaatagtcttaatcgcaaagctttgatgactgtgccagaccctgcacaggcccctgcggactgcgctgaacaaacacgccattgtctccgggtgcaccgcaggcgaccagttaatggttaaaccaaggggagaaggatggcagctctgcctgaggccagggtgggggagctgcctggcgtggtgtgggcaccagctccccccaccccacaagggcacagtcgtcctacactggggctcccagtgggcagagagagcacacggcttctcccctgttttagaactagcctcccagcaaccctggagccgggagacaagtccagaggaagctgctggagtccccagcaagacacctgccccgacccctccacaccaggcaggcgcccaggctgtgggagctgctcagacgcttgagagccggccactctctgtgtactccagacccacgggccaggagtgggcatgcagttagagccccgtgagcaagcctcacacagctgtgggacgtcagcagcacagctgccatgggaaatgccctggccggtccacgcaggccggttacccccagcactaccgtgtgaccagcaatcccaccccaggtctatccccagaagtgaaagcagggactcaggcagacacgtgcacacccatgttcccggcagcatcactcaccagaggcaacaggtggaaacgaccccggcatgcaccaaccacgaaaacgacgagcccaggccgggcatggtgtctcacgcctataatcccagcactttgggaggccgaggcgggtggatcacgaggtcaggagatcgagaccatcctggctaacacggtgaaaccccgtctctactaaaaatacaaaaaattagccaggcgcgatggcaggcgcctgtagtcccagctactggggaggctgaggcaggagaatggcgtgaacccgggaggcggagcttgcagtgagcagagatcgcaccactgcactctagcctgggcgacagagtgacactccgtctcaaaaaaaaaaaaaagacgagcccactgtggtctgcctgtacaatggaacattattgggccatgcgaggaatgatggacagatgcaggctgcagcatggacaggcctcaccaacgccacattcggtggaagaggccgggcacacaacgccgcgtggtgatggactccctttatatgaaatgtccagaataggcaaatccatagggacaaaaatagatgggtggccgcccagggaggggggtggtggagacggggagtgaccgctcagtgacagggtttccgcctgggggatgcacgtgctccagagctagaccgaggtgagggtcgcacagcactgagatcgtgctggatacgctggattgtgcactgaaaatagctaattctgggtatgtgaacttcacctccttttaaaaatgacagcccactgagacagacacacaaacagtgggtccctgagtgtgggaaaccaagacgggctggggccgaggccaggccacagaccccagtcgggcggcctggctcactcccagctctgcctggggctggccacggccttgatctgtgccttgatctccaggtttgtggccctgagcctcccgtggcaccatcccagctcctgttgagcatggccctccctgggagccactgtggccacacacacactcctccgagcacgtttgtccagtccatccactctttctcacaatgtcctgaagacctgctaggcagcagaagctggccctgctgggggaacgcaggagtgggcaggctgccctggctcctgctagcatggagcacacagccccaggggcaacaggcaaaccccaggagacccccacctgcagcctggagaggggtgcaggcagggcatgcagcaggggccagccccatcccaacctcctccagcccctccggccaactggcctgcaggctatgccgggtgccctcattggcctctgggctttttctgttttgtaactggtagccttttttttttttttttttttttttttaaagaacacactttaaggtttatagaaaatggagcagaaagtacagaaagttccctgatgctctaccccctgcccagccctcccccatgcctgcagtctccccgttactggcctcttgcatcgctgtggccaggaacccattggacattttttaaagtcgcatactttttattggggcaaaaaacacatcacatcaatgtactgtcctaaatgtacactgtttttcaatgcacagttcaggggcattagggacactcacactggtgtgcagccctcactgccatccatctccggaaccctttcatcttcccgagatgagactctgtccccattcaaagcaaactccccacccctcccccagcccctgacacccactgttctacttcccgtctctgcggatttgatgactgtaggagcctcatgtgagtggcagcacacagcgtccgtccttccgtgtttggcttttcccgctgagcccctgcctcaggtccaccccgtgacagcgtgggtccggatcccccaccgtatgagaagatcgcactttgcttatccacgctgatgctttttaaaaaacatttctgtttatgtaattgacaaataacaatgcatatatttatcctgcactacacgttgttttgaaatacatcaatacttaattattatgcaaaggccatagtttacatgaggcttggagctcggtgttataagttctatgggtttggactaatactaccctgtatccactgttacagcaccccatagaggggttccacggccccgaaatcctccatgctccacctgtttgttcctcctgcctccctaacccctggcagccgctgacgtttgtcttcatggttttgctgtttccagaatgtcctaagggtagaaccctacaggatcctacaatcctttgcagcctggcctcttccacatgtcgagttagcggtttctccctgtctttttgtggcctgtaactcatttcttccacgggcttctagacaggctcagttctctcccatcttaaatactcatcccttgagtccacagactgccacacagctcgtgccaacctctttacttcacattaaatgtctggaaagagagaaggcctgtccactccctttccctgtcacctcatgccacctctcttctaaccacagtccaggtcagtcagctcccgcactgccaaggggcccagtgctttggcctccagccctggagacctcctcctgccttcccagcccctcatctgtttcttccccgctctgctgctcctccccaggtccttgcgggacggcctcttccactgggtccggagctgctccagacggcctcctctcatcttcctgccacagttgccggctacacgcaggccacagtccgtctcccgctaggccgcctccctctcccctgtgctccaacccagaagccagctgccctctgtcactctcagacgacagacggcagcacgggtccagctgccccaggcccgagccccggggctcctcaccgcctgggcctcctcgccaggccggaccttgatgctgggtactactgccctgccacctgccctgccacctgccccgctggcagctgctccttcctgcccccacattctgtccttcagacacgccatcgggagggcagtgacatctccgtggtctccctttaccctcctgctctgccactctgcctctgctcatcctcctctggggagtcagcctgacctctgcaaacatgggcatcagtgggcacgtctccgtgcttagaggcccccagggctatccgtcggcctttggtaaagtcacaggcagaacccacacagagcctttgtgctaggactaggccggcccacctgcctccccaggctttgggtggtgcccacccaccccagcctctgcaggtccatgcctgactagccgcagggcctttgcacacctgcattttgcccaaattaactctactggaccctctcctgtgaggaaggctccgcagcctccccagccaggccacacaccccagtcctcgttcaggggtacacatttgtccccttcatacacaagccaggctccactctgggcactgggtcacagccaggagcaaaacagacccagtcctagaacccgcaaagcatccaccctgggggaaaggaagcagagatcagaggtgtcactgagcacacagaagctcgaggtgctaaattccatggaatggaagccaggagtagccagagggagcacgggtgctggggggtaggtgagggtgactgagacagccactggggggtacgtgagggaggaccgggacgggcgctgaggggtaggtgacgggggaccgggacgggtgctggagggtacatgagggaggactgggacaggcgctgcgggggtaggtgagaggggacccggaaggccgctggggagtaggtgaaggggactgggacgggtgctgggggggtaggtgaggggggaccgggacgggcgctgggggataggggaagggggaccaggacggccactgtggggtaggtgaggggggaccgggagcaagtcccagacaagtgagttttcagaagcccgcgaggccctcaagtggacaggccaagtgtgtgaccagggcttggggagacgtgagggtgaggtagctgtctgcagagggtgcaggagagcagccacccaggaggcccacctggggccctcagtgtcagaggccgcggagcctggcttctgcttgcccccactgccccgggccttctcctgccctgacccacaagccctgtgggggtccctgcccggcccagatccccccactatatcccagtgtgtccagtaggtgctcagtcagtgccagcagactggatggatgcagctggaccaagaggcactccggacagacccccagaggagctgaggatggggcctccctgcgggatgcactgggcgcaccggatgctcagggtggtctcaccatcgtgcccccttcacagagaggaccctgagcctgggatgcgcaggtcctcacctgaggaaagtaggcaccagccaggtgtaacctgggccagatgggcagccccgagggccgcgccccacctctcaggccccgctcacagccaggccccagggctgctcccaggcccctgggagagcagggtgccgtgggcggtcagcaatgggtgcagggtctcctgaggtcaggagggagctcagagctgcttcttcccttctcctttctcagctgcctatcaccccaccctctaaacagcagggagcccggcatagacacacttgtggctaccccaccctcacaccctcagaaatcctcagggagacaggtcgtacaccgcccatccttgcaatgggctccctgccccctttctcctggagggcaccaggcacacacaggtacacacacaaacacgcaaggcacacacacagacacgcacagacatgcacagccacacacagataaacacaaacacacacagctatgcacagcacacacagccacacagccacaaagacacacacagacacacagccacaaagacacacacggacacgcacagacacacagccacacagacacacacagacacacagacacacagagacttgcacagccacacacagataaacacaaatatacacagccatgcacagcacacacagccacacatgggcacacaaaggtacacacagacacacacagccacacatgggcacacatagccatacccagataaacacaaatacacacagccacacacagtacacatagccacacagacatgaacagacaaaacacagacacacagagccacacacagataaacacaaatacacaccatcatgcacaaacaacagggacgcacagccacacacggacacacacaggtatgctcagacacatgcaggtgcacagagacgtatgggcacacacagacacacaaaacaggggcacacacaggcacgcagagacgtgcccatcctctcacagccacacgtacccacagccacagccacacccatgggcacccagcaacacccgccctcccagcacagctgcctgcccacagggacaccactaccaacgcccagcaccgacaccctggcaccaacgcccaaaaaacgtcctcagcggtgcccacccaggccggcaggctcagacagacaccgctgctgcagcgagtgtgcctggagtcccacctgctgggacaaggagacctacaggtgtggatgctgcccgctgcctgctgtagggggccaggacctctgagcctggctgagctgggcacccccgtcccatgcccagggggtgctgcaggactgtggccaggccaagccttcccaaggcacctcttggggccagagcagcttcccaggacagcccccatgcctggcaggctctctgtgggctccccctgttccaacgccctgtggacccagccttggaagcttcacaatgcccggtgcgaggaggacacgtggtaatgagaaaggtgcctggagctgtccagcctgcagcatgctgccagcgcctcactgggtcctcatgccctgtgcccactgggtccctataccagcctctgctccgcctggcccttacaccctcggctccacctgactcctacactggctctgcaaccattcccagccacagaggttggctgcaagtactcacagctgcccctcctcagtgactcgttctcaggcaaacaggaggctatgccccagcccaggggcagcccacgctaggagtgaccacccaggaatatgaaacccagtccccttacctcaaagcccagcctactatagtacaatttatgccccagagctccctgaggctgtctgctgccgagaccccctcttgcttgcctgtgttctcagcctcttctcttcctgggagggcacccctcccccaacaaatcccatgcatgagaaaccccactgcagattcttcttcaggggaacaggcctgagacagttggtgccaggcatggcactgggaagctgagcccaggtgtgggctctgtgatcagctctctcactgaccagggcaaggaggagcccctcatgggggtgagcaggggaggagtggatagagcccctggcaggctagagcagaacactgtgggatcacagaccacctggtgccatgtccccagcacttgagaactatggggaaaccttaagcaaagagctgtggaacgggcagcttttgctgagagccatgaaggtcctgaaggaagaaaaccccaagttcagatctataaattcacaatccaagatccagtgtgagagtcctaacgaggtcatgggtgtgggcttttgtcttactctgtttgtgttgctataaaggaatacctgagactgggtaattgataaagaaatgagatttatttggctcatggttctgcaggctgtacaggaagcatggcacctgcatctgctgctggggggggcctcagcctgcatccactcatggcgggagggtgagagccggtgtgcagagaccacatggtgagagaggaaccaagagagagggaaggtgctgggctcttcttaacaatcagtgctcatgggaactcaaagtaagaacttagttctcaccctcctccagggagggcattaatccactcatgaggaatccatcctcatgaccccaacggctcacatcaggcccccacctccaacactgggcatcaaatttcaacatgaggttgggggacaaacatccaaactatagcattcctccccagtccccccaaatttatgtccttctcacatgcaaaatacaatcatcccatctcaggagtcccctaaagttttagcttcttcctgcatccatttaaaagtccaaagtgcaaagtctcatctaagactcaaggcaagtttctttcaggtatgagcctgtaaaatcaaaatcaagtcatttacttccaaggtacaatggtgggacagacattgggtaaacattcccattccaaaaggaagaaattgaccaaaagaaaggcaggacaggtcccacacaagcttgaaacccagcagaacagacattaaatcttaaagctcccaaatctcttttgactccatgtcccacatcccacgctggaaggaagggtgggctcccaggactctggacagccctgcccccatggctttgctgagcccagcccacgtggctactctcacaggttggagtccaatgcctggggcttttccaggctgcgattgcacactgctggtgtctctgtaattctggggtccccctggcagccccattcccacagctccagtagaagaatatctccgaagggctctatccctgcagcagggttctgcctgggcacccaggctttccaatacaccctttgaaatctaaatggaagtggccaaacctccagcacttttgcattctggattcctgcagacttaacaatacatggaagccagcaagtcccatgcctcgtgctctgcagggcagctgtccaagcggtatctgaggccattgggaccatggctggatctggggtggctgggatgtgggaagcagcatcccaaggtggtccacagcagtggcaccctggacctgaccctccaagccactctgttctgctaggcctctgggcctgtgatgggcagggtggcctcaaagtccttcaaaataccttcagggccctttccccattgttttgactgttagcattataccctctttcagtcatgccaacccctctagcaaccggtgtcacaaaggaccttgaattcctctcctgaaaacattctttgcttctctaccacaggccaggctgaaaattgtctaaatttgtatgctctacttccctttttattagaaattctacctttagatcattcctttgctgttgtagtgattgtaagttgttaaaagtagccatggtacttctggaacactctgctgcttagaaatttcttccactaaacattctgggtcatcactcttaaggttagccttctacaaagccttaaagcacggacacaatgcagttgcaacctttgctaggggttaacaagggtgatcttcgctccagtccccagtaagttcctcatttctatcagagacctcatcagcatggcctctattgcctgcatgtctatcagcattttagtcacaaccacttaactagtctccaagaagtttaaaactttccctcatcttcttgtcttcttctgagccctccaaactcattcaacctctgcccattactcagttccaaagccacttccacattttcaggtatctttatagcaacaccccactctcagtaccaattttctcagtccacttgtgttactataaaagcacacctgagactgggtaatttataaagaaaagaggtttatttggttcatggttctgcaggctgtacaggaagcacggggcctgcatctgctgctggtgagggcctcaggctgcttccactcatggtggaggtgagggggagccagtgtgtgcagagaccgtatggcaagagagcaagccagagagatgggagggaggtgctagcctctttttaacaacctgctcttgagggaactaataaagtgagacctcatttgccccgctctaccagggagggcattaacctgttcatgagggatctactcccatgacccaaacacctcccattaggcctccactttcaacattggatcaaatttccacatgaggtttggagtggacaaacatccaaattctagcagctttaatccaacctgactgatatacttgtgagaagaggagattagaacccagacacacacagggggaggaccctgtgaggacacagctagaaggcagccatctgccagccaaggggagaagcctcaggaggaaccagccctgtgacaccttgatcttggattccagccttcaggactgaggaggataaacttctggttattaagtcccccagtctatggtacttagttatggcagccacagaaagtgaattcgggcagcaaagaggaaatggcaccagttggccttacccacaggggtctttgagaaggataatagagcatgatgctcctagaggggacaggtgggcaaccaaccaggtgaccctttaatatagaaacaagggatcaagactggatgcctgaggctgagatcattctctcaaatgcaatcctgaccccttgaccatttccagacctcagccagttctcagacccagactcaccaatggaaagagaagctgggtccccatgaggcaggaccctgaaacagcataccaaatgcaacctgtggtatgtcctcagtcctttccccaagggacctacagccactgaatcagatcatcacagctgataactgagggacacaactatctttgcagggctgttgcatatggagtctgcataacactcataacactggtactaggggacccaagtgccatcatgggccccccattaaagaagcagcataggggagttagataataagtggaaatctggcccaggtctatctcatggggtgggctatgttcatgaacccatttgaagattacgcccccagttcctacacaaataatcaacatggacccataagcaggcagactccttcatcagctccttgacctttgtggtaagacctattatggcaggaaagaacaagtagaagtccctgaacctgcctttactccaaagccagaaaataagtcaaaactgatgacactctccaaggcttttcacccacttctggcaaagacgaagtaacaggaactgggtttcccctctcagctgaaataataagcaaaaagattgaagaagaaaaaaaaaaagaaacactggttttcaagaaaggatattgggcaaagaaggacagtgatccccaagagaagaaaaacaaagtgagccctacaattgccttgtcttgctgccctgagagagtttttggactgcaatacagggaggaaaattgaggcagagcccaatgaatccaagttgaggtaacagaattgggggtttggggagaccaaggtggctagagtttgcagggcagagaagagagtggtacaaagagtgaaccctggagatctccagaaggttccccctaaaatattcagcaggatacattcatcacaggcctgggagggaatgacccaagcctggaaggaccaactgaaagggttcggggctgcaagacccagtacctatgcagaactgggagaagaaccagttcccaccagccagactggaaaatgtcatgattcacagggcattgggtagtgtaccaataaaagggtcttgccccagcagtggggaataattagccctggatggagtaatgtcccaggcctgcctgacaagccataaaagcaagatatgaaaggaacaagttgttccaaagtatcttaactgcatcccagaacaaagctcagccgtgttcataggaatgcagacgtatccagtatccaacacggcaaaattcacaacatctgcaaccaataaaaaattgtgggatctgcaaggaagcaagaaaatacacccataatggggagaaaaatcaacccattgtaacaaacccagaacagacatgaatgttagaattggcaggcaaggacattaaaacagttattgtaactgcattccctatgtacaaagagctaaacagagatgtggagagatgtgaaaaatgtaagaatgaaccaaattgagctgtcagtatgaacacagcaatgtctgagataaaaaatacactggatgagattacttaaagatataccaatagaaaatattccaaatgaaatgaaaaaacaagaattgttttaaaatgataagagtatcattgagctatgggacaatttcaggtggcctagtatacaagtaattagagggcctgaaggaaagaatagggagggacaaaaacattctgaaaaaagaatggatttttattttcaccctcaacatgtaaagagctcccatccttccaccggaaaaagcagaacaacctgaaaatcactaactttctcagacccatcagagacttgagattgtagagcaaatcactctcctgaaatcagggaaatggggaagtccagagagttgtggccaagactggcttactggagtagaagccacgggagacacaaacagacacagatgtttaaatggtagttctgatcaactgctgagacaggctaccctgagagtaagagatcctgggggtgtgcagtcttgggggctccacgctttcatggactttacctccaggaaccagtttctcactgtgaagagcgcagaagagcctggtaggaggcaggtagggggcaggggtgaagagtaattgtggagcaatttccataacaaagtactactcttctggggaaagatgtttccagagccttatcccacctgggtgaagggcatttccccaactccagccccttctagctctcctgtcactcccaagttgcaaaagctatgacactgggaaatacttgtgaaggtttcagcccgaggcacaggctcactgtaaggcatttaattgggagaatatagaacactattctccccctcatacctgactccctgtcagaataacataaaccctcacagtagagggctctttacctcagtttctattacctgataaacaaaaaatttacaaggcacaccaaaggataagaaaaggcacagcttcaaaagacaaaacaagtgacagaaccagactgagatatgacacagatgtcagaattatcacatagataatttaatataactatgattaacatgctaagagctctaatgaaaaaaatcgacaaaatgctaagaaaagatgggtaatcgagcggagatatgataatcctgggaaagaatcaaaaggaaatgctagaaataaaaaacattttagcagaaacagggaccgccttcaatgggattatcaataggctaagcaagtctaaggaaagaattgaggagcttgaagacagatcaacagacactttccaaactgaaatgcaaaggaaaaaagaggaattgaaaaaaacaaaacaaaaccagaacagagcaaccaaaaactgagggaaatttaaaaaatgtaacatacttgtagttggaataccagaaagagaagaaaaaaggaatggagcagaagagatgtttgcagttataatggcttagaacttggcaaaattaatgatagacatcaaaccacagatccaggaagctcagagaacaccaagcagaattttttaaacattaaaaaaccctcaactacacatagacatattatatttaatctgagaagacctaagacaacaagaattcttgaaagacacaaaaggaaaaataccgcattacctagagagaaatatggataagaattacaatgacctcttgtccgaaaactgcaagcaagaagacaatcagatgaaataattaaagtgttgaaagacatatactaccaacctagaattctatatccagttttatatatatgtgtgtgtgtgtatatacatacatgtatgtatatgcacatatatgtatatatacacatgtgtatatgtgtgtgtatgtgtgcatatatatttacatataatttttaaattatataaaaatgatttttaaagccctgagaggaacaagggccacaagtatgttcaaagtgttgatgatacatgtgtcctgcaattcacattaattctcacagctcttaggctatcattaaaaaaaattttttttcagcatcagtctcactctgttgcccaggctggagtgcagtggtgtgatcatagctcactgcagccttgacctcctggactttgaaatcctcctgcttcagcctcccaagtagctaggactatagatgtgctgcaccacacctgacaatgtttttattttttatttctgtagagatgaggtctcactatgttgccctggctagtcttgaactctggggatgaagtgatcctcctgcctctgcctcccaaagtgctgggattatgggtgttagccattgcacccagcctatatacagtgataggctgggtgaagagaaagtaaagacttttgcagacaaacaaaaatggaaggaatttatcaccagatctgccctacaagaaatgctgggattacaggtgtgagccaccacacccgaatgaaatgttaagattcttttttagacagaggaaaattataggtcagaaacttgaatctgcataaagagaaaaggagcatcagagaaggaataaatgaaggtaaaagtaagatcttttcttattctaaatcaatgtaatgataactatttgtttcaaataatattagtaagaatgcattgggttattacagcatatgggtaagtaaaataaatgacaagcattataagggatgggaggaggaatcgggactttatatagtttggtatttgttccctccaaatttcatgttgaaatgtgatcctcaatgttggaagttgggcccagtgataggtgttttggtcatgggagtggatccctcatcaatggcttggtgccctctctgcagcagtaagtttatgtgaaagctgtttatttaaaagggtctggcacctctcttgcttcctctcttgccatgtgacatgcctgctccctctttgccttctgccaagggtaaaaccttcctgaggcctcaccagaagcagatgatgacatcatgcttcttatacagcctgcagaactattaaacctctttactttatcaattacccagtttcaggcattcctttatagcaatgccaaatggactaacacaggacttatctgtgctactaatgaagtgaaatggtgttatttggagatggacttaggtaaatttaaaatgtatattgtaaatgctaaggtaatcactgtttatctgtttatcaacagaataaacagaaaacctacagaatgggggagatattctcaaactatgtatctgacaaaagtctaatgtccagaatctataaggaacttaaacaatttgatgagtgaaaaacaaataaccccattaaaaaatgggcaaaattggctgggcgcggtggctcatgcctgtaatcctagcatgaggatttgggaggccgaggtgggcagatcacgaggtcagcagatcgagaccatcctggctaacacggtgaaaccccatctctactaaaaatacaaaaaattagccgggcatggtggcaggcgcctgtagtcccagctactcaggaggctgaggcaggagaatggcatgaacccgggaggcggagcttgccgtgagcggagattgcaccactgcagtccagcctgggcaacagagtaagactccgtctcaaaaaaaaaaaaaaatgggcaaaattcaataacaaatacatctcaaaagaagacatacaaatggccaagaaacatgaaaaaatgctcaccatcactaattaccagagaaatgtaaatcaaaaccataataagataccatctcacatcagtcagaatggctattattaaaaagtcaaaaaataacagataacggcaaggctgcaaagaaaaggaacacttatatactgttgatcaaaatgtaaattagttcagccactgtggaaagcagtttgaagatttcttaaataacttaaaacagaactaccatcccaggcaacagtcccattactggttatatacccaaagaaaaactaatcattctaccaaaaagtcacacgcattcatatgttcactgtagcatgattcacaatagcaaagacatggaatcaacctaagtgcccatcaagggtagattagataaagaaaatgcggtacatatacactatggaatactacacagccataaaaaagaacaaaatcatgtcctttgcagcatggatgcagctggaggccattatcctaagtgaattaacagaaaaccaaatactgcatgttctcacttataagtgggagctacgcattggatacacatggacataaagatgggaacaacagacactgaggactacccaagaaaggagagaaggaagggggcaaggccttaaaaactacctattggatattatgctcgctacataggtgatgagaccatttgaacctcaggttcatgcaacatacccatgtaacaaacctgcacaggcaacccctaaatccaaaataaaattgaaattatattaaaaagtcactatataatgataaaggaaccagacttccaagaagatacaacaatccttaatgtgtatgtacctaacaacagagcaccaatacacatgcagcaaaagctgatagacctgcaaggagaaatagacaaatttactgttacagctggagacttcaagaccctacggccagtaactgataggtcaagaagacagaaaatagacaaggataaagttgacctgaacagcagttatagcccaacttgatctaattcacattttagactacctcatccaacaacagaataatacacattaatctctagctcatgtggaacattcatcgtgatagaccacattctagaataaaacatactttaattgaaaataatagaaattatataaagtgttcccagaccatagtggaattaaactagaaataaaaaacaaaaagctggcaggaaaatcctcaaatatttagaaatcaagcaatacacctctaaataatccaagctgaaaagaagtctcaagagaaatttaaaaaatatttttaactaaatgaaaatgaaaatacagtatatcaaaatttgtaggactcagcaaaagcaatgctgaatatagcattaactgactataattagaaaggcaatcagtaacctaagctcccaccttaggcctaaaacaagcagaagaaaaatttaataaaaattagaggataaatgaatgaaattcaaaacagaaaaaaatcaacagaaataacagctggtgctttgaaaatattaataaaattcataaacctctagctaggttaggcaagaaaaaaagaaaagacacaaataatcaatatcagaaatgaaaaagtatcatcactgttaatcccatggactgtgaaagcataataaagaaattctataattaactctatacccacacatttcacatggatgaaatagaccaatttctggaaagacacaaattaccaaaacttacacaaggtgaaataaataacctggatatccctgtatctattaaagaaattgaattaattgaattaataatagtagccttcctaaaaagaaattaccaggcccaaatggttttagcagtgaattctattaaaaatttaaggaagaagtcataccaaattctccaccaaaaaatctcttccaaaaaatcaaggtgacagacacactttctaactcattctatgacgacagcattactgtaataacaaaactcaggtaaagatattatgggaaaggaaaactatagaccaatatctctcatgaatataaatgcaaagaccttcttaaaattagcaaagtgaatcgaataataaataaaaagaattatgaagtacaatccaaatgggatttattctagatatgcaagatgggttcagcattcaaaaagcaatctctgtaatccacacatcaacagactaaagaaaacaatatataaccatatcaaatgaagcagaaaatttatttaacatttttctctctttggcttctttctgctctttctcttcttccccttccctgtcttcctcttctccactactcctctactactcctcttctcctctactccacttttctgaagggggaagacattagctctccaagtatgtaagaagtggctgcagccaccataggtatatccagtttctgtgacaagattttagtgatcttgtccaaagtatcttatgaccaacagctggagttaaaaagagtgaagtcagtaagatggcagaataggagatttccaccatcatccctccacaaaagcattgatgtttcaactacctatagatgacagtatctttgtggaagtccaggagtccagtggagaagttctagcacagttatagcaaaaaatctaataataaatgcattgaagagggtaaaagaaccgtttgactttatccacatcacccctttttcaaggcagcatagctcaatgccaaaataaatctattaggtccatgacctttccacagaggaaagtgagtgagcaccaggctcccccagccatatggcaaactgcccaagaggcccactgtttctcaccccactgagaacactgaggtggtcggcacagctaagtggttgcaagaaactgagagaaggtgagaaaggccatagaccctactaatttatctgcagacttcatcataaacatataatgtggggaaggaagaggagtgaagtagtttttgtatgggacttaagctattatcagcttaaaatagactgttatatgatgtttaatgcaattctcctggtaaccacaaatcaaaaacctatagtaggtacacaaaatcaaaacatacaattacagaaaatcatcagatcacgaagaaagacaataagaaaggaagaaagcgacaaagggtgtataaaatatccagaaaacaatgaacaaaacagcaatagtaagtctttacctattaataattactttaaatgtaaatggatcaaattctacaatcaaaagacacagaatagccaaagtgtggtgcactcctgtagtcccagctactgaggaggctaaggcaggaggattactgagcccaagagttcaagtccagtttgggaaacatagtgagatctcatcttttaaattaaaaaacaaaacacaatggctgaatgcatttaaaaagcatgacccaagtatatgctgcctacatgagattcacttcaactttgaggatacacatagactgaaagtgatgggaagaaaaatgatagttcatacaaatggaaaccaaaagagagcaggggtagctgtacttatatcagacaaaatagactttatatcaaaaactaacaagagaaaaagattattacataatgataaagtgatcaatttaccaagagaatataacaatattcaacatatatgcacccaacattgaagcacctaaatatataactaactaaagggagaaatagacagcaatgcaatgataataatagaagacctcaacaccccactttcaacaatggatagatcacccagacagaaaaatcaatatggaaacaagcactggacttgaactacactttagaccaatggacctaacagacatacacagaacattccattcaacagcagcagaatatacattcttctcaagtattcacagaatattctctaggatagatcatatgttaggccacaaaacaagttttaccaaatttaaaatgactgaaattatatcaagcgtcttttccaaccatttccaatttctagtttggtatcaaactagaaatcaataacagaaaaaaacagaaaaatccacaaatatatgtaaattaaacaacacacacctgaacaaccaatgggtcaaagaagaaatcaaaagggacaccaaaaatatctcagacaaatgaaaatggaaacacaacataccaaaatgtatgtgataccacaaaagcagttctaagagagaactttatagtgataaacgcctgcatgaagaaaaaggaaagatctcaaataagcagcttaactttatacctcaaagaactagaaaaagaagagcaagctaagctgaaagttagcagaaggaagaaaataacaacaagcagaggtggaaaagattaatgaaattaagagttgttttttgaaaagataaccaaaattgataaacatttagctagatgaagaaaaaaagagataagctaaaataaataaaaatgaaaaaggagacattcaactgatactacagaaatacaaaggatcataatagaccactatgagcaattatatgttaacaaactggataatctagaagaaacagatatattcctataagcataaaattaactaagaatgcatcataaaaaaatagaaaatctgaacagaccaagtaaggagattgaataactaatcaaaatcacatatcaaagaaaagcccaggacctcacggcttcactagtaaattctaccaaacgttttgagaagaactaataacaactgttctcaaactcttccaaaaaactaaatttttggaatacttccaaattcatattataaaacaagtattactctgatgtgaaagacaaggacactacaagaaaagaatacaaaccaatatccctgataaacataaatgcaaaaatcctcaacagaatactagcagcaaaccaaattcaaaagcatattagaagagtgacacgccaagatcaaatgggatttatccctcagacgcaaagatagttcaacataagcaactcaaaaaagtgatacatcacattaacagaataaaacataaaaattatatgattatctcaatagatacagaaaaatcatttgtcaaaattcaataccatttcatgataaaaaagtatcaataaatttggtatagaaggaatgtacctcaacacaataaaggtcatatatgacatctcacctctaacaacatactcaaaaataaaaagtgaaaagctttctccctaagatcaggaacaacaaaaaggatgtccacttttgccagttctgttatacataatactggaagtcctagccagagaaattaggtaagaaaaaaaagcaaaaaaaagaaagcatccaaatcagaaaagaagaagtaaaattatctctgtttgccaatgacatgattacatacatagaaaaccctaatgactccatgaaaaaaagttagaactaatcaatttagtaaatttttaggacacaaaatcaatatacaaaaattggttgcatattgatgtactaacaatgaactatccaaaaaagaaattaagaaaacaatttacttacaatagcatcaaaaaggataaaatactgaggaataaatttaatcaaggaagtgaaagatatgtacactgaaaactaaaacttggatgaaagaaattgatgaaaacaaacaaatggaaggatgtcctgtgttcacagatcagaggaattaatgttgtcaaaatttccacactacccaaagtgatctaaaagtcaatgcgaactctatcaaaattgcagtggcattttgcacagaaacagaaaaagcaatgctaaaatttttacagaaccatgaaagaccccaaatagctaaagcaatgttgagcaagtggaccgaagtggaggcatcacacttcctgattcaccaggactcaaagtcctggctatttcaataagacaagagagtgaaataaaaggtatatagattggaaagagagaaataaaactgtttatatttgcagatgccatgattttacatctagagaatctctaagaaatcaacaaaatactcctggaactaaaaagcaactatggcaaggacccaggatacacattaatacaccaaagtctatcactttcctatatactagcaatgagcaactgaagtctgaaatgataaaaaaaaaaagataccatttacaatagaacccccaaaaacataattcttaagaataaatttaacaaaatatatataacaccttgtaaaggttaattttggttgtcaacttgaagggatacccagataactggtaaagcattatctatgggtgtccctgtgagggcatttccagaagagattggcgtttgaatccgtggactgaataaggaagatctatcttcacctgatgtgggtgggcactatctaattgtctgagggcccagatagagcagaaaggtcaatggtctacttgctcagtctctctctatttatctacctacctatctttcctggagctgagacacccatcttccactgcccttggacattggaacccctggttcttcagcccttggactccaggacttgcaccagtgtcccccgggttctcaggccatcatctgcagactgagttacaccaccagctttcctggtcctgagtcctgcacacttggactgagccatgctcttggcttccctggttttccgtcttgcaggaaacacattgtgggacttctcagcctccataattgcatgagccaattcccataataaatcctgtctcatatagctctatcaattttgatatctacatctatatctgtatctatctgcatcctactggttttgtctctctgggtaactcatactacgtaccaggaatggttctagtggggacagaattttaagagtgagttccctaaattggttttagagtttctggaattgggtctttagtctgattagacttaaaaatgctaaggactctacttccaatagtaccaagagtaccgatagtcattccataaattgtttataaagatacgcaaaatacatgcattaagtactcctaagcaaccactttttaattttttttccttatttatttattttttattgtggcaggggctctctctgtcacccaggtgggagtacagtggcacaatcacagctcactgtagcctcaacctcctgggctcaagtgatcctttcttattttattttattttattttattttattttattttattttattttattttatattttattttattttatattttattttattttattttattattttattttattttattttattttttgtagagatgaggtctcactatcttgccaaggctggtctcgaactcctgagctcaagcgatcctcccacctcggcctcccaaagtgagcagccacttttaagaggcaaggaacttagaggctctgtatatgatactttggagcatttgtggaaaacgaaggaatgaatgaactgttggttactcctaatgttccaggacaaagtgatgaaggaaaagaatgagatcaggtatttggattctcagctcaagcaccgcataaatgacctaacagcggctaggtgtgtccctagggagaacctaggtcctatagccacagggtcggaattgctgcaagtcaaatgcaagccctcatcacgcagttctcggccttgctgggtgtctgtggtaggctcagataaatgcaacgtttttatcacagccccaggaaaggtttttgttgtttatgttgctgatgttgtgttttaaacaactcctctattaaaaaaaaaaaaaaaagaaagcacagagaaataaaagaaactctgattatcctgtattgtgcacagaaatacaaaataagaatctagaaattttagaatattcagctaaaaattcacattgtgtgtaaatggcatttactggaaagacggtgattcttaactgtggaattttgtctagaaatgttgataaatttacatcctaatgggattgatctcacatttggttttgcttacatgtttataaagcattaaagtttggttagccaaatttctcatacttgatatatatcagaaattgtatttaaaagctttacttctgttgtaaaattagttgcctgaaatgaataaaaccaattaaattgatatttaaaaaaaaaagggaaggcattggttgagaaagaattgatatgttggaatggggacctgggaggggggccttgatgaagctggggacattgcaccctgaaatactgagccttcttttaccacggaaaaagtctctccacaaccagcataagtgacattcccagccccacaggcagcagcgtccctggcccagtggaagcagcctccccgcccccagcagctctggcctttccacctcctctggggcattaacctgcgttgcctgaggaaagggtaaggacttcccctaaggcggttgccaggcaagtcagtgctgattctcctccggtccttcccccaccacctccctttgcttctggacctataacaagactcgcagcccaggaggcccctgaaggtgaggcccacagtgtgacacaggaggaggcgagccacaccccagaagagccacttgacctctctgatttacacagacagacacccaggggcatcagtgggagcagacactgggtgtgggcactgggggaggaacacggaggtggaggggccgggtgtgcagacgtgtccaccaagcagaggccgcactccaggctgcagctaggggacttggaaaagctctaactggctggtcggttgaaacatggatcaaaggatgcccgcagtgagcgagctggaggtacccaagctcccttggcttaacatagaggaaggggttcaaaggctcagggagatgggaatgtgacaatgaaaacctcctcacccaccctgggagggcccaggatgcaggcctctcacaacactgagacatagatctgtgagggagcccagtctccttgaagagctctgcaattgttcttctctgtaggccagactcacagtgggaattgcagtcaatcaactgcgaaactttacatgcaacggggaataatcggatcctggggtagcaggggccaaagaaaaagtgggtgtggttaccatgatggacagcagaagcgaagcagcaatcagacctgggtcactggtctgacccatgcagacctatggcactggctgcttatcatgttcctagcagtgaaataaacaggaaatctgctcaattcctactggatacaagcagtaaacttccaggccaagtggacaaaagtctaagttcagtcataaaaacacagagaatcatggccttggtcattcacagacttgagacagtctacggacccagaaccctcgaatgcaagaaaggcgggtacccttgagaaaaagtctccccacaaccagcataagtgtcattcccagccccagaggcagcagcgtccctgccccagtggaagcagcctccccgcccccagcagcacgggcctgtatagtccccagaatttatcctgataatcttttccgcagtcttcctgaaagagactgtgtattggagaaaagaaaatactgcaacatttcgggacgattggacactggctctgtcctgacattgattctaggagacgctggaaggacactgtggccctccagttagggaggggcttagggatccaggtgatcaatggagttttagctcagatctgactctgtgggtccagtgggtacccagcccatcctgtggtcatcttcccagctccagatgtgtaagtggaacagacacactcagcagccagcagagtccccacatgcgtcccctgacctggggtgtggtgtctgctatggggggaaaggacaagtggaagccattagaaaggcctctacctagaaccgtcagtcaaaagccatcccacatccctgaagggactgcagacatcagtgccaccaccaaggacttgagaggtgcaggggcggtgatccccaccacagccgattccacccgcctatttggcccgtaggagagacaggcgggtcctggagaatgacaggggactgtcctaagtttgactccagctgcagctgctgggccagacgaggttccatcgcttgagcaaattagcacatctcctgctccctggtgcgaagctcttgatccggcaaatgcgttctcctccacccctgtccacagggcccagcagaagccaggccagcaatgccccctcgccgccccacctcaggggcctctcgcctctccagcccgtgtcagaggtaattctcaggagtctcgatcaccgctcccttccccaggatgtcacactggcccattacactggtgacatcatgctgacgggacgtaaggcacaagaagtagcctccatcctagacttgttggtgtcggagggtggggaataaacccaactggaattcagagccttctacctcagggaaacgtctaggggtccaatggcgtgtggcctgtggagttacccgttctaaggggaaggataagcagttgcatctgccccttcttagtcataactaagagacaatgctgaatggggcctcttcgaatttttttttttttttttgagacaaagtctcactctgtcacccaggctggtgtacagtggtgcaatctcagctcactgcaacctctgccaccccccaaggttcaagcgattctcctgcctcagcctcccgagtagctgggattacaggtgcacgccaccatgcccagctaatttttgtatttttagtagagacgggatttcaccgtgttggccaggctggtctcgaactcctgacctcaggtgatccacctgcctcagcctcccacagtgctgggattccaggcgtgagccgccacgccggccctctttgaatttagagcaacacatttctcatgtagttaatctggcccaagtgccctgaaaagctgccagttttgagtagaaaccagagcaggagaaggctctatggcagatccaggctgccgtgcaagctgctctgccctgtgggccatgtgacccagcagatgcagtggcgtctgggatgtggtgttagatggggtgccgtaggtgaatggtgactggttggtgttagatggggtgccgtaggtgaatggcgactggttggtgttagataggggtgccggaggtgaatagtgactggcgtgtggtgttagataggggtgccggaggtggatcacagcacgggcctttaggactttgcggcgaggccctgccaccatccacagataaccactctcctttggagagacagggcttggcctgctgccgtgccttagtagaaactgaatgtttgaccatgggccaccaagttaccctgtgatctgagctgcccaccatgaactggggaattatctgacccacgtagccataaagttgggcatgcacagcagtgctccgtcatccaacagagaggtatatacatgatccggcctgagcacatcctgaagacacaagtaagttacatgaagaagtggcccaaatgcccgtggtccccactcctgctacactggaaaaggcaaaacgagagagacagtagacgcatcagtcattgccagggggctggtagaggagagaggtaggtgaagcacaggaggttttttttttagggcagtagaactattcttactaccttaaaaggtactgtagtggtggctacaaggcataagcatgtctcaaaagctataaaactttacagcacaaagagtaaaccttaatgcatgcaaattttaaaaaataataatttaccaggtcaggagatcccaggatggaaagcagaatgcgatgcagtcatcttactgtgctatctacgtatgaaacaacctcactgagggagctgggaataaagtgctggcctaagtaactttggaaatgagtggagtctgtaagactcaatgcaaaaataactatacataaacactgtaccctagttggtaaggttgttgcttatgcttgtatgggttaacaattctgatatcatcctgatatcagatatcattccagaatacgtattctggaattggacagttaagtaagtggaagtaaaatggtgggaaccgagtgtcttatggttgcagtagaaggttacagatgagcaaggagagactagaaaaatccatgtggggcaggagtacagttagagacatcagtatcaaccgatggttagcgtaatatagacacagatggttacatttagaaatactatgatgtgtgcatatacacatgctaatgtatacacatatatttcctttctctgtccgctgagagggcctaaaagcaaagaaatcccagtagcaatgagcaccagatcttggtatcaaataccactctccagtaaaagaaatcttggaaaaaatagctgattctaggaatagcacaggaaatatatacgatggccctagatgcttttacactgttggtaggaatgtaaattatttcaacaattgtggaagacagtgtggtgattcctcaaagacctagagacagaaataccatttgactcagcaatcccattactaggtatatacccaaaggaatataaatcgttctaccataatgacacatgtacacgtaagttcagtgcagcactattcacaatagcaaagacatggaattagcctaaacgcccatcagtgataaactggataaagaaaacatggaccagcctggctaacacggtgaaaccccgtctctagtgaaaatacaaaaaattagctgggcgtggtggcacacgcctgtagtcctagctagtcgggaggctgaggcaggagaatcgcttgaacccagaaggcggaggttgcagtgagccaagatcgcttcactgcactccagcctgggtgacagaatgaaactccatctcaaaaaaaaaaagaaaaaaaagaaaaagaagatgtggtatatatagatacacataccatggagtacgacacagccacaaaaaagaatgagatcctgtcctctgcagagatgtggatggaggaggccattatccttagcaaactaatgcaggaacagaaaaccaaatactgcatgttcttactcaaaaatgggagctgaatgatgagaacacgttgacacatggttgggggggaaacacacactgggcctactagggggtggaggcggggaggagggagaggatcaggaaaaataactggtggatactaggcttaattacctggctgatgaaataatctgtacaacaagcccccataacacatgtttacctatgtaacaaacctgcacatcctgcacatgtacccctgaacttaaaataaaagttaaaagaaaagaaaaagaccacgttagagcatcttgtagtaccaaaaagtaagaaagcactgcagacaatacctacaattatggggatatgccaaagggatacaggagccaactgaaagagcttccagtggccaaagctggaacaatttgaataaaacaaaataaatgaagtagtaatggattataacccaaattataaaataaatattctggagtgcaatctgatacaaatcaatgattgaataaataaatatatggaagacaacagacaaatctaccatgcagaagaatttcaaacaatttatgtagctacttcacccttaacaaggtggagcataactccccactccttaaatgtgggctgtgctagtgacatccttccaaagaggacagtattaaaaggggagaaaagagtcacttaatggtggagaaacctgacaaacagcatgtgttaggccgttattgcattgctataatgaaatacctgagggtgagtaatttataaagaaaagaggtttaattggctcatggtttggcaagttttacaggaaatggtgctgacatctgctcagcttctggggagtcctcaggaagcttacaatccaatcatggcggaaggtgaagggggagtgggtacatgatatggtaaaagcaggagcaagagagacagggagggtcttttttaaacaaccagaccttgcaagaattcactcactagcacaaggatagcaccaagaggacggtgctaaaccattcatgagaaatacacccgcaggagccaatcaactcccaacagaccccacctccaacactggggattatgtttcaacataagatttgggtgaggatgtagatgcaaaccatatcacagcacctgggccaggtgataaaagtcaacatcaagagcaataagccatgttgataatatagagccttaatatgatgcgaatggcattacctctgtcatcttactcaaacccataatcccaaattaatcctgagaaatcagacaaatcccaattgaggaaaatgctacaaaacacctgactagtatttctcaaaaactgtcaaggtcatcaaaagaaagcaaagtctgagaaaacgtcaccagcaggaggaagctatggaaacatgactgctaaatgtaacatggtatcccggatgggaatcctgcaacattaggggaaaactgaaggaatctgaaaaaaactatagactttacttaataataatgtatacatattggttcattaaccatgataatgttccataccaatgtaagatggtgataataggacaaactgggtgtggggtttatgggaattccctgtactatctttgcaacaattctgtaaatctaaaactgttctaaaatgtaaaactttattgaaactgtcataataggcaaaaaaatccaaatttgagaaaacctataaacacacaaatctaaaaattttaatgagtcccagcataagaatcactatcactaagaaaattacactagggaagataataatcaaatttctcaaaatcagtattaaaaataaatcttaaaagcagccagagggggaaaaagacacattacatacaaagaaagaaagaaagataagagtgacatttcttaccagaaataaatcaaagaataaaagggtgagcagcatctttaaaatagggaaagcaaataaattgccaactggaattccctattcagtgaaaatatcttccaaaatgaaagtgaaatcgactttttcagatatacaaaagctacaagaattaattgtcaactgacttgcactgtaagaaatgttaaaggaacttcttcacgcagaagaaaagtgatatcaaataaatatatggatctcaaagcaataaagagcacagaaatgataactacatgggtaaatatgtactttttatcttgctatttacatatctttaaaagataattatagttgtaacaataccaaaataattcaagatgttaacaatagagtaaactgaatgtggcatagactgggaactctctgtactaactttacacattttctgaaaagctaaaactattctaaaataaaaaatttatttaaatattaacttaataatgagaaacaatatagtgtgaggtttataatatgcaagtaaaatgcaggacaataatagcataaaagtgaggagggaagaaatggaaatatactattgtaaagtttttatgctatgtatgatgtggtcaaatatcacttgaagaaagactgataagataaatatatgcattagaaatcctaaagcaaccactaaaataatgaaacaaatggctatagatcataagccaacaaaggaaagaaaatgatatcatgaaaaatactcaatctgaagaaaaaaacagatgaagcaaatataaaacaaattacaaaataatggacttaattccaattatatcaacaattacattaaatataaatgatctaaacaccttcattaatatacatagattgttgggttgcatagaaaaagcaagacccataaatatatatatgctgcctaccaaaaatacactttaattataaagacataagtaggttagaagtaaaagaattttaaaaagcataagcaaaactagcaccaatcaaagccagaatagctatggtaatataagggaagcagatttaaaagcaaagaatattactgggacaaaaaaggtcatttcataatgatataagagtcagtccatcaagaggatttagtaatcaaaatgtttatacacccagtaacagagccttaaaacaaataaagcagaaaactgaccaaattactaggagaaatagacaaattcacattataacaggaaattcaatattcctctttcaataatagaacaagtagacagagaattggtaaggatataagagacttgaacaaaacaatcaacttgatttagctgacactaataggacgctccacctgataacaacacaatacataatcttctcaagtgcacaaggagcatttactgagacagatcttactatgggccataaaacaagtctcagtaatttcaaaaggattcaagcaacacaaagtatgctctctgaccaaaaagaaattgaattacaattcaaaattaaattcaaagttaacagaaagaaggaaacaataaaaatcgagaagtaaatcaaggaaacaaagcacagggaaaaatgagaaaaaaatcaataaaccaaaaatggattctttttgagaaaatcaatcaaattgctgaacttctaccaagattaatcaggaaaaaaaagacagaaactgccagtattaggaagtaagagagatgacatcatttacagattctacagatatccaaaggataatacgggctattacaaataactttattctgataaattgacatcttaaacaaaatgaacaaattcaatgaaagactgaaattaccaaaactcatacaagaaaaaatagataacctaaatacactcacaaacacaaattaaatttctagtaaaaattctattcacaaagaaaacatcacagcatcactggtaaattttaccaaacatttaaagaaaaaggataccaattctagaaacactctttctaaaaattaaagaagagggaatactccttcaccatttctatgagaccaggattattaccctgataccaaaagtaggcaaagacattacaagaagagaaaactaaggctaaaacctgtcataaaaatagatgcaagaattctaaacaaaattttatcaaatcaagcctgaaaatatgtaaaaaggataatatctcatgatcaagtgtggtttcagaatacaaggttggtttaacactcaaaaatcaatcaatataaattttcatattaatgaaactagaaaaggaaaagcatattattatcaatatacatatgtgcactggttagggttctccagagaaacagaaccaacaggggtgtgtgcgtgtgtgtgtgtgtgtgtgtgtgtgtgtgtggagagagagagacacacagagagagagaaaaagagagagaaaatccaaaatcggcagggtaagtggcagactggagccccaggaaaaagctgcagcccaaatccaaaagcagtctgctggcagaattccttctggcttagagaaagtcaatctttgttttgttaaggccttcgtcaactgcttagatgaggactatggttcaagcttgtccaacctgtggcccatgggccacatgcagccaggcactgctttcaatgcagcccaacacaaattagtaaactttcttaaaacatgagacttttttgcaaaattttttttagctcatcagctatcattcgtgttagtatattttatgtgtagcccaagacaattcttcttttcccagtgtggcccaggaaagccaaaagattggacacccctggtttagatgtttgtcccctccaaacttcatactgaagcttgatccccgatgttagaggtgaggcctaatgggaggtgttttggtgatgaggccagatccctcctgaatagatcctccctcaaggatgagtcagttctttactggttgctgtttattaaaagagcctggcatctccccttctttgctcgctcttgctttctctctcaccatgatgcagatgcccaatcttgaaattttcggccataagaatcatgagccaaataaatcttttttctgtatagatctccagtctcaggtatttctttatagcaacacaaaatgaactaagacaaggaccctgcacattgtggaggttaatctgccctactcggagttcaccaatttaacattaatctcatccaaaagttaccttagctgaagcatctagaataatatttgaccagacatctaggcacagtagtccaaccaatttgatacataaaatcaaccaccgcaatgctaagaaaaagtatctaacaaacaatatacaatatcctttcctgataaaaactctcagcaaattaggaataaaagggaatttcttcaacctgataaggagtatctatgaaaaacttacagctaacatatttaatggtaaacgattgaaagctttcttcctgagatgggaaacaaggtgaagatatctgctctacccagtgtaataagaaaataaaaagaaacaaatacacccagattggaatggaagaagaaaaactgtcttaatttatacaagaaatgattgcctatgtagatggtcaaacagaatctacatgaaacacacaaagaacaatcagacattgaaattttactagcataaaaatgcaaaatactgcgagagaaatctaaaaaaatatgtacaagtctggtgtactgaaaactataaaacattcctgagaaaaaacaagtaatacccaaataaataaagaaatatactgagtcctagattgaaagactcagaattattatcaggatgtcagtttctgacaaattcatctatagattcaacgtaatctcaatcagcaccccagcaagctttctgtagaaactgacaaactgattttaaaattcctatggaaatccaaaggacctacagtaaccaaaacatctttgaaacagaacaacatacttagaggacttactgtatctgatttcaaggttataaaattataataattaagacagtgttctactggcataatgatagagaagtaaatcagtggaacagatcagatagccaagaaatagactcacacatgaggacagctagtttgacaaaggtgcaaagtcagtttaatagagaaattgtatcttttcaaccaatgatgctggaacaattggatatccacctgcaaaaagacaaaataactttgaccaattcctcaagctgtattcaaattcattaatgtaaaatgaattagtaacctaatataaatgtaaaactgtgaaactgttagatgaaaacatggtggaaaatctttgtgaccttagattagtcacagaaaggatatgacggcaaaggcacaattcataaaagaaaggtggctaaatggaatgtcatcaaaatttaaaaattccactcttttgaaaggcagtcataagagaataaagaaagcaagccatcagctgataggaaatattcacaaatcatattacgatgaaggacttatatccagaatattcattgcatattctctgtgtattttcaaaaatgaatagtaagaaaacaaccctataaaaatgagcaaaaaagatatacagatatctcctacacacttgaccaaagaagatatatggataataaataaggtcatgaaaacatgctcaacatcattaatcattaggaaaatgaaaattaaaaatcgtaatgagatatcgctacacacctattagaatggttaaattttcttgctttaaaactgatcataccaacttttggcaaaggtaggagaaactgtaattctcatgcactgtgagtgggaagattaatggtacaacccctttaaaaaatgatttggtagattcttaaaaggtgaaacacacaccggccggccatatgatccatccattccactcctaggtatttattcaagaaaaatgaaagcatttgtctccacaaagacttgttcatgaatgtttatagcattggatcatagatagcccaaaccagaaacaatccaagtgacgcctaacaagtgaaggtataagcaaatatacccattcatgttatttatcaataaaaataaatgaacgattgatacctgcaacaatatcaatgaatctcaaaataagtatatggcatgagataagccagacaaaagaatacatcctgtatgtgtccattgacataacaccgtagaatgcaaagaatacctgatagaaggcggatcagtggttacctaaggctggggaggaggggtgggaggaagggattacacagttgtaatttaattacgaatttaaaacttacaagaaattgttgacggtgatgatggtctcactgttgtacacatatgtcaaaattcataaaactctgcattttggcccagtgtggtagctcacgcctgtaatcccagcactttgggaggctgaggcaggtggatcacctgaggtcaggggttccagacctgcctggccaacgtggtgaaacctcatctctattaaaaatacaaaaaacttagccgggcgtggtggcacgcacctatagtcccagctactcaggaggctgaggcaggataattgcttgaaccctagatgcagaggttgcattgagccgagattgcaccactgcactctagcctgggcaacagagagagacctatctaaaaaaaaaaaaaaaaaaaaaaaaaaaaaaaaacaaaaaaaaacctctatattttaaatatgtgtagtttattgtatgtcagttagcccccaataaacctataacttcccaggggaaatggctgagattgatgccaccttcaaagagttaaagaaggcctaggtagtaacccccaccatctctctcgtgatttcccctctctggcctctctgcagactggctgaatcagaatagatgattgcagacctcaaactcaaccaagtagcaacaccaaatgggctgccaggccagatgtggtatcttcgtttaatcttagattaaattagattcatttaatctaagattaaattaacactgcccctggtacccggtatcagtagctacggattctgtgaatgaattctcttccatctcatcaggagagagtgtgagaagcaatttgcattcgcacaggagggacaacagtacacagtcacagttttgccccagggatatgttaattcttctgctctttgtcacagtatagtccaaagggaaaaggccctctggacattccacagattatcacgttagttcactatactgatggcagtctgttaactggatctgacgagcaagcaggggaaagtactctggacgccccaagtaaggcacacgagccaggctgggagataaattccacgaagctttagaggcctgctacatcatgatcttattaccatgaagttattgccataaaatctggcaaatcccatggtacaagaggtatttgcaatggagaaagacaccacacacacagagcccctggagaacttcaaagaagagtcatggcccagactccttgggctctggaagaaggccgtgcagagaacgataccattcagaaagaggttcctgctctcctgtgggaacctctagagaaagagtttctggtcatggacgttaagtgaccatgtggtcagagatgcccatcttgagctaggatctgttaaacccaccaaatcagaaggtcaggcaagcccagcagcatccagtatacatgggaaaagacacctcctgggactgcgaacaagcagagggcaaaagaaagcgacataatccggggatcggaacccccacgtcatctaccagtgttgcactgacacctcttcttcagtccacacctgtggcctcctgcagaggtccctctgaccagccgatggagaaggaaggggcctgagcttcactcattggcaggttagctagaaacgttagtgagcccccaaaggactgctcctgcactgcagcccactcaggtggtggtgatggtggcgatggggtaaccctcccagggggccgagctttgagtgcaggacctggtcgtgcacttgtagggagagaagcgaaccaaatcagtggttctatttctagcagttttaggctctacagggccattcccagagcgggacgcttccaccggaagacgctattaagacagcttccacctggtcacttcgggctcctggtatcaacaatctggcagagagaatgaagttcccatactggcaggggtaactggctgggagcatcatgagaaggtatgaatacagtcatcaatgggggcgggcaggtgacccaccaggggcatctcttggtgctgccatgcacagatcttcccgcaagtagcaagcgccacagtgtgagcatgataaggccatggtgaccacaggctgctcaaggtcccggctatctgacacggatggaggaggaaggggcggtggctatcagtcagggccccaggcaatgaaaatggcaatggcaatggcaggagtaggcactggcgttcatcccactcagcctgttagtgtcaatttcccctggtgttgggaccaatttgatcctggagaagctctcctcaggggagcaaacctcctacacaggtgggctgtgcggggggtgggggtggagtaaggcgtgttgggtcatgggtgctactggtgtcctccccaactccttttatctggaccgtgtgcctatcccccagctgttaagtgttgacaactaatggctcaatgaagagctgtttagctaaagggaagccccacatccgggacgtgtgtgccctgggggacacacagcaaatgactgacaaggaggaacagaaggcagcctcttgcttccagtcctgggagaccatgctgaagccctgcctcctggcttatctgtatctcctgcacaagaattccagcccaggctctgtttctagggagtgtgccctgagatgccagcgcttgagcttcgagagcacgagggggtaggttctggtggacagggaccccggtgtgacgacaactgcaaggttcaccttggaccctggcactatcctcccaccaggctggaaaaggagaccaggacatggccccagcacagcccccaggtgggcaaaccggcaggctgggctggctaagctcttggtgttctttgtgtgggggtaggtggggctggtgagggcgggactggctgcaggtccttcagcgggtccctgctggacctccgtggcggggacagggatgaaattaaaacagacccgactccattcaatctcagcgatccatgactcagtgatgcccggagctgcctccctttctcctccctgggctcccaccccgccgcgccccaccccattatgatcccccccaaaatgcagagagcccactagagggaggaggctgagggctccaggctgccctggtcagacaacacatcatgttccttcacctgcagatagaccctgagcccatcagtgaaacaaggggcccccaggagaatcagaatcctgaccccatcccaccctccacaccagctcaacggactcccaggctgccagaaaggcctcatacgtcaaagtcagcctcccagtcggcctccgtttccaggtgtgggcctggagtgccgtggcccaggtggtatcagaagctcgcagggataggcctaagaggtgaccccaggggagggccaggccaaggagctgcagagagggctggggaagctccagatcccccacctccttcaaaacacacctgaaacaccagccagcaccagcaccaccaagatgagaaagggccctggaccgtctccaccagtgtcatgcagcagctgggctggtcccctcccttgggtccccatctgccccacttgtacaggagctaacgacgcctgctgcccacccaggaggacctagcaggagcccagtgtgaaggtgtttgcaaaactctggggaaagtgaaggtcagaggtgactcccagcttccacttaggacatagagagctggaaagagcccggctcccatccttaaactgcagcagcaacaaaaggcaccaagcaacctgaaaagtcaggacttttctcaaaactctctgagagctgaggtcacagggcaaccaactaacccaaaacaaagggaaggcaggcgcctgcaggaggagacgggatgcaggctgtcaccgagacagacgaggccagacaccaggaagaagaacacagccaaaatgtttaatgagttggcaagggtcggtgtggggtaatgggagagcacagaagccccaggggctgcggagtgaagggaaatccacatccactggaaggtccccgtggatttcacgggatgctctctttgtggtgtaggcccagcagaggggaacagcagccactgtcccaaaggtacaaaacctacataggttattctcctcaatggaacaaaacccttagattgctggaggaaaggcaaaaaaggcaaaaaacactgtcacacttagggcacgagtagaaaccatcgaaactgggggaatcctaaaagccctgtgccctggggagggataagctacatggtgggcccagagctacagctgagcgtagggcaggagtcccaagaatgcttcacccacaagacccaaaggacatagggttaatcagaaaaaaccgaacagccccccacctccagcacctgctgacaagcaccatgtaacaagtgaccctggagtgggagaggccgcagagtgtggcctgggagagtctgcggagtgtggaaaccctctccaaggtaagcttatagccgaaggctggttggacactgggaaaagcctctctatggtaaacacaaagtagtgctggagggatttgatgactgtggtgctccagagataaccatgacaacaccaaactgaaacccagctcaactctggacgagattagccccaagccccgcagtaaaggaacagcaaaaagaagggtatgcccatttccaaaagcacaaaacgaatttcttcagtctctactgtcctctgcacgatgtctggatttcaaaaaattgatgaggcctattaaaaaaataaataaataggccagggtctgtggctcacgcctgtaatcccagcactttgggaggccgaggcaggtggatcacgagttcaagagatcgagaccatcctggccaatatggtgaaaccccatctctactaaaaatacaaaaattagccgggtgtggtggcacacgcctgtagtcccagctacttgggaggctgaggcaggagaatcgcttgaacccgggagacagaggttgcagtgagccgagatcgcgccactgcgctccagcctgggcaacaagtgagactccgtctcgaaaaataaataaataaataaataataaataatagatgaatagataacgtgctatcaagacaaagcaagcaaaataatcagactgaaaggctggtctcagtggctcacacctggaatcccagcactttgggagactgaggtgggaggatcgcttgagcccaagagtttgagaccagcctgggcaacacagagagacctacctctacaaaaaataaaaataaaaaaatcaactgtgcatggtggtgcccacctgtggttccagctactcgggaggctgaagcaggagaatcacttgagcccaggaggtcaagcctgcagtgagttaagattgtacttctctactccggcccggggcagcagagtgaggccttgtctcaaaataataatgataaaaaaagaaacagactcagatatgacacagccgtcggaactgtcagacaggacattttaaatacaataaatatgctaaagactctaaggaccctaatggagaagggggaaaatatgcaagctcagataggtcacttcagcaaagagatggaaactagaagaagaaatcaaatggaaaagctaaaataaaaaacagtaacagccatgagaagaagcctctggtgggctcatgaatgtacttgacacagcaggacagggtccctgaacttgaacacaggtcagtaaaaaatacctaaaatgcagaggaaaaaatattgaaaagggggaaaaaaatcccaaatccttcaagaagtgtgggacatattaagtgatctaacatatgtgtgaatggaatctcagaaagaaaagatagaaaacacagtgaaaaagacagagttgaagaaataatgggtaagaattttataaaatcattgacaaacaataagccacatggccaagttcagagaataccaagcaagataagtaccacattttttttttttttttgagacatagtttcgctcttgtcgcccaggctggagtgcaatggtgtgatctcggctcactgcaacctctgcctcctgggtccaagtgattctcctgcctcagcctcccaagtagctgggattacaggtgcctgctaccaggcccggagtagagacagagtttcaccatgttggccaggctggtctggaacccctgacctcaggtgatccacccacctcagcctcccaaaggctgggattacaggtgtgagccactgtgcccggccggtaagtaccattttttaaaaactgaaggcatatcacatttaaactgctgaaaacccaagacaaaagcgaaaatcttgaaagcaaccagagaatacaggtacattccatagagacacaagaaaaacagaaatatggtagcagacttctaaacttctcgtcagaaacaaagtcagccagggatgaaagaaaaacaacaacaaaaaaactgttgattcagaattctatatccggtacaaatatctttcagaaaaaaaggagaaataaagtctttctcagacaaacaaaaactgtagaatttgttactgaaagaccttcactataagaaatgttaaaggaagttcttcaggcaaaaacatgataccagacagagacttggatctacacaaagaagcaaagtgcactagaaatggaataaatgaaagtacaaatagaatttctttctttctcatttttaattgctctaaaagataactgactaaagaaaaaattgtggtcacgtattatatgtctatagtataatgtaaaatagaatgtatgacaataatagcacaaacagtgggaggaaggaattgagaatatgcagttgtaaatttattatataacacacagagcaaggtaatatcatttggtagacaatgattatttaaagatgtatattataaaacctaagacaactattaatttaaaaaataagatataaatgataagccaatagtggaaactaaatggaatcataaaaagtactcagttaatccaaaagaaggcagaaaagggagtggggggacaacagacggaataaatagaaaagagttagcaagatggtaaattaaatccaagcatatggccagaagcagtggctcgggcatgtaatcccaacattttaggaggctaaggtgggaggattccttaagcccaggagttcagaggctataatgagctatgatcataccaccgcactccagcctgggcaacagaatgagatcccatctctaaaaaaagaaaaacactccaaatacataaataaataattatattaatctcaacacaccaatgaaaagagatgatcaatttgaataaacaaaagacccaactatatgctatctatatgaaacccactttaaatataaagacataaataaggttaaagtaaaaggatggaaaatatgtgacacagaagcatgcgtcaaaataaagatgcagcagctacattcatctcagacaaagtaggcttcagaacaaggactattacaagggataagtgagacctcacataacaataaaggagttgcattttctgagaaaacaatcctcagtgtgtaggcacctaccaacaaaggctgaaaacacagaaagcaaaaaatgataaaataaaatgtaacactcattcatgatttttaaaaaactgtcaacaaacaaggaatgtaagagaactgaacctaataaaaggcgaagctgaaatacaaaaaaaaaaaaaaaaaaagctaacatactaaatggtgaaaggctgagtacccctaagattgtaaagaaggtatgatatcccctctcacacttctttttttttttttttgagagtctcgctctgtcgcccaggctggagtgcagtggcgcgatctcggctcactgcaagctccgcctcctgggttcacgccattctcctgcctcagcctcccaagtagctgggactacaggcgcccaccaccacgcctggctaattttttttgtatttttttagtagagacggggtttcaccatgttagccaggatggtcttgatctcctgacctcatgatctgcccgcctcggccttccaaagtgccgggattacaggcgtgagccactgcacccgggcccctctcacacttctattccatattttacaggaaggcctagccaagatattaaggcaagaaaaagaaagaaatggtatacaaatttgaaaggcagaaataaaactaagtcaattcacaatgacatgaatgttgcatagaaaattccccaaacaactagagaaaactcctcaaatgaacaggagagttgagcaagatctcagtataaagtcaatatacaaaagtgagttgtattaatatttctgtttgctagcaacaaacaattagaattttacattttcaaaatagatccacttataataatgctccccatatgaaaaacttgggcacagatgtaacaaaaaaagtattctgatctaaacgaacagaaaaatatactatgttcatggattagatgagtcaatattattaagatgtcagttctccccacgttgatctagatattcatacatcccaataattttcccagcagaatgttttgtagatgttgacaagttgattcaaaaattcatatggaaattaaaatgctctaggatagtcaaaataatttaggaaaattattttctggtcactatctgatttcactgatatgttactatatatttactatttactacctgatttgactataaagctatagcaatcaagacactgaggtattggtgaaggcgtagactcagctcagtgggattgaatagagagcccagaagtggatccatataaatatagtcaagtcaattttggcaaagatgcaaagggaaatcagtagagaaagggcagccttttcaacaaacggaactggatctattggatgtccatatgcaaaaaatgaacctggacacacatatctcacaccttacacaaaaattaactctaaatgaatcatagaccttaacgtaaaatatacaactataaaacttctagaagaaaacagagaaaatctttgtgcccttaggaaagccagggtcttcagcctcggtactgttgccatttggggatgtagctcctgtgtgggggctggtctgtgcaccagggaggtttagcagcggtgtgctccagttgtgacaactaacaatgtccccagacactgcccaatgtcctctgggggcaaaacaggcctgaattgagaagagaaagttctcagctgtgacgtggaagcataacccataacaggaaaaaaaaaagttaatacacgggactttgttaaatgtaaaacttttcttctgtaaatggccatgttaagatattgaaaagacaaaccacaggctgggaaaaaatatttgcaattacattatcagatgcagaatttgtattcagaatacacaaagaactcgaaactcaacaatcagaaaacaaacagcccaattaaaaaaatcggcaaagggcttgacagacatgtcaccaaagaagggaggcagatggcaaagaagccccaaaagatgtgccacagggttcgtttcagggaaatgcaaaccgcaagagacctgtgtgctcctgcgtgctcccgtgtgctcctgcttactcctgtgtgctcccgtgtgctcctgtgtactcctgctgcgaagggtaaaatgaagcaaaacagcgaaaactcacagcacacaacctagtgccagcgaggatggggagcaagtgggcctcacgccctgctgcagagtgcactatggcacagcccctgtgtgtgcctggggggcctgtgggtgacagggggacaaagaagaggttggcagagatggcagagcagcctcctggtgctggacttcctcacccagccaggatggcctgggcctgcaccagtgctgcctgagacagcgagtctcaacctgctccaggggcgtgtgcgtttctgcgtgtgtgtgtgtgtgtgtgtccatgcatgtgtctctatgaatatatgtgctgtatttgcatgtgtgtgtgtgtctatgtgtgcatatgtctgtgtctgtgtgtctttctgtgtgtgcggtctgtgtctgtgggtctacacgtgtatatgtgcatgtgtctgtgtgtgtcgcagtgtgttactgtgtctgcgcgtgtgtgcatgcatatgtgcaggagggagggagggctcaggccttagcagagtccctggggctctgggagtggagggcagtgaggctgaggctggtgcaaaggtggtttcaggcgctcaggtgaagtggagcagaaacagaagttggaatccagccccagcgggcgggcggcagcagcagtgccggccctgcccagaacaggttcgacctgagccggcactgcccggctgccctggggctagggaggctgagacagagaagggaagccagagggtgggggtgggggcccggcactggcagagctgcctgccctcaacgaccgcccctgccggagacccccgccccacccgctgtggttctgctggcccaggtttcgctgggcccactcccagggtttggcatcactggagcccagggtcccccccgcaccctccccacagccttggccctgctgctgcctgcctcctccagggtaccccgaggcccacgtcaggagacccgcctcaggcagcagtggcccggtggctgcttctgcctagcccgcagcacgtgccaccctgggcgcactgccttcccgaaggctctcctccctccccggggcgctccctcccactctggaatgcctccctgcctgcacagcaggagtgtttggctgaggtctgcagccccgacacaggtcacctcccacgcctatgggggcttcagaaagtcccggaatcggccgggcgccctggctcatgcctgtaatcccagcactttgggaggccgaggcgggcggatgatgaggtgaggagatcgagaccatcctggctaacacagtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcactccagcctgggagacagagtgagactccgtctcaaaaaaaaaaaaaaaaaaaaaaagaaagtcccagaatcccagacatctaacaggatggggtcccagagaccctccacccacccatctccctgacttccacacaggcagggatgaaggactgagggagagtgggagagggtaactgtggcggtcacgaagggtcctcaggtccccgtccttatcccaagccccatccaggccagaaccgcggagtgggtgtgcagagcactcaggcagcctgtgaatccccacagccacttccctaccctgagacctcagagaatgacctggcctctgtctttctgtttcattttatttatttttatctccagcttgtttgtgaagttcaggggtaccagtgcaggatgtgcaggatccttgtcacaagcatccttctcacgaccctgcctcactccaaaaggggtatcaggtaggtgagcagaaacgccccttcctgaatgcctgtccttgtcccaccacaaggatgaggatgcctgctcagagggcacagggagaagccaatggcatagggtgcacagcagcgagggccaagggacaaggagtggggggcccccacctgcccagcgtgacctgctgaccacagctcctcagcggcgggacaaagcctgcccatggggccctcagtggccaccctggatgcaaacacggttaatggtcaggcccagcctgtcccctcctgcgcacaaactcagggcagagcagagagcttacatccaccaagacccagacaaaagaaagccccaagaacacccttaaaggcagccaaaccctggagctgcctcgggcccatcgatgggagcacaagaggtgaatcctgctacgggcaccgtggccgtctacgcgaccgcagcaaagaggaacatggacgactcacagacgcagagacggggggtccatgctgtgtggtgatgttcacctgcagctcagggacaaaccctacctacggtgacagatgtcaggaggggtgaagggtgagggagggagggcctgttagctggagcgggtctcagggatgcctgctgctgctgctggaaacattctgcacaggggttcgggtggaggttctgggagtgtcacccgtgcacacttgtcagcatgctctccaggtcctgcatttgaggtgcctgtaccccagtggaaagatgacggacagagctgctcaaccactgccctggaccgcattctgcagggtgccttagaaggcccaggaggaaaggggactccaggctgggcaccggtggtccacaggcttccagagcagcccagcttggccgttgtgtcccagtcactgggagctaacgaggacgcaccctcatgggggtatgtgcccacccagtcccctccgtagagagcctgggagcctctgtgatagggcgtcctggcccagggctcccaaggccaagtatgaagtctcattcccccagacaaccttcacctccaggctgcataacctctactgacccctctcaatcccacctcttctttttgtccatgaaggcagtcgggaaatgcagcctgtgcttcggagaggcgggcagggctggggtcacccccgccccaggcagtgggataggagatgcgccagggtcaggtcccttgctgcaagcctgcaacccgtgcctgtatgtgccagccgggcctgccaatccatccttcaccctgcaggaccctcccgtctacaggtcccagctctgtgtgggcctggccagccctggggccatggctgagacctgagtcctcaaaggactgccccttctgagagcagaatcctgctgcccccagaagaccaggtgttcaacctgagccctgatcctaaaacccatggtcctctctctcctccagaatccctctgccagcctccaagagccgcctgctgctctcctggtgcttctcacacccctgggggatggcaggggggcggggagcccagcagaaattggagcagagaggacatggagggctgaggggtgagggggcagaccgaatgtatcctctctgcccatgcgtcttcccccaggatgctacctgaggtctcgggagaggggcatctgggaaggcttcctggaggaagatgagtgcctctctctcatgagggaggggctccagggaggtcagtgtgaacttgtgttggcacaaaggcagccctggccgagggggcgaaggcagtgtgaagtgggactcacttcccccaaagatgcagagggatgtcgggagacctggcaggcggccctgggcagttcagttgaccccaccttaccctaccaggctgcaggaagcccctgcccccacctggagccgctacgggttttcctagctcagccctaaaggctcagcccgactagatacaggccaactagagaggtcatgtcagggctgagggggtggctgccaggggtggctgctgtggggaagagcatcccagcccgcaggccctgctaccccaggcagagctgcccgttgtgtcccgcacgaagagctttccctgcctgggaatcccgctctgccccccaccagccagtggctttggaagttcgtccagcaaccctggagtctcagtttccatgcctgtaatatgggcacagcactcactccaggatgaacagaagccgggccaggaaagcagtccctggcctggcaccacagcaggggctgtgagggggatggttccacagttgctggaggtcgacagggaccgaagcacacatgagtgccagatgggccccacgatgggattccggcgagggtggtgcagggagccacctatacagaggacaattgactgcagaagtgccaggctcatgccctccacggatggagaggccgtcacctccgggggatgccccagggccgcatacccgtgcagtggcgctggagtggcagtgggcgcctgccccacactaatgcacacacacatcagtgcacacccacagccacgccagagaaagccacaggccctgaggggctgccccatgccagcctgccagctgccacacccctcccacaaagcctggctctggcccgggacacagggagcccagacccatccagctttcccctcaatgccccgggtcctcccacaaattcatcctgcctcaagcctcagtctccacttccgacaaatgggtctcaagctctctgctctgtccaccctgcatggcggtgtgggcagcacagagccagcctggtgggggctggggactctggaaggggtgctcagggaggggccgggctctggggcccagaaggccttggaaggtagtccaggcgggtcccggaacaagtgttgcatgagcaccaaatggctcagagctcccgaaacctggcgtgcctgtgagagccgttgagaccccttttcaaggccctgcctgacagcccacaaaagacattcaaatgagagacaaatatttggggccccaaggttgagcccagcccagcctctcaggcccagcccaagctgctcccaggctctcatttgggtattaattgcatttcgtttagagatttgcatgcttatcacgcgggtggtggccagccgtgggggcctggccagcctggacagaatcccaaggctcgtaggcaaatgccaggaggagggggtgggcagaggacccaggagcctcccgaatggtatcaggagagcaagcctgggctaggctgcgggccatcagcgtgggccctgggccacgacctggcatccatgtggacctgagcacgacaacaggacaagcagagaaaaaagtggatcccaaaaacagggctcccaggccaacttctccctaacaccagctcccagcaccccaccggggactgcagcccctccatggtcaatcagggtagccctggggtccctgtcacatgacgtatgcccaccctccgacagccctgcagcctgtgggacggcccgtgtgctcgccgaggcgcttggaaccttggagggcaggctctcagaagattggctcagggaccctctggtccaccctctcggcatcccagggtgtcctggtcccaggagatgcctcatcccaggccacacggggccctaggcctttccgtcctcagccctgtctactctaccctctacaagagaggtccagaaggggcagtgcttgacccaagaagaagaggctgtaactatggagaggttgggagggggaagtggccctaagggctggagttttagaaagccctcttgttcctgcccattatgggttggattttatgccctccagactcacatgtggctgtttttggagccagggcctttaaagaggtaattaagttaaagtgaggtcattggggggaccctaatcccatgtgaccgatatccttagtaagaggaggtgaagacacagacacgcacagagggatggccacgtgaagacacagggagaaggcagcgtctacaagccaaggagagaggccttcggaggtggggggcctgcggaatggtgagagactaatttctgctgtgtaggccccctagtgtgcggggctttttcacgcagcacaggccaacccattgcagcctctcctgctgttaggaccccaagtccatcctcagggacattaattaacataggaactttttatcctgatggtgtcacctcctaggcagaacagggacccggaggcaggcctagctgcgaacccccagccctccctgtccttctcgcaggacagcgggtctggggctgaaggctgtgacgctgcccctgcctggatcacaacaggcaggacggctgagcaggcacacatctgtctctccctctgctgatctgtggccttggacaggggctactctgggggagctgacaggtgacccccccaggaggcccctccctgcctctgggctgggaatccacctctgtggagcccctgggaatggcctgtttcaaatacgtaagtgggagcaaggtctcatcctcagcgggggacatcgctgggggcaaggccagtgggtgggtgggaaggtttctgtggcactggggcctcctgttgattgattcacccaattaatcacagccagcagctggggagggggtaggaaggcggtgaagggaaaaggagcccacagccgggaggccctgggaggttggcagaggcctgcacctgcctgcagccagccctccggcccagccctcttccctcctttcggaggggccagagcatggggtgctaagggctcagtctttaacccctccccagctctcagggagcccctcccatgctccccaggcctctgccccacttgcacctccccgggccccagggcacaggacgctttccccaccctttgggaggctgagggtgtcaggaggcctgggctgagtgctggcttccgtctcactggcttgcagacaagaccctccatttcggtggaaaaacagcaagaacagcacccccctccaggcagacccaagggaggcatcggtgtgagggcttcaagctctgtactgtgggtttaagccttgcacctctggatacctgtgggcctcgggcagatcactgagcctccctgcatctggaagtcggggtgagacccctcagagggggctgggaggaggaagggcccctcttgatgggcagcccccaccctccacctactgccctgccctcccagccttcagggtcctccccagcttctgtgggctcccaggtggacctgggccacccctgagaccccgaagagctcaaggccagctaatagcccacaggctcaggacagcactggacaggcctctgggcccacctggccccactcccgatttttatgggaacaaagactgaaggtgtggccccaaaggaaccacccctcccccagtgccccgctgctgggaaaagggtcagcagagtttgggtctccccccacaagccctctgggctgtgcgtgctacagctgaggacatggcgttgaggggcaggccgcctccaaccccgtccaccttgccctgtctagctctgtccaaggctctctccggctggctaatcacctctgggcacagctgtgctgctgaggtctctgggatgactgaaggtctttgaaggccactttgggagaagcgaaggtgcatggacaccagggaccctgctcacagcgagtgtccctgccccatccctttctgcattgagtgggacaagcttgcttccatttgggggatcgccatctgactattccacttgtcttagggtggggcagagattaggtgatgtggaggggcttctctacatggcccccctgccccagctctgaggggtagcaccagagtgggtttcaccagcgtagggcacgtaggccccgccatgaacagggccccaaccttggtttaatgctttgctactgccatcttaaagttctttttttattttttattttgctttattttttattagagatggggtctcccagtgttgcccaggctggtcttgaactcctggctcaagcaatcctccggcctcagcctcccaaagcactgggatgacacgtgtgagccaccttgcctggcctttggaatctgactacttttatcttctaacttgttttgcaggtgcaggccaacggcatacagcagcactcacataagcaaaggagagcgtgcacaaggcgccaaatgtatatccaccctcactcgtccccccacttgagtagcgcatccacgatgcccacagacaccaggccacacagaaaaggtgccagggacccacagcagtgcaaggcagcgtgtcacacctacgcatgagcaagccgggcgctgatggccaccgagcagccacgttttccattcaaatccgcacttgctaaggatgcagcaggaagccagtggtgttctaacaaacgtgcaggacccgggaacctgtcatgtcctttcttacttgtgcgacttctctgtgttagccgaggtctcttgctgatggatctacccacagtgccttttgtctttgaacttgtcccttccctccttcctcgcccatcagcgagcaggaggtggagggtgctggtggaacaagcctgcgtcaaggagtgaaatcagctgatttcatttttgtgcagtttccactgttctagtagcaaatgaaatagagacgcctgtgccaggacaaaacacacactgtgtcattccagtgattccgcatagaagttaaatgctcttatgcttgcattttaaactggcatcacataatataaagatggataactacattcacgctagtcacttaaattcctaatctttcttactcagaatggcattaaatagtgagtataaaataagaagtataaaatagtaagtcaagaggttgactatagaagaaagaaaaatgctttatattttagcaccttgaacatgacatcacgatcaccttctccctggaatcagtttctaacttccaggtggggactaggcctggaccatgagctcctagcagagccctgctgcccccacagcagagcccaggacaggctggcacctgggccaggtgaggctctgtccaggctcactgatctcaaatgctgaactgctaaggatgtcatgtccccaaaggagccgccaggctcagcctcacttcctggaaggcgtgaacattgcaagaatgtggaagtgaaagagtccagggcttaaatctcaattctcatcattttcaagctgagtccaagggagagaagacagtcatggattcttagtttctgtttctggttgagccagcagggtcccttcctcatccctcttttctgcttatcactagagacagaaactaaaaccatgactttaggctgctgagagcctaaaacaaaacgacagcaagagaaggtgggttggaccagcttgcctgtgacttcaggcacttcatctttactgggcactgggtgaatgacagtgtggggaggggtcttcataacacggcaatcagcagcccactgtgcccaggagactcgcctgtggtcctggttatcaaccacagccctttccagtctcaaaaatgtccccgctgggacagcaagttacatcgtcgctacaagtcctgtctcctgggagatgcagtccagcagcactacatcctctgagcagcaggtgccaagtgggatgaactggataaggactgcattcggggaaacgcccgtgtgaaaggaaatacacaggaaggaggtggcaacgggtgggaagccactagaccacgacgcgattctgccccagtgaaggcgaggggatagcctgggcctagatcgctgtgaggtctatggaagtttccacaagcttgctgggtagttctcgaggcaaactcggaaagggagtcccttgtctccctggaacggatctttcttggcatctctgtcacactcattaggtgggcctggtgtcaaccccatttgcaggccaccccaaacttgatcaaaggtccgcttctggcaccccataccctgtcctacaggaaatacagggacaggctcccaataacaacacccagcacggtgccatcaacaccaccacgcacacgggggctcaacggaacagacatctccgcttcttcaatgaagacactggagggaaattgcttacaaggcgcttaagagacctattaagcaaacttgatgtgtggacctgcggcggatcccgattctataaggccaactgcacaaaaccacgagaccccctgaggactgcgccattggctgggtccccgatgatatgaaagaacggtggttcatttgagcgggtgatgtttttgcggtttcctttagaggcacacgtgaaacatgacgggtgaaaggattcaaagtctgggatttgcttcaaagcaacgcagggatggcgtgggggatggatggggcaggaagggccttgaaactggtgctggaggcttcccagggctgccctggagcccagtgcgtcctccaccggccagactgtacaacggttggatcctgtgtccactgctaggacccaggctccacgagcacgggcttgtgtggcacacggatgcaccctaagtcctggcacagagactgctcaacaaaggcctcggtgcttttgtgtatgtttgaaattttccataataaaatgaaaaatgggaaaatgggaaaacaaaaatggcagcactacttaccctctgcagagttttgtccgcttcacgccagtgggtggcagtcgtttcctctgccctggccttccatcgtttcccccctaccctcttcacccacccaacagccccctgtggtcctggcagctgtgggcctttccttgaggtcaaggtgtggagtcctggggagggctcagggaggccaccgacccgggtgtggattctgggagaagcctgtgggatgtccctccctgggtgaccacggcaatgtgccccctcctgtcccttggccaaggccagttccctgagccctgcagccccaagccacagctggtccactgaccccagttgagcctggtcctcatcagaccagctgacccctttgacccccgctacagactcggctttgaccttggctgctgaggagcccccacctggactgaggctgcagctggcgagagaggagccctgagctcctctgataagaagggacctggccagcctgacgtttgagacccaggcatcccggtagcctgggtgtcctgttgccgtggttattcaggagccacccactctgggacaacaccagctgctcccacctcgcagggctcccacggctctgtcccaaccactcctttctgaaggaaggggtgcctctgcgccctaaagaaaccgggggagccccacaacccctcccccaccaggacactaaaaggcagctttcggtacagtgagacatcaaagcctcctaggccctgagtcaaaggtatagccgtgtaatatcccagtgccagctctccggctgcggggagcctggcgca

SEQ ID NO: 28 - DNA, 197073 bp, Artificial Sequence
  Synthetic BAC sequence
gcttcttgatgtgctgctggattcggtttgccagtattttcttgaggatttttgcatcaatgttcatcagggatattggtctaaaattctctttttttgttgtatctctgcccggctttggtatcaggaagatgctggcctcataaaatgagttagggaggattccctctttttctattgattggaatagtttcagaaggaatggtaccagctcctccttgtacctctggtagaattcagctgtgaatccatctggtcctggactttttttggttggtaagctattaattattacctcaatttcagagcctgttattcgtctattcagagattcaacttcttcctgatttagttttgggagggtgtatgtgtccatgaatttatccatttcttctagattttctagtttatttgcgtagaggtgtttgtagcattctctgatggtagtttgtatttctgtgggattggtggtgatatcccctttatcattttttatgcatctatttgattcttctctcttttcttctttattagtcttgctagcagtctgtcaattttgttgatcttttcaaaaaaccagctcctggattcattgattttttgaagggttttttttgtctcttatttccttcagttctgctctgatcttagttatttcttgccatctgctagcttttgaatgtgtttgctcttgcttctctagttcttttaattgtgatattagggtgtcagttttagatctttcctgctttctcttgtgggcatttagtgctgtaaatttccctctacacactgctttgaatgtctcccagaaattctggtatgttgtgtctttgttctcattggtttcaaagaacatctttatttctgccttcattttgttatgtacccagtagtcattcaggagcaggttgttcaggttccatgtagttgagtggttttgagtgagtttcttaatcctgagttctagtttgattgcactgtggtctgagagacagtttgttataatttctgttctttaacatttgctgaggagtgctttacttccaactatgtgatcaattttggaataagtgcggtgtggtgctgagaagactgtatattctgttgatttgggttggagagttctatagatgtctgttaggtccacttggtgcagagctgagttcaattcctggatatccttgttaactttctgtctcgatctgtctaatgttgacagtggggtgttaaagtgtcccattattattgtgtgagagtctaagtctctttgtaggtctctaaggacttgctttatgaatctgggtgctcctgtattgggtgcatatatatttaggatagttagctcttcttgttgtattgatccctttaccattatgtaatggccttctttgtctcttttgttcttttttggtttaaagtctgttttatcagagactaggattgcaacccctgcctttttttgttttccatttgcttggtagatcttcctccatccctttattttgagcctatgtgtggctctgcacatgagctgggtctcctgaatacagcacactgatgggtcttgactctttatccagtttgccagtctttgtcttttaattggagcatttagcccatttacatttaaggttaatattgttatgtgtgaatttgatcctgtcattatgatgttggctggttattttgctcgttagttgatgcagtttcttcctagccttgatggtctttacaatttggcatgtttttgcagtggctggtaccggttattcctttccatgtttattgcttccttcaggagctcttttagggaaggcctggtggtgacaaaatgtctcagcatttgcttgtctgtaaagtattttatttctccttcacttttgaagcttagtttggctggatatgaaattctgggttgcagattcttttctttaagaatgttgaatattggcccccactctcttctgacttgtagagtttctgccgagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctctttcctgaatttgaatgttggcctgccttgctagattgaagttctcatggataatatcctgcagagtgttttccaactttcttccattctccctgtcactttcaggtacaccaatcagatgtagatatggtcttttcacatagtcccatatttcttggaggctttgttcgtttctttttattcttttttctcgaaacttctcttcacatttcatttcattcatttcatcttccatcagtgataccctttcttccagttgattgaatcggctactgaggcttgtgcattcatcctgtagttctcatgccttggttttcagctccatcaggtcctttaaggacttctctgcattggttattctagttagccattcgtctaattttttttcaaggtttttaacttctttgccatggctttgtattcctcctttagctctgagtagtttgatcatctgatgccttcttctctcaactcgtcaaagtcattctccgtccagctttgttccattgctggtgaggagctgcgttcctttggacgaggagtggcactctgatttttagagtttccagtatttctgccctgttttttccccatttttgtggttttatctacctttggtctttgatgatggtgacgtacagatggggttttggtgtggatgtcctttatgtttgttagttttccttctaacagtcagcaccctcagctgcaggtctgttggagtttgctggaggtccactccagaccttgtttgcctgggtatcagcagcggaggctgcagaacagcagatattggtgaacagcagatattgctacctgatcgttcctctggaagttttgtctcagaggagtacctggctgtgtgaggtgtcagtctgcccctactgggggtgcctcccagttaggctccttgggggtcagggacccgcttgaggaggcagtctgtcccttctcagatgtctggctgcgtgctgggagaaccactactctcttcaaggctgtcagacagggacatttaagtctgcagaggattctgctgccttttgtttgtctgtgccctgcccccagaggtggagtctacagaggcaggcaggcctccctgagatgcggtgggctccacccagttcgagcttcctggccgctttgtttacctaagcaagcctaggcaatggcaggtgcccctcccctagcttcgctgctgccttgcagtttgatctcagactgctgtgctagcaatgagcgaggctccatgggggtaggaccctttgagccaggtgtgggatataatctcctggtgtgccctttgctaagaccattggaaaagtgcagtattatggtgggagtgacccgattttccaggtgccgtctgtcacccctttctttgactaggaaagggaattccctgaccccttgcgcttcccaggtgaggcgatgcctggccgtgcttcagctcacgctcagtgtgctgcaccaagtgtcctgcacccagtttctgacactccccagtgagatgaacccggcacctcagttggaaatgcagaaatcagccgtcttctgcgtcacttatgctgggagctgtagactggagctgttcctatttggccatcttggctccagccctgattaagcttattttcaaagaagaaacctgatttatgaaaatgagcagatataatttttcatatcaagaatataaagtaaatagatttagcagtataattatgaaatcattgtttttacctctcagacctctttagaggatcttggagactctgggaaagacttactttgtcataaagtgtcagtttgttccagaacattgaaaaagcacaatgaaagacaaaatgggaactgagttcacctgtagatgtagaatagggtccagacatttatatttttacagaatgccatgtgtaagtctgatgtacatccctagtgaagaaccactgaagaagatgttagattcaagttaggaaagaggtaaggttagagacgttttaaaaagtgaaattatgactggcaacactgtactattgcatcaggcagcataccttcaagactttgataaatatagggaaactctatagaattactttatagaattttgagcagtgtttctcctgagggtaaaagtatactttggatggtgagagaacttacaaatcatgagggactcccgtaaagcatacacacacacacacaaaaaatagaggccgagtatcacttatccaaaatacttgagaccagaagtgcttcatattttttttttctttttttggagacggagtttcgctcttgtcgcccaggctagagtgtgactgcgtgatcttggctcactgcagcctctgtctcctgggttcaagcgattctcctccctcagcctccccagtagctgggatttcaggcacctgccatcacgcctggctaatttttgtatttttagtagagatggggtttcaccacattggccaggctggtctagaactcctgacctcaggtgatccgcccgccttggcctcccaaagtgctggaattacaggtatgagccaccatgcctagccatgtttcggattttttttaattaacttttggaatatttgcagtacgtttatcacttgatcatccctaatccaaaactctgaaatgctccagtgagcatttcctttgagcatcatgtcagtactcaaagagtttgggattttggattttcaaattaggaatgctcaacgtgtattaacattttatctattctctttaatcttggaaaagtgtagtcttttctggtttgacaactcttaccatacaactcttaaatagtaatacatctaaaaaaaataatttctagaatcccttcctttataatgaaataataaacctttgtgcttttcctggggctctctctgagaaatctcaaaagttttctgggtgaatttcttcttctaaatttttaatttgatcttaaaaagacaaaaggagttgtcagaggagagttgaatatttgattagtgtaggattcgtgggtatcagaaaaactatttggttatcaatttaattgaagtgacaaaacatttagaagtaaacatagaaagtgacatggttgtaaataaccacagctctttcataaatagggaaccttttctctttagtctttttttcttctttttttcccttctttagtctttttttttttttaaacagacctaataaagtcaacagaatctctgctgtctaggctgattacaaggaaggtaaagaataactttttatccagtgtaatggctctgaggaaaaaaaactctcataagcgaaagcattaaacagtaaattaagaaagtaattccatacaaactgagtgacctttgctagaatattaacaccttttatagcttattttaacccaagtgttttaaatcaaagcagataaaattcagtttccaagttttatctttcattgtgctttttcagttttctggaacaaactgacattttaggacaaaatgtgtctcccccaggttctctaagatcccctaattgggtctgcaaggtaaaaataattttcatgattatactaagaattatttattttaatatgcaaatattgttcaaataaagattatcttggtgttaatttttaatatggtaaatatcaaaacacacaagaaaaactccaggattgtcagtgttttatgagtttaaaggtaacactgaccaaaatgtttgaaagccactaaactactttttttccttgaagcaaaagcaattacagtttttatttctgtcactgttattcctagtgtagttgcaaccacttatgttaattatatcttttaatcatagtaacttctatttcataaaggaaattgggagcagggagatgggaaactgggagatgtcatacacaagcattgtctactgttttcagttacctgaagattttggaaattatcttcaagatgatgtttttcaaaacataaatactgttgaataaatgactaaatttagttgaacacagatttccgttttcatactcttaaacatcatgaaggaataatactagcttatttggctagtaaacctctatacattaggaaaaacaaacccaagtagagtaagtgtattaagctttacactgataatagggagaagatgttttggttttttttaaactaaaggtattagtctcatttaccaaagatttcacttaattatgtaaacttggattcttaaaatgattctgattcttgtaatacgttttttcaaaagtttaatatagtttaaagtatatttttcaaaagtgcaagttcaatttctttactttctgagattttaggaatatttaccttgataacatttctcttttattcatctttataaacaaatttgaatagaattcctttaagagactttgtaatttaatgtgttaatacttccgtaggggccgggcgcggtggttcacgcctgtaatcccagcactttgggaggccgaggcgggcggatcacgaggttaggagattgagaccatcctggctaacacggtgaaaccccgtctctactaaaaatacaaaaaaaaattagctgggtgtggtggcaggtgcctgtagtcccagctactcaggaggctgaggcaggagaatggcgtgaacccgggaggcggaggttgcagtgagccgagattgtgccactgcactccagcaagccgagattgcgccactgcactccagcctgggcaacagagcgagactgcgtctcaaaaaaaaaaaaatgcatttctcagaggcttagacttgtctttcactcttccttaagctcttttcctagatacctgcacagttcactatctttatatctttactaagataccatctaattggggtatctaaagtaggcctgtctaataagcctgtcttaaagtatctaaagtaatcatctctggaccctttatcttgctgattttttcctttttagtactaaatgcgtaatatttatttgcctccccatagtgaaagcaggggcttttatttccgcatttccaacagaaacatgacaggcatctagtaggcactaaatgtttgctgaataaatgaatgaagtgagattacagagaaatggggagagagattatgaacagtaatacatttttatatgctttaaagctataaattatctttcttctccaacattttatagggaaattccctgtgtgggaaaatctccggcccatgcttgaatttctaccggttaaatattttaaggagtaaatattccttaacaagttaagaccctgggataaggttgtcatttaattttttaatatgtaagatattttgggaatgaagggatttgaattagagataatgtttggaacactaattatatagagttaagcagccccaggtcagatgccactattgtaaacacctcaggcaatcatgggagaatgaaagattggattatcttgagaggtagacagcaaaaaacatttatagagcgagggaaatggaggggaggaaaggactgagacaattttatattactaagagttggcaggcagatatgatttacctttccctaaggttctacttcttgtgttggcctgggaggaggaaagagaagctaattttttaaatccctcaactaggaaaacagtcctgtgtctttgacatccattctggaattagagtccctcttatgtaccaggcttggctgtggtgctggtagtaaatacagtggtggacaaagtttcatattcaagcactgcctcctatccctgctttatttttcatttcctgattttgaagtttgaatattaataatttcattgtcttgtaggggatgaaagaactatggtctttgttgaaactaagaaaaaagcagattttattgcaacttttctttgtcaagaaaaaatatcaactacaagtattcatgggtgagtagatgaatataattacctattaggggaatgacttctatttggtatttaagaaacatcagtttatataactaatatgatataatcctaggattgggattcagaattctctcagatctaaactgttattctcctttatatgaggaaaaggataatacccaggagtactaaactattatttttcatcctcattcttagtttttagaactaagtggttgtggtgggtaagataaaggtctgccttactctcaaaataaggagtggaaatttctcaagagatctcacttaaggatctctggccccttatcaaattttcctttgctaaatctaatctttcttagagctttttaaaattggagtgctttaaaatgtcatattaataccgttttatgggcacttcattagtagatcctaaaatatcacgtagtatatagtgttgtgaaattatactttaaaaatatgtttttaagcaagcattctaatcaagtagttgtatattttatgtcaagactataaagcatagagattataataggatttgatttttgtcagacttgagattgtagtctgtctctacatattagctgttactttacctcatttgcaaatggggataatttttgcaactcaaagtattatattgaggattaaataaaatggtagcttggaaggaattagtatagtacctggtatgtaagaagtgaacattaatgttaaatgctgctattcttttttttttttgagaaagtcttgcccagtcatccaggctggagtgcaatggcacgatctcagctcacctctgcttccccggttcaagtgattctcctacttcagcctccctagtagctggaattacaggtgcatgccaccatgcccagctaattttttgtatctttaatagagatggtgtttcatcatgttggccagactggtctcgatctcctcaccttgtgatccacctgcttcagcctcccaaagtgctggggttacaggtgtgagccactgcgcccagccaaatgctgctattcatactattattaaaaagaaatttgtatgttgaactttaatgattcactttaatgattttaagagtggttctaataacatgctttcttttctttcaagtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgtaagttaaacttttatgatggaatggatagttttcttactttgttgttgaaagtagacattttatgcatgtgtatataacaagtaaacttttccaatatttaatactttatgttgcatatgaagtcaattttttttaaaggctcaacaggatgttcctgcatggttggaagaaattgcctttagtacatacattcctggcttcagtggtagtacaagaggaaacgtgtttgcatcagttgataccagaaaggttagtagaaaggaaaacttgagaacttgtcttctagttactctttgtaaatgttgtgcttaatattgtgaagtaactataatatttaataatcaagccattgttttcgtgcctggaaggtagctactttattatttcattaacattttatgtatatacatatttttggttttaaaggtcaggaattaactttgagatttatgcctaaacagtctcctttcccagattttaaattttaatttggaatcttttaaacttctgatggaattatttaatttttgaattctgacaacattaattaatataaaatacaggacctgttggggttacaagtcttttctttttcttttctttttttttttttttgagatagtgtctggctctgttgtccaggctggagtgcagtggcatgatcttggctcactgcaacctccgcctcccaggttcaaacaattctcatgcctcagcctccagtgtatctgggattacaggcatgtgccaccatcttagctggttttttttttttttttttttgtatttttaatagagacagggtttcaccatgttggccaggctggtctcaaactcctggcctcaagtgatccacctgcttcaacctcccaaagtgctgagattacaggcgtgagccactgcgcccagccacgaggctacaagtcttttctggtatgtcaggtttttataggctgaacaccgcctttattcagaaacaatgagcatgttaattaaatatttatgctgattcattgagtgtagtgcattaagttttccccacttgtcaaaactattgacttaaaaaatatttttcttgaaacattttgtgcaatttagatttcctcatttgacaggagccttttttcaggtgaatcagatttagtgagaataaagttctttgattatttggggaagacatggtagatactttgagtccttgctctcagtctgagtgatgtaactttaaagctgtcataaaattaaatgtttgtttgtttctttttttttttttttaaataattaccagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttcccttaagttttccatcagcactttaaatttttctttgttgcatatcctagcccaaactcctatatttttgaaactgtttttttgtgtcttgcgtaaccagtgcagtgaacaaagtcttacataaattaaatattaatgtataaacattactgcacagatgtggcaatgaaaatcaatcttagaactcaaacccgtttatcaacaaaaaacaatgctgcttactctttccataagtttttgattcatattttaagattgatgaaagaaccctgtctttcttcattttccattatatatcttgaacttactatgcctagaataatgaagttctttttttttttgagacggagtcttgctcttgttgctaaggctggagtgtaatggcgtgatcttggctcactgcaacctctgcctcccgggttcaagcagttctcctgcctcagcctctcccgagtagctgggattacagacacgcgccacaatgcccagctaatttttagtagagacgggtttcactatgttggccagcctggtctcgaactcctgacctcgtgatccgcccgcctccacctctcaaagtgctgggattacacgcgtgagccaccgcacccagcccgaagttattaattaattgttaaatgaacgaacccaaatatttaagacccagtgaggtgtaaatactggggagacaaaaatgattggtattaagtgttactgttcacctaaacaatccaaagtgacatgtccctgatgtatatcttgttataggaatttagttaataaatgaggcatcacatatgaaaaaggaaggcatatcaacagatagtgttagaataactgggtagatgcctacctcatgccatatttaaaattaacttcatgtgaattataaaatattaaagctaatagttaaatattaaccctttgaagggttgactttaagctaaggaacagaaatcaaaaaagaaacaacagatttgatcactcaaggaaagattagttgcctacataaaaaatagtgaaaagtagacaaggaaaaatattactgtgaccacagtggttatcagtgttctttatatgtggatatactaatagaagaatacaaagaacatagaaactcaaaaagggcaccagcatggcacatgtatacatatgtaacaaacctgcatgttgtgcacatgtactctagaacttcgagtataataataaaaagaaaaaatgttgacaacaagaaaaactcaaaaagggaagttcaattaataaaaatatgggacatatttcacttttcttctgttatctcacttctgggaaaggctaaatgaatgaaggtgtttggattgttatttgtaatatctgtatgtcttaattttctagtttcgtttaggaagagtataggccagtcttgtctcatttttttcattgctttttttttttttaacagattgctccctctgaactgattccttttaagcttttgcttgatttgtcagattaccatagtagcattactgaatcaaatataaaaaaggaaaggaaatgtatcatacatctaccaccattacagatgaactgtaaatgtccctatgtttaattactctcctcatttctaggtataggtttgaatcatctctttaaaaattatcaaagtaacatgcataaattagaaaagaaaatgccatagaagcatttataatagaaagcaatatttttctgcccctccccttccaaattgccattccacatccaacaatcagctattattaacaatttctgttcactgccatcatatacaggttgagtatcccttatctgaaatgctcgggaccagaaatgtttcagatatcagatttttttttggattttggaatatttgcataatatataatgagagatcttggagatgggacccaagcctaaacatgaaattcatttgtttcattatacctcatatacaacttgaagataagttttgatattttaagtaattttgtgcatgaaacaaagtttgtgtaccttgagctgtctgaaaactaaggtgtcactatcttagtcacatgtggacaatctgaggcatcacattggtgctcaaggtttcaggtttaggagcatttgggattttgaatttttggattagggatgctcaacctgtatttttatgtcaccaaccagaacgtctgttgactttgatatatgaagatttaactcacatctctgactcgccgtagaagtatacctgtgagatgattttaaaggcaccttttcctttcctctatttgtatgtcataacatctgtaaactgcacatttacatttcccaagttaacatttgcattttctataaccataaagtctcccttatatacacagattccagaattgaaaatcaaaagcatgtgtttatataaatattgttcactggatgggccaattcacacagtcttgattgcctcacctttactatcttcctaattttatgacttttgtgtctgcagggagaatgggaagtgtcagggtcaaatgaaaactgcccaaagccattccacataccagcttgctttgaatttggatcacacaatttttgagcaatttgtttaccctgtttgtagtgtttttttgttttgaaggagacagatcatgcatttttcatattaccttcccaggtttgatgttaattttcttaaaagatcccaaaagatattggttgtcttcacttttatgatgaatgcgacttgtgtgtgatactcagggtgctttgaaaattgttttttttttttttcttggtccctaggagtgttttttgtatttgataatttttttcccaagttttctctgttctctatttttggagcttctattagattccagaactgaattctctattgtatctttcctgtttttttcatcttttatattctagtatatattttttactttcaaccgttttattagcaattgtttttaattctccagagctcgcttgctcactctatatatgtttaaatgttgcttaataatagtgaattttctgctttactagtgctttttaaattcctggaatttaacctaagaaatcatgtcttatgttgatcatttgtttttctgctgcttggtgtcagatatcttaacccttgatcattttataagttgtaggtacacatgcttctcaatttacaatggaattacatcccgataaacccactgtaagttgaagatatcagtaagccaaaaatccattaaatacacctaaacctgctgaacatcatagcttagcctaacctgccttaaacgtgctgacaacacttacattagcctaaagttgggcaaattcgtctataaaaagccgatttcataatgtgttgaatatctcatctcatttattgaatactgaaagtgaaaaactggttgtatatgggcactcaccattaacgtacacagctgaaagcacactgggccaaagaatgtttgaaacatctagaattgctggatgacagggatgccacggtgacagggcaatcaatttctcttctggtgaggctcaagaataagcacttgggcatccacacagaatgctttagcgtttgggtggtttacactcgtggtctcatggctggctaaaagctgtgtctggctgctgctgcccatcatcacagtctccatccaccacatactgctagcctgggaaaagagcaaaattcacagtacgatttctgctgaatgcatatcgcttttacaccatcataaagtcaaaaagtcatgtaagtttaaccactgtaagggtccgttaggtatatttaatgcaactcaagatcaactttcatcagattctgcaagctcttccatttttgtacttttcccctcagcccttagaattgagtgtcctttttctaattatttcaaggtctgctctcaaggcagaggttgagatgtgactgataaggcttaacttttcttctttgaattctttgcattttaataggagtgaaagactgtggccttagctaaaaggaagctcaaaatgtggaatcaccattttgagcaacatatgctacgcaaacaccagctacgtatgtgagagttggggaataatggtgatgtagtggggaaggaacatcaggggatacctgatatcacacaggatgggtaacctacctgttccaccagtccctgggatcttgggggtggagtagatatgtcttttctgatttcactgtttgcacttacaacattttcccctatttatttactagagacagggtcctgctgtgttggccaggctgatctcgaactcctggcctcccaaagtgctggattacaggtacatgccacagtgcctggctttgataacatttttattatataggacggcagcagtggtcagttttcccctcgcaccttccccatagcttcacacttgtgctggtttgcgtagatctctctcattagtgccctaacttgggagcagccattttttcattttgttcggtgtggccttcatcgatttttttagcgtattggaaatagggcggtattttgttttctaaagcattttctaaaaacttcgacttgccagtatgtgcttatgctcactgttggatttagattccccggtccacaccgaagcgcgatcctagtacctccagcgtgaaacagtccagaaaggagtcgtcgatgtcccggggccctggccgggagaacgcctcgcggggcgggctggtgggtggctgtgtgcggggagccgcggcgaagctgcttccgcccgcgtgtcccgagctcgcggaggcgggcttccacgggcggccctgacccggtggtcctgacgctctcccagccagcggcgggaggcttcccaggggcggagcgagaggttggcccggtaggatcgggggactgagccgagagtcaccgcggttcctgccccgggagcccgggctggccacacccaggtgagtggcactgtggggcgcggcgcagctaggctggccccgcgggttttcctcgggctctcactttagaatagcagttctgatctctttggatcacataaattatagaaccaagttttacataaaattgcaggggctttaacctttaacctccttgaaatccattaacagacccacccaagggagccaagaactgcacattgacccctgctctagagacagatggtgccatgagggattccatgccaggaggggacaggggaccaggggttggtgtgtggggacactgatgctggacactgagcaaatgagatttgtcccagttctttgatctttacctaagtgattcattgttttgctgtaatttttaggatgtttatcaaatcatcaaagtagctcatctggaagatacttttctgtgggagatttcttgaaagatttttttgtctccatcagagttttctggatttagagtctcatatttctgtgggattctttttcagaatcaaaaatcttttccctctccttctgaacataggaacttactatcccaccatcttggatattttaacttggttttagttttggaatgaggcttaccgtgtgggagattgaagaattctcaacagaaatcaaagcactttaaaatagttttaaaaattatggatagcaggagaagcttcttctatataacaaagtaagcctgatactagttggagtagccttaacattggctatatttgccgacttgtgtagtacctagtgttatcaatgacctgctttaggctttgatttgcttatgtgtaaaaggaagataataactagatttttttccccacatctccatctgatgaagtcacacagtccatacagttacataaagtatttttaagaggcagccctgtgtaagaaggctcagtatcatagctgaatgctggtgcacttggattttagtgctcaggtcttattctggtattgcattaactgctttgtcgattttagagagttgattcttaagaagtcagtgatcactttgccaactctagtggttgaatctctattacgatacagtttgcccttgggatatcatacagcaagagtgatgcctgttaattgaccattttggcatcttattatatacctcctctagcaattgtttcattaatcttagattgttccattactggagatttattcatgataatccactgatgccaatcagctaagcatacttcccaatgtgttcatgccagttaaatgttgcaatacaagttctggcaatttcatcttaacatgtttgttcttcagctgaggtattttattgggctagcagtcatctggataggtggaaagtttggttccaataatttacttcagttttataaacagaattactgttgctatgatgccacaaagaaaacactatcatttggagtagaatttagaatgtatacgtgccaaaataagttcagtttatcatagtgtgaatactataaaatatgtactgagagtaatgccaatcacttatttaaatagtaacaaacctgtagttttctcatctgtgtatgtaattcactaggaaaatgaaccctactctggtgaaatgactcagattaaccaaagtttgaatcctattactaattgtgtgatcttggggaagttaatttttttaatttgaaataaaacttacctacaataaaatgcacaaatcttaagtttacagcttaaatgtttacctatgtgtgctccttgtaaccatcacctaaatcaagatgtgaaacatttctatcaccctaaacagtttcctcttgcccctttacagtcaactccctggcccagagcactattctgatttttatcaccataaattgggtttgcctgttattgaacgtcatataaatggaatcatagagtatctctcttttgtatatggcttcttttgttcaacataatagctgtgagattcatccatgttgttttgtgtaatagtttctttttattgtatcatgaataactacaaattatttttgtagtctcctattgacaggcatttggattgttttcagattttgaacaaagctcctacaaatattttactacaagtcttttggtcaacacaaggactcatttttctgggcatatactcagaagtggaattgctggaacatagggtataactttttattagaaacagccaaagagttttccagaatggttgtaccatttactatagccaccagcatcataagaatgttctgtttgctccacatcctcaccatcagtatgtgttactgttgtttttaattctagccatttactgtggttttaatttatatttccctgatgattagtgatattgggcaccttttcatatgctcattggcagtttccttctttcttcacctgtttacgtgtctgtccagtcacataaaagggggtggagaaaaggtggtgaagcggtgttgtttgtctgaggtaatgcctgagattcattgtctcatgccaaggaaatcgaagatgcggccatacaaggagtggatttaggagcagaaagtttaataggcaaaagagaaaagagaataactctctctcctgcagagagagagggatgccagagtgggtcttctggtcccatggtgaagtgcacagggttttatagtctggcttgaggaggcagtgtctgatttacatagggcccaaagattggttgaaccaggtgtgatgtttatataacagttgaagaagctggccaccccaatctaatcttttattatgcaaacagattttctacctggctggtgccatgttgtctgctccctactgtacatatggctgacaaagaaaagggaagttggagccaccatgttgaacatgcctagcccctaggtagccttttcctattgtcacagctgccagctttcacccgtgcaagcttctagcttgcttctctatgtctgcggctcaattttacaggctgttttttgttagaaaagaaatgatttgaaggctgctttttattaaaagggaaacctgatcaaggacttccttaccctcactgtctgcctaaataatttttttgaactcctatatcattgggatcaaaggatgaggtgctgtcttgctattcagtggtgataccaagagttgtgaaaatagtttatccttaggctaaattacagtcctttgggttgctcattatatctttagggtgacatttgctgctgttacaaccccaaaacttcagtggcttaacaaaatagaagtatgttttttgcttacctgactgtccaaaaagggtattcctggtaggtaggtgtccttcccagtagttacttaagaatccaggttccttccatcctgtggctctgcagtctggtacagcttccaagatctttatgcttctctttatcaagccagagaaagggaaagagttggagaggagagagacaaagtggacttgtggaacatttttatgggtcaggcaaagaaataagcatatacatctcagattccactgttacaaacttagtcacatgtaactgtaagagagactgggaaatgtggccttatctgtgtgctcagaaagctgggaatcagctagcagtttttgccaatactgttgaaatgggttgttctccaggatggtcaatggatttctgtagtaaattgagtcaggacaagacttcttgatcttcacgtatcaaggaatctgtgtaagctgctaagagttcttaaataagacaccttcccattctctgctttctgcagcatgaaggagagtgaccatggaaatatagataatgataactgaaatccattctgtgatggtacagaatgcttggctgaaagctgttctccattcatgatgattttttaaatctagtatctaatatttataaaataaatgcaatttggaataaagtaatcatatttcatctttcataaataatccagaacttaggattttaaaagtttaaaaaagtgattaagtagttttagtgacttattagaaaatgacttctaagacagtccgtggggaaaagcaaagctgtttctttcacacctttttttccattgggctactaatatactcctatatttgagttgccaagtcattatactgttcttttgtcttaaaatcctctatcaacgagagagaaattactgtaaatcatttaaaccttgggtcagcaatctttctagctcttaagagttcagtacacatcattgttagaggaaggagaggaagaagaaggtaaagggggaacagaaaatgatcatgagttgaggtgcagtagagcttctccaattcctatgtcttgtaataaagtggccttgtgttgtctaagcttttcttggacaaatcattactctagaactgtcctgtaaaaatataatgtgagccatatatgtagtcgatatatcccaaatactgtcatttcaacatgtagtcaaatgtaatgattattgaggtattttacatttatgtactaaatctttgaaacccagtacttattttgcctatgcttacatctcaatttggacactaagttatcattggaaatacttgatctttatttagagtgtatgaaatgtgtagttatagagtagattcacacacccaagttgtccaaacatacttgaaagttttccaacagctgaatcaagtctcaatttttaaatttaaatttagactaagaaacattaaataaaattaaaattcaatttcttattgcattagccatgtttcaagtgctcaatagccacatgtggctagtggctaccacactgacactacaactctagagtctagattgagtttagactgtaagctcaaaaaatgtttgtggattgaaaatattaatgtagttttaaaatgtctaaaatagaattgaaagtagtgcttaataaataagctaatttaattgaatagctggagggaagccagacttccaaagctaaacctttatttcaaaaacttattcctggtaaacatgcgaagtgcagatacttagatcagaatggctatacctttttttggagaatgcctctttctagcccaatggctggcaattctagtcaaattgcatgttaattgccacataacggttagctaaccaattgtggaggaaaattttaagctgtcatttctgtaatccattggtttgcatttgggcattataaagtaaacatgaatgtagtcaaaacaattagggttgagattctgaaaataattatgtcccattccatattccatgtcactctgcagaggaaacaattttattgttataggggcatgcacatctaattttgaaaatctaacctgccaaatatcctgtgtgaagaaagcactctattctttgagaatgtgactcttctaccctaatgcccagacatcttttgtactacccaaattttactagttcaatgctttactcgagtcgaccttctttcacaaagctttccttgattactgtagttcacattgatccctcccttccctgaatttatttctcactcatggtaacaaccaaatattttgtcaaccaaatactatgtatctacaatgctgtgaattgtttcccatttgattattgagtgtcatcacatctagcacatccaactcagtgattgataagtggcagttgcttaacatttgcttgagtacacagaaaacaagaacaccatagaaatcctgggtaataaacataagaatctctgactgttccatgctttgtgctcagattgctttactgcattctcttgtcttgagtagtgtcaggagctcggctcaactggagagagagtgctgaactgccaggtgttgttggaatactggattaaaggacaatcaaaataaaagtgacagtcaagcttttcatcacttattgcaatagtataaacaagagtctaaaccagagaaagcacctgctccattccattcctctcacagcccccatggaatggcccactagttgaaagtcaagtagaccagcacagagagaggagttgtcctcactgtctgagagctccaaacaaaaggcttgggcagttttatgggcccagggcctagcaggaggcagagggaagggctaggagtgcaaaagcactgagtcagggtggagcaaatcatcttcgagttttcccgataaggatacctctaaatggaggcagctgagccaggaatgcagccatgtgtaaggtcatggtggaccaggggactgtaatgacttccagagactgcagtgcactggcagtgccactaagtctgatgtggagagagcagctttcacccgtgaggtctgtcagataaagtgtttgtaattgcctatgatcaggcctgaaaaatcactcaggtttttttttttgccaggaaccaggctcctcaagtaggaaatcacttctattgtcaaggcccaaaactactctcatctattctagaaggcacattttctcacactttaacatctctgaaagcaggatgcattttacaattgatgtcctacaattgtagtgtcaggtaacagtttatgatctagttctatgaaaagcttcttttgacacttgtgtaaagtcaagaaaacactggcatcaaaaagtcttaggtttgatgagatacagtattcttttacatcataaacagtgtctacatcacatctagagtttggcaggttttgtctttggcatctccattttagtccttcctaacatgttccagtgagcttcccaagactatgtaaattctttgtctgccagctgagaagaatacagtttcttttctgttttttctttgaccaaagtctcttgttctgtaaaggtcaacatagtcttaaaaaaaccctatcagatcatatatccttttttttcccttactgatgtttaccttttccagggatttttggaatcttaaatcatgccaagcctttctgggaatagcttgaagaattttgagaaataagtgacatgactaaaaatgaaatttcactcatttggctagctgatgggtctaaagtggaaggagttgggaagacccttcacacatgcaatggatcccctcacttgactctgttgggactgctgtgaactgtcttaagctctgccagggcagaacaaatgaattaaactgtggaatgttctgtgggcttcagcacccaattggaaccattttccccaaatccaactgttaaacctgtttaggattaaggactggggataagattctgatgacattccagtggtgaacatctgcactgttatttgtctttaatgcaatttgggaactaaattcaaatggtagataggaggaggaaaccaaaggatcctcagggaccacataaaaaatgtggcaagcaaaagcccttttatagaaaaaagatttggagaccaaattttgggatagtggtcctgacagccctctctgccaatgactgaacaagaggcttaggcactggactccctgaaatggactctaccttccttcttttgtgtgacccttctttaccttttccatatattctctcttctaacactctccttagccttgggttattctgatgtgcaccccgctcaagaaccactggctagactttagatatagacagcatgtttaggtagatgtatagtaacaccttctgttcattttctgccttcttgaaatttgttttagttacccatcgctgcataataagttaccccaaagctaagtggcagaaaaactacatgtattatctcactctttctgtgcattaggagcctgggcatggcttagctgggtactctggttctaggtctctcacaggatacaatcaaggtgttggctaggatgcacccatctcagggattaactgggaaatgatctgcttccaagctcacttggggttgttagcaaggttcagttcctttgggttgttggactaaaggtctcagtttcttatgagctgttgaccaagggctgccctgagttccttacgataagtgcctctccctagtgcagtttacagcaaggtagctgacttcatcagagcaggcgagtgagagggctggagggagtgtgagaaagacagaagttccagtctcctaacctgatctcagaagtgacattccgttacttttactgtactctgtttgttagaaatgactcactcactagtttcaacctacactcaagagaacattatataagagtgtgaattgggagacattttagaagctgtctaccacagaatgcaaattattgcatgaatgatataccatttagaacaagggtatgggtttgaattctattccacatgtcttgaatgtaataatgtcacagcgttaaaaattcaacttgaatctgacagtccccatcctactggaatagctggaagttttatctcagtcattagcggggaacccctcaccttgtcacacacactcatgcttgtgctgaggttccagggtcatgagcaccaccaaagccctcgggaaactcttcagttatcaattgcctgtccacactgcttacttccaagttagttgtggtgctctcagctccataggcagtgctttcggggccagtagccttgctgctgctgtgccatcctggggcagggagtctttgtcaaggctgagagctcctgttcccaagacctggccaccctcaatgtaccctgtagtcaccctctttggagcatgactactaagaggaacacaggccaccaaactatatgtgtacgtaatctggcttttgttgttagtgtagaagtgacatacattctcttgcagttttctacattctaagccaaagtctgaactcagcgttctatgacctagaataagcaagacattttccacaaatataactataagtaatcttcaacgtaaaatctatattacaaaagcagaacacaaaacgtccttgttgtagttaatgtagaatcttacagaattgttctcacaaaacaacagcagcaacaacaacaacaatacacacacacacaatgataacaaaatgaagagtacacataatcttccaagaaagaaagcttcatcccaacttggttaatgggatgtttatattcttagtgtcttcaggataccttctgtgtgcatacatatcttttggttttttagtttatccatatagcaagatgtaatggccatctgtgtcaactgtcttttgattttttcaaaattctttgacaaattgcaatatgagtcctgtgctctctggctttagctctacttggccaagactgatttccattcatgcattataataagcaccccaataatagtgcaggttgtgtttggatctggtggttccataccacgtagccctagaccttgatttatttttatctgctcctttggacccttaggataaatacagagtacatgtatgttttaaatcagctctcatattccaccttatgacaggctttactttgtaacagattaactcactcttccctttcaccttacatatcctgcagacttccaaggaatgaaggaaaagattgcagttaccagtgtgggattgatatggtttggctctgtgtccccacccaaatctcatctcgaattgtaatccccacatgtcagaggaggggcctggtgggagatgattggatcacgggggcagatttctcctctgctgttcttgtgatagtgagtgagttctcatgacagctgatggttttaaagtgaggcacttccccgcctccctctagcacgctcgctaatgccgccatgtaacgtgtgcctttgcttccccttcaccttccaccatgattataagtttcctgaggcctccccagccatgtggaactgtgaatcaattaaattattttctttataaattacccactctcaggttgtatctatagcaatgtgaaaacagactaacagtgatgtatcccttgtcccagctttggggcagatctgtgtcagaggcagtggttagtctcagggacaaaacccctttctggtaggggttttgatttttgtaaaccttggctttgattctgtcatcctctcctgagaaggtaggtaggtggcttctgtgctctgtgttgttcagggaaacggatgctttgattctcatgtggtgatatagtttggatatttgtccctgcccaaatctcattttgaaatttaatccccagtgttggaggcagaggtggggcctggtgggaggtgtttgggtcatgggggtggatccatcatggctttgtgctgtcttcctaatagtgagttctcatgagacctagttgcttgtgtggcacctccccctcactatccctctctcttgctcctcctttcaccatgtgatgtgcctgctttccctttgtcttctgccatgattggaagcctcctgaggcccacccagaagcagatgctgctatacttcctgtacagcctgcagaactatgagccaatcaaacctcttttctttacccagcctcgggcatttctttatcgtaatgcaagaatggactaacacaggcctggaaaatggctggtcgcgagaggggcggccggttgctggggagggagtcggggctgtgtgggggcattggttcagccccagcggagtccgagtcggggtttgcagcatgttttgtggtgatgtttccaatctctttcccaaccaatggatcaggacggcgatcagtagcttggacggtcgcggatcctggctccgcaaacgttaaaggaaattgatgatgtctatgaaaaatataagaaagcaatgattcattccatgttcattaagtgagggagtgtcacaagaagatgaatttcaagaactatttgaagaaagagaaagagaatggtgagttcttcttctagggtaccatttggaaaatggctattcccagtgaattatccttcccaaatagcattttgatgctgttgttcctttctttgaggttcacaatggttcttaattttcatctaatttatgagacccagttatccagcacatgagctatgggagggcctttccaacatagctcacaataagcttactgctctggcttggcaaaaacactcctctgctcctcaaacactccttctccactgtgctctgggatgtagcacctgtcagtcctttactcagaatgctctcactctgttgagctacatgtttttcctcttctgaaattctgtttgagacccatcactctaggaaggcttccctactggctcactttgatttgatggtaagtatgtttcacattctgctgagactgtgagcctttcatgagaagggactgtgtggcactagcatgttaatatgtgggtgcccaataagtggtagctggctggttgtgccaggatccccttggtacttatgctacattccactcactgctgtgggctcaacttccatcctttgtgccaggaaagaaagccatgggagagataggatgtgaccagagaagaaagcctaggaatcacagaaaatgtgtgtgacagtagagacaaagtaatgcaaactgcaatgatgaattttagttatggttgccatgtgtatttgggaaaggaattagatgattctgattagcacccctcattaagaaccagacctggccgggcacggtggctcatgcctgtaatcccagcactttgggaggctgaggcgggcagatcacgaggtcaggagatcgagactcatgctggctaacacggtgaaaccccatctctactaaaaatacaaaaaaattagccgggcgtggtggcaggtgcctgtagggaggctgaggcaggagaatggtgtgaacccaggaggcggagcttgcagtgagcccagatcgggctactgcactccagcctgggtgacagtgagactccatctcaaaaaaacaaaacaaaacaaaacaaaacaaaaacccagacctgtggacaggactggctatatacgtatatacgttgtggagcttagtgcaaaatgaaaatatggggcttgggctcagaaacttaagaatttcaagacagcaatagcaaggcattaaaccaaattcagggaccttctcactgtaaggccctgagtgacccaattgtgcagcttgcgcatcttgtctataaaagattaacaagtaagagacagaaggttgaatgtgactcaccgaaaatagagatttctttatttaaaatcaaaaccaaaaaagcctattacattcccaataaaaattatagagtcatgttagactaaatcttcttggtctcatgggatacaaagagaactgactctatcttcaataagtcagagattttcaagtagagaaagtcaccgactatgtgctatctctgagagtaggagtgagtcagatttttatgttgataagaagagtgggccaggcacggtggctcacgcttataatcgtagcactttgggaggccgaggtggggggatgcaacatggagaaaccccatctctactaaaaatacaaaattagccgggtatggtggcacatgcctataatcccagctactcaggaggccgaagcaggaggatcacttgaccatgaaggtggaggttgcagtgggctgagatcatgccattgcactccagcctgggcaacaagagcgaagctccgtctaaaaaaaaaaaaaaaaaaaaaagtgaactttttatgttgaaaaacatggctctagaagagacataaatttggatatgaaagattgctgtgagatttgcaagagacagtgattggtctgtctataccttcattcaataaatattcatggcctaatatattgccaaaagccaagctgcatggccaacttcctcttgtattgtggaaatttcctgtgcttgctttactttggggcttttgggacatagggtgtttatcaatgcctgtgaatgggaaggggcaggagcaggcttgggcagagggagaactctgaattgagttgcaggtccaacaaagcctggggatctgcatttcttttttgtttattcttcttttagagacagggtctcacactgttgcccagactggagtgcaggggcacaatcatagcctcaaacccctggtctcaagtgatccttcctcctcagcctcctgagtagctgggactatagatgcatgtcaccagtaccagctaactttttttttttttgagacagagtctcactctgtcacccagactggagtgcagtggtatgatctccgctcactgcaacctccacctcccaggttcaagcaattcttgtgcctcagcctcctgagtagctgagattacaggcatgcaccaccatgctcagctaatttttgtatttttagtaaagacggggtttcatcatgtttaccaggctggtctcaaactcctgacttcaactgatctgcctgcctcggcctcccaaagttctgcgattataggcatgaaccactgcacttgacccaattttttattttatttttatttttattttattttttttgtagagatgggggtctcaccatgctgccagggtgatctgaaactcttggcactaagcaatactctcacctcagcctcccaaagtgctgggattacaggcatgagccaccacgtctggccagaatctgcatttctacacaagtttccagttaatgcccatgtgactgatcatggccacagtttgaatagcaaagttctgtagcaaactgactggttttcagctgataataaaacaatgaaggaagaaatgaacaactgctaactgtgtctatgggttcttcatggtttcttttttaattataatgatgtggaaaaactgtgagctatgcttaattatgtgatgaaaatgcaaataatactttcccttcatggtcttaaagaaatatttttgaagattaatgaggtgaatgattgaaaggctggtagagtttccagaaagcatggtactgctttagtgcttggcatgaatatgtagtggagtccacaggtgagtatttcctcggaaagttgttatgtgattctattatatttcagaaaaggagacttcagaaactgcatttgaaagtttcttattcacatcactgttcttagggacagtgggcacagaggtttgggcattttactgcagctttccctgctgagttagtgtaaccacaaccatattccgtgattagcctattaagctcccaagccctgggaatgggattgtttcttcctgaaggtatagagttggaggtgagcactgcagaaggcataactatacagtctagagatttattttttgaaaacaaaccagaatttagtaatctgaaagagtgttatccatcagggtgtctgcttataagaccacaaatgtatttcaaggatattgcagttgctcaacactcagtaattccatctgcccttttggatatccacgtcaactggcctttctcagccagggctctgtgcaagaattaagcctgattccctaaaggtatccattgtatatagtacatattgtatgtgataggaattaacttctcttctgtacatttagattggtactaattatgttccattcttggtaaaataagagtcacttaaattcttttctgtgttttgtggttcagataaggaacctggatggaaaggctgccagtgattcttattgttttcatagagctataattattaactggcagattgctgtgtaattagttcctgctataattattaattacaataatttaataattattaaattgaaggaagaaggagggagtcagaagtttaaagaaacagtaacatatttgcaacctccatttgagctgggccaggaaaatagtctttgacttaacaccaaaaagtagtatagtgcagctgaagattttcagaggcggagtagaggaggagagaggtagaggcaagtctggagtaaagatctcgagcagcactgtccaatagaaatacaatgtgaggccgggagtggtggctcaagcctgtaatcccagcactttgggaggctgaggctggtggatcatgtgaggtcaggagttcaagaccagtctggccaacatggtgaaaccctttctctgctaaaaatacaaaaatcagccaggggtgttgtcgggtagctgtaatcccagctactcgggatgctgaggcaggagaatcgcttgggaggcggaggttgcggtgagccaagatcacaccactgcactccagctagggtgacagagcaagactccatattaaaaaaaaaaaaaaaatcacaatgtgaacctcattttaaaaagtaaaaaagataaaattaactataataatatatatcatttaacccaaagtgtttttaaattatgatcaatataattatttttaatgagaattttacattctttttttgtattcaccttcaaaaccttgtatgtattggatttccagcaccacatctcagattggaattgtcacacttcagttgctcagtagtcacctgtagctagtgctactgcattggacagcacagctctagatgccatatcactacaaagattatgtaatttataattaaacagtaaagttgtatttttcaaaatgtcataaaatacaaatatgctaaaagtaaaaataagtcatttgtagattttctctttttttcctctctctcttccatctttccttctccctccattccttctgtctaagccttggggcactctacaatagagaggtcagggagaacaggaggcctaggtaaagggactgaaaaaagaccggtgaggcaggaggagagccaggagagtgtggtgctccagaagccatggtatcctggaaccagcttctgtcagttcacgagggctgattggtaaattttctggaatttagtaaacaggttgaagtatggtcattagtaaaaattatataatttaaataaattgtacttttaaaaagtagtactcaaaactcatttcttcttattttttttttaaaaatgaggatttatttgacaagttttacttagctcaatatacgtaaaaggaaatcacagtacaatggaagacttaaatcaaggcctcagaatctcatacaaacatcaagaccaaaatcctaaagtattggtattgcatctcaaatttttcccattaacttaaaaaaaaacaaaacttaaacttatgtgccttacaggttattaaataaaactagaattaacaaagaagccaaaatgtttcactttaattgtagacagacacagctcctatattgagttttacaacaaaaaaacccatgtctttcagcatgcatctacacagtgttcaatgtaatgtagcaaagggcaacagtgaacataattcaactccttttacctcaatacacttactgcttaagaacatcctataatataactaacttgagcaaagctggaacttgtttaacagttatagtttactcaacttcagtgttacatcctagatgagtattgtgttaaaaaatactgagccttaagtcttcataacaatcctgatttctacttagagagtaagcataaatcataagtttgtattgcagaaactgttaaactgaagttttgggtttttcttaaaaaaaaaattgagcaagggtcagtgatcaattatattccccatccaccactcatactggacatggtagacatccctcccattccattcacacctatagatgcacagcttccattactgtagtagctgctgttcattgctccttggctacctatgcaatgtctgattgaaaatcacatgagttttcctgtaaaacttggtcaaatccactcatgctgctgtggccaccatagccacctccataaccaccactcagctgcgggctggctgggccaccataactggactggattgacaagcccatgccccccatcatttggctaccgtaagcagtaccgctggctcctgctgcacaattcaagaagggttctacatagctgtgttgcatatttgctttgtcttttgacatagctgccacagcatcttcatgagttgcaaactcaacatctgcttcaccagttactctgccatcaggaccaatttcaatgtgtaccctcacagcattgagcagtcaaaaaaattacaaatgtcattctcagtagctctgtaaggtaatccacacgtatatacagtgtcctgttgtgctctggaaggtagagccaccatccccatatttgtgatcagacattcctgaaaaacaataattgaggtctcttccaaatctatctgacccaaatccatagccatagccattataattgtcacaggctccatatcctccaccataagcaccatgcctcatcctctgaaagccagctcctctgccaatgctgttaaaacctctgccagaaccaggtctgtcatgggacctggccgccgcatggccataagcttttatggtggattgtagtgagttccaacttcagccctgctgcttttaaagatttcaatatacctgtgccctattctttccttgtgtttctttagagccttttcggttattttctgcgaagcaaactgcacgaagacctcccctatactcctcccctggagtccactggcaatgttatccgatttggcacgatttccaaccctgagaagaactgaacaatttcttccttgctgcattcaaagggaagtcctctaagctgtacaaagccatcattggccgtgtcaggactatttcgaccggtatgcttcaacacccaatccatttcaacgttgtttgacttgaatgcttcaacaaaactgtgtcccatagtttctctgtcctttttcagggccaatttgacttcattttctgattcaagttcaacaaaagccttgtcacccagcctgccttctctgttgtagatgaaacgaataccttgagccttattttgaattttgcagtcagaagaaacgctgcacttcatcggccaagcaagaccagggcaagccgtggaccttcaacataaacccctcgccacctttggtgcccaacatcattgtctcttacctggtctggtgtcaaaacagaccagacacctgacttcggcagggctaaaaagaaatggcccacttcttaattattttggtagactttactagtatctatgctcctgagattatggctgttgcatctgtgtggtggaaatactacataatggagtgtactactgttcatctctttctaactcagcagtcacgctggtagactgaaattggccatagtggaagtacttacatcacagaaatcagcaaaggcaacaaattggaacttttgaaaatttttctggagaacctgttgttaaacatttaccagcacactactgcctggaagccaagagaagatggagtatcaaggggagaggaatcagttgtatcaagtgctgctaagatgaggttagtaacgtaaggtttggaaattgaacattggattaagctccatggatttcacaaggactaaaaaagacaaaatcgctgcctttgtggaacttacattctgatgattgacttggaaatttaatagcaaatagaacagaaaaaaatgtcctgccttcatgggttgggatgtagtaggcattttgaaggacctgctgttcttggaatagtaaatttcattctctccaccttctaagctttgtatgttctctgtgtttagactgccctttgctgtcttattctgctggtgtacatctgtctattcatttctttaggattcagctcaaatgtgtattcctttgggcagctgtctctgaactttgcaggcaaaattaaatgcttgccctgaatattcctgtgtttttcttatgcctgtatttttctcattgctgtaatgatggcccatttctacatctttccttgatgagcccactgactgataatggctgcgatcttcatctttgtatctcagggcctgccaccatccttggcacatagtagatcctatgtttctctacatctttagagactgaaggaatcaagtaattaacctgggattaagatattgagatctgatccaaggcagagggaccacaagacctactccatggggggatgtaaatggttgtcagtagaactgtgcttatttctgtctctggaccatttgacactctgtctttatcattctctctcctgatttgaatatctaatctggggcctgaaacaatcaatgtgctatattataaaataaaacttgtttgcttttctattcagagaccttttattgctaaaattttccacttgttaccttttctttctcaatcaatttacactttgaatttattcatttgtttagcaatttccattttattttcatctcctcatgttttcttaaaactaagttacttcttagcatcatggttacatcagggatcatttggttgcaaggaacaaaaacatgttcaatctactttaataagcagcagtttattgcattgatataataggcaatgtcatgggcatccacaggcagggacttaatacaacagggtctcttgtgttccacatgagcacttgtactgaactgtcagtcatcacatggactctcacccttgcttctctctttgcttttattcactctctccttagccatctttcttttctcgcatgtctaaaacagggctgccagaacccatcacctgatagctccactcagctgactttgtttcacattcccatgtgagaggatccggtgagttagccaggtctatgaaccacatgtaacctgggatcctatctcgatgaaagggtgtgttcttcatttcctagggatgttgtagcaaattaccacaaacttggtggctaaaaaaccacagaaatgtattctctcacagttctggagaccaaaagtccaaaatcaagatgtcagcagtgttccttctggagtctctgagggagaatctgttccatgtttttctttaaaaaaaaaaaaaaaatttttttaagagatggtcttgctatgttgcccaagctggtgttgaactcctggcctcaagcaatcctcccacatcagcctcctaaaatgctgggattacaggcatgagccactgcccctggtcttatttcatgcctctccttctcctagcttgttgtggctccagcaatccttggtgcttcttgatttgtagacacatcatgccaatctctacttagtcacgtggtttttccttgtgtccctctgtgtctgtctcttctgtttcttacaagggcactgattattagattaagggccaccctaatccaggatgatcacatttcgagatctttaccttaattatatcagcaaagactcaattccaagtaaggtcatattagggtaccaggtagacatatcttctgtgggccactattggacccactatgggaggtgtatgggagtatatgagaggtatagtcaaaggctaccagcatggctttgaggccccattgcaggtgccagtaaatgcctagttgttccacacctctaccaggaatacttgtcactttatcattttgaacacttactttcaattaacatgttctgctgaaatgtccctttctctaaataactttcagggactcacatcccttagggcggaattaatgacttgcctttcccatttcccatagcattttatacacacctctgacaacacttgccattttcatttatagcactttgtttacgtgtccattttcccacttaagttgtggacttttcctgggtggggcctgttctttactcagttttgcttccgcagtgtcaagcacaggatccaactttgagttatgtttgtggaattgcgttgaaagtctgggcttcatggattgaatttcttcccttccagccttagtgttacttgattcaattgtgttaattgtccattccagccagtttcgtctgggattgtactctgttgtgttctctgttacatgctcagctctgccccgtctttcctgctgccacaacctatgttagccctcatcagcatacttctgctgcccaaattctttaggccctgcattctcaagttgtccccaccaccccttctgttcaggttaatcttcccttttgcatgcatgtgcccacacatggggatccactttacatgtttatcttagccatggtcgatgcagttaggatttccaaattacattatcagtaccaaattaggtttgaaaaaggagagggagcatttctttcttttgcaatcttgtcacagtgtttcctgtggtcccagaaatcatggtggaaagaaaattgggatttcaggaaacattgcttgattctgcaggaagtgaacaacgttttctaatgatttccagaaaaagaaatgtcatatttttctggagtactttaggaggaagtagtgcagtcagtggtgggaaatatgtcctccactccctgttaagttctctgtggcagatcttacatattgccagtgagttcctgctcttatttaaagaatgaagataatgatattctgcagctatgaattttgagttcaactatgtagttgctgattttctgcctactgggtttgtccatttccaatacaggggtgtcaatatcttcactatcatagtggattcttctatttcccattgtagttctgtcagtttttgccttatgtattttgatgctctgttggtagatgcatacaaattaaggactgttatgtcttcttggagaattggcccctttaccattatataatgtccctctttatccctgataacttttcttgctctgaagtctgctgtttctgaaattaaggcagctacttcaactttcttttgattagtgttagcatgatatctctttctctatccatttatatttaatctatatgtgtctttatatttaaagttggtttcttttgtttccttttgtttgtgtatgtaaaatgcaatcttccttctgcagctttctttattgaagtgtttggtatatatttggtgctagcatggccattgctaattcatgaatttttttttactttatttatttgtaatttcaacttttattttagaatcatggggtacatgtgccagtttgttacatggtatattgtgtgatgttggggagccagaggggaaaataaaccacctttcctataaaggcacaaaagaattacatccaatgtctcctcagaaatcatataaggaagatgaaagtagaatgaaatatttaaagtgttaagagaaaaaaacccccaccaacctagaattgtttatcctataaaattatccttcaaagtgagggaggaataaaaactctcggacaaaaattgagataatttgttgccggtagacctgccttgcaagaaatgttaaaagttcttccaagagaagtaaataatatgagtcagaaactcagatctacataaggaaaggaagagatcacagaagaaataagtgaaggtaaaagaaacacttctatttttcttattgtgagttgacctaacagataagtttgttcaaagtaataataattataacaatgtatctgattaatatagtttatgtgtaagtgaaaaacagtcattttacttttcattttctacagttttaatgatatacctaggtgtagtttttctggaatttatctcacttggtgttctctgagtttattggatccttggtttgttttctgatgttaatttgggaaagtctctgtttttactgctttaaatattgtgtctgttcttttttccttcttccctttctggtattcccattatgagtatgttacacctttgcagttgtcctgaaattcttagatactattgtttatttatttttagtttttttctctttgcttttccactttgcaagtttccattgtcaaatcctcaagctcagaaattatttcttcagctatgtccagtctacctgtgaccccaataaaggcattcttcatttttgttagtgtttttaacctctagcatctcttttttatgcttccttagaatttccattctgtgcttaagatatccatctgttcttgcaaattgtctactttttccactcacccttagcatattaatcatagttattttatatttatagtctgataattttaacatccataccatatcagggtctggttgtgatgcttgctttgtctctttaaactgtgttttttgccttttagtatgccttataacattttgttgaaaggtgaacatgatgtaccaggtaaaaggaactggggtaaacagacctttagtgaggtcatgacaagatgtgaagggagaggaagtgtttgacagccctatgattaggtctcagtcttttagtgagcctgtgcctctggactgtgaacttcacaaattgtgttaattgtggtacaggtggatttcacttaggtggtacaggatggcaagagagggctgtagtggggtattttctttcccattaggttaggctcttgagggcaggtgatatggtttggctgtgtccccacccaaaatctcgtcttgaattgtaatccttgtaatccccacgtcaagggcaggaccagatggaggtaattggaacatgggggctatttcccccacgctgttctcatgataatgagtgagtcacatgggatctcacggttttttaagtgtctggcatttctcctacttgcacccattccatcctgttgccctgtgaagaaggtgcctacttctccttttccttccgccatgattgtaagtttcctgagacctccctgagccatgtggaatttataaaggaaacctctttccattataaattacccagtctcgggtgtttcttcatagcagtgtgagaacggactaatacagcaggccttgttaagaagaacgaaatgctctagtatatttcaaaatggttactcccctctgtccctctgctacctgctatttttctctaatctttgctatgagaatttggtggttcttatacgagctcctgtaggtaaaactcacaaagtatgagggcctctttatgactcgggctccctggagtttttgactcttatacttgtccacactgagccttgagtgatttaacaatgataattcaggttttcctaccctggtactggttcctgtggaaatgagtttgtgttctggggagctgtgattctctgtatatccacctgtctgtctctccaattttggggacagtggtttgtcctgtgacctcacttctctgatggatctaagaagaattgttgattttcagtttgtttagctttttacttgttgttaggacagatttatgccatttaagctccttacatggggaaccagaacctggaagtcccagctgtaaatattgaaggcataatgatttcttaacttttatattctgatgcgtattgtttggttctctgcctttccaaaataggaattgaccccataatatttctgtacattttaactgggaatgttaagacctggataaattctaatcttggctctgctgctaatgatgttaccttgggcaaatcagagactgagttttctcatctataaaagtgaagggtgcagactcatttctaagtctccttctagctttaaaattctgaggtgggcggatcacgaggtcaggagttcgagaccagcctggccaacatggtgaaactccgtctctactaaaaatacaaaaattagccaagcttggtgtcgtgcgcctgtaatctcagctacttgggaggctgaaacaggagactcgcttgaacccgggcaaagttcagtgagccaagatcatgccactgcactccagcctgggtgacagagcaagactccatcttggaaaaaagaatctatattttatgatgttacaaaatattctctgattttgaacactaataccagtactctgggtaaacctgtgtgctcaagcaggtgccctattatactttctggaatttaaaaataaactttttattttggaataaatttagatttatagaaaagttgttagccagacatggtggctcacacctgtaatcccagcactttgggaggctgaggcaggtggatcatgaggtcaggagtttgagaccagcctggccaacatagtgaaatcccatctctactaaaaatacaaaaattagctgggcatggtggtgtgcacctgtagtcccagctacttgagaggctgaggcaggagaatcacttgaacccgggaggtggaggttgtggtgagccgagatcatgccactgcactccagcctgggcaacagaaaaaaaaaaaaaaataaaaataaataaataaataaataaataaataaataaataaataaaaagaaaagaaaagttgcaaagatagggctgggcgcagtggctcacacctgtaatcccagcactttgggaagccaaggccgatggattacttgaagaccagcctggccaccatggtgaaaccctgtctctactaaaaatacaaaaattaggtgggcgtggtggtgcactcctgtaatcccagctattctggaggctgagacaggagaatcacttgaacccaggaggcggaagttgcagtgagccaagatcgcaccactacactccagcctgggtgacacagcaagactctgtcccccgccaaaaaaagttgcaaagataatgcagagttcctgaataccccttactgttttccccattggcaacattttatattattatggtacatttgtcaaaactaaaaaccagatcatgaatggtacattactattagccaaactctaggcttctatttggatttcaccagtttttccattaatgtcctttttctgttccaggatccaatgcaagctaccatattacattgagtcatcatatctttccaatctcctctggtctgtgacagtttctcagtctttccttggttttcatgaccctgatggttttgaagagtgttgactagatattctgtaaaatgtcctcaaacttgggtttttctgatgttttcctcattactagactgggcttgtgggtttttggaaagaaaccacaaagatgaaatacctttcttgtcacattatatcagggattggttatatctatataacatcactggtgatgctaactttcattaattggttaaggtagtgtttgccaggtttctccactgtaaaatacgctttttgtctttcccaactctgttctttggaagtgagtcatcaagtctagcataccctgaaggtgggagaagagagggaattaaacttcattcacttcttaaagatagcagtatctacagatcacttagaatttttctataaggaaaattagtctcttcttccacatttatttatgcaatcatttattaatattaatatgaagtaatgtatatttattttatactttgaattataatccagtatacattattcacttttttgctcaaattgttctggctttggctggaagttctttcagattggttcctgtgtccctttgacatgctctatccttttgctttttcaacatttccttactatctggtactacaagatactccaggcacattttgtattttcgttgcccaagtcctgaaatcaaccttttctccaaaaagctctgggttttaaaacaaattacaatttatctgttttggtttttataagcattgccatgatgaccatccttgatgttatatctctggaaaactccatgattatttcttttagataaatatctaaaagtggaattcccggattaaaggcatctaaaatgcttttactatgttttccactaacaaggtgtgagatgggggggctgcctcaggggctgcaactcaaagcccacttcaaatgggaaacactatccatccgtcaatccatttatctatcttagaactctctttctatgactttcttattttcaaaacaaacaaggaataaagaaagaaaaaaatgaaacaagtaaacaaaagacctctcatctagactctctaaccacccaacaaatcacattgctcctcctaggaggaaatggttgaggtgtcagactgagaatgacatctatttcccttcatggggagagcacttgttaattcacctattaattcacttttaaaatataattttacattttatcaaagtaatacatatacatagtttaaacattcaagtggcactctaagacttaccacgaataacagcaatacagtgctatatcccttcccattgccaaactttcttcacagaaaaaatcactttcatttcttttagctttttttttttctggggtttatttccatatctataaagaacatgtttatactgcaatttaatttttttttcaattttagacattatctattgacttcttactaactatggaagataaagactgaagtctcttaccaattctatacacaaacacacacatatgtgcatcctttcctaaccccattctttcaatatagttataacttttgttaaatccattaatgttttcattgttgtgactctatagttattcatagctgagccacatattggactttaaatatattttcttatataacattttctttttcctggaattaataattatgccattttttggtttccttaacttactgagccgattactcatccttctccaaactttctaagagtgctgcaaaacttttcaagtttcaacatctgtcagatccattgggtcccctccatgtattttttcattggaaatatccctccttgagcctggcgtctgccactcacttgggctagttgctctccaagcctgttgtactcttatcatcttgggatctcccttggccaccattcttggaattctctctcttctatttgaaatttgctgtttttgggagcccatttttcctttttgttttggcttatgctcttgtttttgtagtcacttttttcaataacatctcgaaaatggtcacatgggagataaagttcttgaaacttggcatgttggaaaatgcagtttcaagaacgttgttttacctttctttctgatggatcatttggatgggtagagcatcctaggtgagaaataattttccaatagagttataaaggaattgatccattgctttctaacttctggttttgttattaagtctaaagccattctcatccttgatcctttgtatgtgacttatttttttcctatctggaaacattttttttctgtttattcttgatattctgaaacttcactgttttgtacttcagtgtagatttattttcatttattatgctgtttacagtgggccctttcaatctggaaacaaatgttcctcaattcttgggaattttattgtatcacttctctcattatttctttccctccattcctctgttctgtgcttctgtactgctggtagtcagatgttggctattcttcatctctttgtcttttcttctatcttctggaagatttcctcaactttattttctagtctttagacttcagctctcatattttgaatctccaagagttcttgttctctaattatgcctttatcatagcatcctattcatattttgtgggtacaacattttttcttattttctatgaaggtttaactaatatttcttttaaaaaatattctgctttctgcattgcctttctttcaagttttttccccccatctgctgttgggatgggagaaatttaatgaatttggctttgtggggttaggattaggtagtctatttctttttcagattttcaaccaatcttatgatttttgtttcagaggtatagtcaattctcattattccttcattattcctggcaattatgttcaataaaatcgccacaaacactgaattagaaaatactgctgagcgtggtggctcatgcctgtaatcccagcactttgggaggccgaggcaggtggatcacctgaggtcaggagtttgagaccagcctgaacaacatggagaaaccccgtctctactaaaaatacaaaatcagctgggcttggtggcgcatgcctgtaatcccagctacatgggaggctggcctgaggcaggagaatcacttcaacccgggaggtggaggttgcggtgagctgagatggcgcaattgcactccagcctaagcaacaagagcgaaactctgtctcagaagaaaaaaaaaaagaaaaaaagaaaatactgaattattctctgtgggggaaatatagagttaggtgcctgtgagcctctggtcacaacatttttgtcagctaatcaatacataaccttgttttgtgtgtgtttctgtttaaagacaccttatttaatatacattgttgattcatcaacattgaactcatggctaataacagtactatgactcatgcctgaatagagcttatttaacacacatattttctccatgaggcacagcctccttctgcttaggaacaccagacagcactccagcactctgcttggggggcattcgaaacagcaaaatcactcataaaaggcaaaaaattgcaaaaaaaaatagtaataaccagcatggcactaaatagaccatgaaaagacatgtgtgtgcagtatgaaaattgagacaggaaggcagagtgtcagcttgttccacctcagctgggaatgtgcatcaggcaactcaagtttttcaccacggcatgtgtctgtgaatgtccgcaaaacattgtgagtattgatttggggggttacaaataattcctagcaagtaggtgaattcacaaataaggaagctgtgagtaatgagggttgattttacctacctagtgtctcaaatcctgagccgtatgagattccgtggcataattatgtttgcttattgttggcaaccttattaggcatttctaggtttctgctttctcatctttaccagttcagttatggcttgattcatttctctttttccaaagatttgttgacatctcttatttgctgttgcctcttcccatttgttttgtcttgtggttctatatctttgccataatttttgtggagtttcctgagagagtagagataaatgtatatgctcaattggtcttgtcttaaccagaattctatttaatacacaacacctttagtgagctgttatgcatgtaataggtgtttactaagtattggttgaataaattcaagaaatgcttgctatttttgtgctagcatttagcttttctctatagtatattataatggaattttattttattttattttatttattttttgagacagagtttcactcttgtcgccaggttggagtacaatggcacgatcttggctcactgcaacctctgcctcccgggttcaagcgattctcctgcctcagcctcccgagtagctgggattacaggtgcctgccaccatgcctgactaatttttttgtatttttagtagagatggggttttgccatgttggtcaggctggtctcaaactcctgacatcaggtgatccacctgcctcagcctcccaaagtgctgggattacaggcgtgagccaccacgcctggctggaattttaaatatctcataattataatcttctaggtaaaagactagctctctttctcacccttattcctcctacttagtggaacattgcctaaggaagatggggaatgggttaaaaattaaaatgtggggctggaaagcatagcttgttttaaaacttagttttctttccttttgcatcataatctcttccccggtctatttatttctcgtggttttgtcagtccattacaaacggttgcaaaattgtggtactagaagggatcctagaaataatctaatttgaacctttgattgctaggaaactgagagtcaggctgccttggttcaagtcttggctccaccacccatgtaggacatgttgcttactgttttgacctcagtttccttgcctataaagtgggaataaaaatactcctgatgttataggattgttgtgaagattaaaagagataattaatgtgaagttcttagtactatgcctgacacacagtaagagctccacaaattattaatgatgattattactagtggctaaactgaagctctggtttctcagttcagtatgttttcctttagacgtaaataagaatttgtaagcctctttttggagtcagctaccattattttctttccttcatctccttcattgtctaaagacagttaacatgattgcgtatttctcatttcaagctaaagatactctcactgtttcagctattaccacatttgtaaggacttcctgaagagaaaatttaaaagttagtcacttcttttagttgtttctggtctttcagatgatcctttttttttgtagagttgagtgtttttgtttttgcttttgtttttagttaacaataatgcaatccatttcccagcataagtgggtaagtgccactttgacttgggctgggcttaaaagcacaagaaaagctcgcagacaatcagagtggaaacactcccacatcttagtgtggataaattaaagtccagattgttcttcctgtcctgacttgtgctgtgggaggtggagttgcctttgatgcaaatcctttgagccagcagaacatctgtggaacatcccctgatacatgaaggtgagtgctaattcatttagaagagtgatagtttgatcatctttttctactttataaaagtctttttctgttttcttcagtgaaattatgggtcagacccaccacgtgaatttctccttgaactggttgttgatagttaagggaatctaatcttttggcaggcaatattttaaaatgctgagatcagaatggagaatcatgagtgttagaggtgaaggattggggaaaatatctgaaataatggatttatctttcaggaaactctaggctagagaaaattagacctagaggattcagaggaaaatccttgtgtgtactggtatttcatggcaggagagctgagagagagtaaatcactaatagctaccacatgattttagtggaaagagtccaggtttggaataagacagtcgtgagtttgaatctcatttatgctgcttacaaactattatttttggacaatttacatgatatctcttggcctcagattccatatccgtaaactagagatgagtaatacaaaccctacacggatttttagaagtacaggatgtaatttgtatagtgtagttagcactttgcaggctgtcactgttccaacatgatagtgcttttgccagtctcactactggctgtctcagaatgttctttaaatgaaggcagcccacaacccaaatggatttatagactttgaaactggaggtagtcatctgacagctcgcaatctcatcttgggcaatgtatatataatcaatatcctcatccaaaaagtaaggatgtcattattttattaggctgaaattgccaagatttaactgtttttgacttaataaaaatagcaatttcatttgatttaacctaaaacataatatagaaataaaatttaaaatatgcaggccgggcaaagtggctcacacctgtaatcccaccactttgggaggtcgaggcaggtggatcacctgaggtcagaagtttgagaccagcctggccaacatggcgaaactctgtctctactaaaaatacaaaaattacctgggcctgttggcaggcacctgtagtcccagctacttgggaggctgaggcaggagaatcacttgaacccgcgaggcagaggttgcagtgaaccgagactgcaccactgcactccagtctgggtcacagagtgagaccccgtctccagaaaaaaaaaaagaaataaaatataaaatatgcaactataaatataaaatatataaatagaaaatataaaaatatctgtctcatttacctgaagggtgacaagaatctaaggagatagtatacatgaaagtgcttgtaaatctaaggccattattactgcgactattatcattactgcaagctccaaataaacatttaaaagagactgagaacagggcacccttctacttgatcagtgaaagtataaaccaagtcctgtgggtcttgaggaattctgaggcactgagagaggctgagcagtgcatcgcttgactacctccctctcagtgttatgagtctgcaggtgcttgaacttatggccatagtgctggccctagaagttactccctcttctttgccattttttatttttttatttgagacagtctcactctgctgcccaggctggagtgcagtggtgtgatcatagctcattgcagcttcaaactcctgggcccaagcattgtcccacctcaacctcctgtgtagctaggactacaggtgtgcaccatgacactcagataatttaaaatatatatatatatatatttttagagacagagtcttgctatgttgcccagactagtcttgaactcctggtttgccattctttaaaaacccagttctatactgcaggagatagtgtttggcacagaatgagaatcaacaaatagtagctgagtgaatgtatgaatgaatgaaccaaaggaaggcaagccctgggaaaatcacgtagtggtacattcttgtacaagtgaaatgagatgaagctcagcacccaggacacagccttgagtgggagctgaatggccaaagagcaccctgtgaagtatccattttatgggggattgcgtgggagtaaaacagccacactctatttcctttgctttggtcctgtgagacaggatgtggggaggcagggataatttaacatgctgaaatgtgtagcgtttcccagcagaggcagtagcttccatctttgctttcttctcgctgtgttcccagccactgctggtagtcagtaataagtgcttagatttgtttgcagtcgttctactccaaacagtagctgctactaggtttacatctcttttgttgttggttttgttgttgtttgtttgtttgttttaagatggagccttggtctgtaacccaggctggggtgcagtggcacaacctctgctcactgtaacctctgccttttgagttcaagcaattctcctgccttagcctcctgagtagctaggattacaagtttgggctaccttgcccagctaatttttgtatttttcgttcagatggggttttgccatactggccaggctggtctcaaacttctgacctcaagtgatctgcctgccttggcctcccaaagtgctgggattacaggcatgagccaccacgcctggccaacatctttaagcataggacaccactagttacttaagtggcatcactgtatattctaagagtcttttagttcaatatggcatatttgtagtgttgttggaagattttatagagctctgctaaatgctgtactcaaatgagatcccaccaatgtgagattgtttctaggaaatgacccctttttgaagaccagttattcaaaactgctgcatttcaaagttaaggctgatgacccagggatgcaggaaatgattgatggctctcctcaagagcacagcagaatctttgggaatttcttatggcccagatttggggaggctgattcacctcatttaagtcttcaagagactgatatattgaaaccaataagaaatagtctttctaatgcctggaaggctcatattctttgttcagggccttcttccgttaaattagtaatcagagagggcatcagagaatcagagcaatcagaaagggagattcggggttttgaagtatctttcatcaggttcatggtgaggtcttgtggctgccctgtcagagtctttcgctccagtgacaggaaatttcataatttcctttcgtagatagtactggataaaaactgccaacttctgtcttttttaaccatcaatattttacattctaaggtgacctctcctttctttcctcaaagtcttctgtttaggatacaattagttgagtagattcccgcaactaaatgataatgaaggttttccaaatccaactctttgagattatacacaggtttctttggctggagtcctgaatgaactcaagcttatcaactgcacatctacccaccacagataaccaggatcaccttgaactctctactggacttatttctaagcccctgggaggcatctcacctttttgcattttttttttttcttttttgagacagcatctggctctgtcacccaggctgaagtgcagtcatgagatcacagttcactgcagcctcaacctcccaggctcaagccagcctcccatcttagcctcccaaatagctgagactacaggcacatgccaccatacccggctgattttattgtgtgttttgtagagatggggtatcaccatgttgctcaggctggtcttgaactcctgacctcaagtgatccgcccacctcagcctcccaaagtcttgggattacatgttgtgagccactgcgcccagcctttgttcacattttttaccagcaagcagtcctttttgtggtgagaggagaatgtgggaaaggctgtggaggacaagcaagtattagaatgagagatttcatcctaatggcaaggcttgttgacttcccacagtcattagctcatttctctttttagatgctctttgcgctcatttcactattgtaactatacttactatgtgatatatgagactactatccaggcttctgtctctgcaagtggaccagtggttcttaacccatttctgttcaaacctactgcagaaatatgacatgagagtcctcagtaacagcagttcactctgaaattggtagtttccaaaaatattcctgctatcctctccatccttttctcccttccctttgttaaaaatcactgaactagaatatgagctctttgaggtcagagatgtgctcttctttgattccaaccacctaacacatggctgggacagtgctgaacacatagaagaatgcctgaggtcaccagtttgtttgtgagagggccaggaccacaactcaggcagtctcaatttctagaatgctacacttttcaactactgtaacttttccagttttgtctctgggatgatttagtactgctgatttttttctaaggttttttttttaaatttcacaaataatagctgagtatttttattgtaaaggagtcaagcaataattaccattaacttaaaaatattttaatattttattcaacatttaatattgataggattttaaatgcaaaaccgcttgtcagaatagcaattttagttttagcatctattattattcattgattcacttattaagactgccagcatcttggctttcatagccttcctttttaatgtgcttttaggacttgtaaataatgtgagctaggactaaaggcgtgtcttcttcttaacagatggagaagattaagacaacattctgaataattagacacaaaaagaatgttcttagtgttatagttatttttaaagacaccttttttcttcattgaaaaattgaaatgtttccctttgagttatatacccatttaaatcaaaatggctatctttattatcttaggcagttccaattcgctaaggatttcagttggttcatatgtgagaaaatgttatccctctaattttctccagaaatcctgcatgcacatttttctaaagtaacttattttgtaaagaacccttttcttttttttttctataatgatctggcagatgaaaatgtaacatcatttatttcttcctgaaatgaattactggttttacatttgctttattcttagactatcccaccatttcatcttagatgagatgaagagccagcattctttttgttccaataaacaagtaaatgccacaaacagtattgtctaccaggtaccaggcactgccttagataccaaggcttcaaagaggaagaagagaggttccactcttaagaaggtccctgtatgtagggaagccgtcaggtaaattgctgaccaccattcttgtggcagatgctgtaggacacatgatatagtggggcatggggcacaaaggagggaccaactggcatctccatgcgggaattcagagagggcgtcttagggaaggagagccttgaaatgagtctggaaaggtgattaatttgtcagaaataaggggaaaggagcactgtgggcatgcatagagcatggagatgtgagatagcgtggtgcttggcaaaactgtgagttgttccatttggctggagggcctaggcactgaggcaagggccagaggatggcctcatagctgcacatactcatttttttttctggagcacattcttggtagttggtatacttttcataagacatagtggagtagacgatggacgaaaggaaaacgtgttgtaattgcaaatctttaaaatgttgactggggttgatggagtaattatgaaggatctaggtgatgatagtcaacaaataaaataaaataggatccttcctccttccaaaatccccagaatctatttgccattggaaatagagcttttgaaaagagatatgaagcaaaccaactcttgactgatgtcattttcagctctctccccagccttcatgtgttaacctggggatgatgtggacctgggcactgtggatgctcccctcactctgcaaattcagcctggcaggtaggttgacctgggcccttttacagatcatgtgattattattgccttctttggacaagagttgttaactttaaagcgacacctggattatggacatccacagatagaaaaggggacttgtgaacaccctgaatttgtgtgtgtgtctgtgtgtgcacacatgcatgcaatttcacatatactcatgcatgtgcaaatgtggcaagatggcttaccatattttcaaagggagatacaacccccaaaatgctgagatctactgttttagaatatagtagtctctccttatctgtgggggaatatgttccaagatcctcagtggatgcctgaaactgtggatagtaccaaaccctatatatagtacatttttccttcacatatatacctatgatgaagtttaggtacatttaggcatgaagagattaaaacaataactaataataaaatggagccattaaaacaatttactataataaaagttaggtgaggtctggcacagtggctcatgcctgtaatcccagcactttgggaggctgaggcgggcagattttttgaggtcaggagttcgagagcagcctgaccaacatggtaaaaccccgtctctactaaaaatacaaaaattaaccgagtatggtggctcacgcttgtaatcccagctacttgggaggctgaggtgggaagatcacttgaacctgggaggcggaggttgcagtgagcctagattgtgccacggcactccagcctgggccagagcaagaccttgtctcaaaaaaaaaaaaaatgttatgtgaatgtggtctctctctctctaaatatctcattgtactgcactcacccattttcagatggcgttgatcactagtaactgaaactacagaaagtaaaaccatagataagagggaactactataataggaagtgcttatctccatagtttttgtgttgttgttatggcttcatataatacacatacataaatacaaaaataagcagttttcatactatttgccataaagggaaataatgaaacaacatttctatagtgttccaactcaagactacaggcctgatatccatacaatagcttgtagatctaagatccatttgtttgattatatcttaagtttaaaacaatattaagagcagagacactggtctggtagtgggaaggtggggaaggcgtcatgtagcgtattcgtgtgcttgggctgccataacaaaatacctcagactgggtggcttaagcaacagaaatttattttctcacggttctggaggctggaagtccagtgtcaaggtggcagcagggctggtttgcaggtggccttccttttgctgcctcttcacatggtcatccctctgtgcccacacaaccctggtgtctctcctcctcctaaggatgccagtcagattggattagggcccatcataatggtcccattttaacttaattacctcttcaagtgctctatctccaaatataatcacattttgaggtactgggggttaggacttcattatgtgaattttggagagacataatttagcctataacatgtactaattggggtcaccaagagggcagtcatgacccagagataatgagaatgccttcagacttctgtcctggcatggcctgccttagccccttggggttacacctgtggcactcaggagcttgatagaccaggggtccccaacccccaggctgcagaccatgttaggaactgggccacacagcaggagatgagctgctggtgagccagagttactgcctgagctccgcctcctgtcaaatcagcagcggcatgagattctcatgggagcacgaaccctattgtgaactgtgcatatgagggatctattaataggttgtgtgctccttatgataatctaatgcctgatgatctgaggtgaaacagtttcatcccgaaaccatccgtaccccaggtccatggaaaaattatcttccacaaaactggtccctggtgccaaaatgtaggggactgctgtgatagaaaatagatgatacaggcaggcaggactattgctctccctctcatcagcaattgctcccagttatctaatctaaacttctaattacagacactgtggctcctatcaagtcaccctttccctccacttgtctttttctgtcttctatctctgttttccactcttcctatgttgtacatataccagctcctacaaaactggctccaatatccaccattcttttcatctagaatatccttcccttggtcctgctcagccttgctcttctatgtcaagatatttttcaaaacactgactttgcaacagcaccaaagtgatatgagtatagagggaaggagggagatggagaacatctctataattttggaaaatgttcctcttgcgtatgggaaattctctgataagcaagaacattctcccaatttttcttagaggaagtgatgaatgtttttccccttatttctagaaataggggaatattgctatggttcgtattttgagggaatagggaaagaaagatgggagtgaccagcaagcctaaccttcagttgtttgtatttataaaataaaaattctattttgactaattttagatttatagaaaaactgtgaaaatagcatagagagttcctttctaccctcatccagtttatccattgttactatcttataatacaataaaaatttgccaaaactaagaaattgattttggcacattactattgactaaattccaaattttatttggatttcactagtttttccatgaatgacttctttctactttatttttaatttttttttctgagacggagtctcgctctgtcgccctggctggagtggagttcagtggtgcaatctcagctcactgcaacctctgcctcctgggttcaagcaattctcctgcctcagcttcctgagtagataggattataggcgtgtgccaccatgcctggctaatttttgtatttttagtagagatggggtttcaccatgttggcccggctggtctccaactcctgaactcgtgatccgcccatcttggcctcccaaagtgctgggattacaggtgtgagccactatgctcagcctgaatgacttcttcctattccaggatccaatttagggtaccacattgcgttgaattgtcatgtctccttggtctctgccggtctgttacaggtccttagtctttccttactattcatgaccgtggcagtcttaaggagtactgacaagtatttctgggtttagggggaaaaaggcaacagaggtgaagtgttcttcattgtgcatcacaattttacccatgtttgtgacaatcttctgagggagaattgaataagacttaaaataggcacactgattgccaacaaggaggaaggcaggacaacagatgtgtaggctctgccagccaaggcagttctagtacatacagccaaggtcgttcagctatgtggaatcactccagataactgaaactggaaaaggtaaagaaaatctagaaagtagaagtgaagtctaacattgttgatttggttcaattttattccagtttccctcaaccccctaatctgtgataaaatgaatctaaaatcctcatatgcagaattaaaatgtcatgaggacacaaaactagggaaagctattgttaaattcctcctccaagtctgagaatactggagagaacaggctatttaggtattagtcagggagagttgtttatgctgtaataataaacaagcctaaaatattagtatttaaaacagcaaactacatgtccatcacaggtaagcaggggctcaggctggtggggctctgctatcctcacacacaccatgtcagcatccgttttcaaggcgtgcagtaacaggaggaggagagaaaagagagtcatgcgccatcacttggacgcttcctctcacatggcaaaggccaaggcaaatcccatggccaccctattgatgagcactggaaatattggtgagcattcattttatctaccacaaatctcttctgtaacaccaatatcaagagagcctttgtaagactattgttctctcttaccatgtgccaaccagtaagggaaaaacaaatgtagtctcataagaacagcctgggttgagcggaaaatcatttttggaaccacttactcttctcctggtggctccaaaaatcattgacacctggtgacacttaacggttctgaaaaacagatatttaactctctttttagcttatggcttctcatatatgttaaccaaagcttttgaagaagcttaggagaggtatttaaggaagaacaggaaagagcaggattcacttaggtttgactggagtgtatttagatccacaaggatctattcctccattgatatcttggtggctggctttggattcaaccaacgcaagggagagcaagaatgaaaaggaaataaaataaaatatgactgcaggaggccgtaatgagaataatataagactaagactattctggggaaatggggaaaggcttcttgtttccttgttctctggccaagaatcaactttgaaatcctccggcgagttagtgtgacgagtatgagcgaaatgggggtgcggcagcctacccttttgtgaatatttgtaagaaacttggccagagactgaggatagatccacatatatacacacagacacacacacacacacacacaccacacatatacatcacacacaccacactacacacacacacacaccacacacactacacacacaccacacatatacatcacacacaccacgcacacaccacaaacataccacacaccccacactacacacacacaccacacatactgcacatatacatcatacacaccatgcacacatcataatcatactacacacaccacactacacacacactataaacacatcacacacactacacacaccacacatatgtcacacataccacacaaacacatcacacacaccataaacataccatacacaccacacacacacagaccacacgcacacaccaacacgctccagcggacacacactatatatgcattataaacacatcacacatactacacacataccacacatacaccacacataccctgcacacactacacacacaccacgtacacatacacactacacacataccacacacactctacacacacaccattcacacatatactatgcacacatactacacataccacacacatcacacacataccccacacacattttacacatgacatacacaccgcacactacacacacaccccatacacacacatgcactgtacacgcactgcccttatctctgagccatggagacagggagtgagtgggacagtgtgtgagttattcctcctgggtgttgcaagctaacccttggttcacctcttgtaggactttgcacttcctcctgacagttgggaggcatgaggtttgttaacattctgtttgctgaccccaaaagtcctcagggagggttccaagctgcgtgggctctttgagaaatgtgttaatggtgtagctttcaatctctatgtaacatgcagtattatttgattcagatccagttaactttggtctttttaagcatttggatctggagatcactggcttcctcatggttttcagcatgcaagtagcaaagatagaaagcctttgaactgcttgttggatgcgtgctgtgggtgcctggctcatgtgcaggactaggaggaaggcagcttctctggagagagcgagaaaagttgacacaacaggaagccatctagctctccctcaccctcatttgtcattctcagtggctcctttacccatgtagacaatgctcagttcatagaccaaatacatgaatgtatatacaaacacacacatttacaacccttttaaaatcccaaacctaaacaaaacaaaacaatgaatgctacccattctggaacccctttacaccaccttcttgttatagggtaatacctctgacagagttgaaatatatataatattattcagatgtgcagagaaatggaacatccctattttctatgatcaaacgagtcattttctaaagtccccttaccactggaaagtcaggcaagggtgagaaagaggagggtgtgggtagcacttaaatttgttaacgttgtgtcatttcttctggtttaagatgtctttggctagctcagtctctttggggttcctgccttgccctctgctcctccttaagattgtgtctgaatatatgagcaaggcttatgtgactgcagacttggatgcgtgggaataagtccttgtgttgccctctgtcttccctgaactgtctggtgtggtctgatccccctctgccatctgccatggggcagctggctttgcctgtgctttgggccacagcttatgctccagttgtttgtccatggtcctgaagttcctctgtgaatggaagctgcttcatcctcatcccaggcctggtcccgtctcacagctgtatcctcgcccctgactttgagggcacagggaaatttctggatccctgtgtgctacattcacctgcatagagctcacatgaggagctgcaccaggccaccctctgccagcacattgttaggacttccatgccaccatagagttggtgcttagtggaacatgaggcttcccctagactagtggtccctagcctttttggcaccagggaccggtttcatggaagacaatttttccatggacagggggtggggttgggagttgggggatggtttcaggatgaaaccgttctacctcatatcatcaggcattagttagattctcataaggagtgagcaacctagatccctcacaagcacagttcacagtagggttcagctcctatgagaatctaatgctgctgctgttctgaggcaggggtaggggtgggggcggggagctcaggcggtaatgctcgctcacctgctgctcacctcctgctgtgtggcccagttcctaacaggccatggacccgtaccttgcccagcggttgaggaatcctgctagactacagcctggcaacctcccccggacttgctgtacctggtgaaataggctaccagccagatgaccttggtgcatgggacccatccgcatgtttgtaccgctctatcaagaacactgacatcagaattctttgctttaccttcctttcattccctccccatccctgcccccatatttacttgttagaagtgatcagctttttcctacttcttgtctggtagagactgccttcctaggaagcgctagaccttcctttgatatataaaggtaatttaagaagttgccctcctctcacaaaaatgcctgcttcttaagactatgatctttccagaggctcaacaaagaagttagtataagcctcagagctgaacatggcccttagtctaaaattgctcttagttcttagttgtgcatgtgtgtttgtgtgtgtgtgtttgtgtgtgtgtgcatgtgtgtgtttgtgtgtgtgtgcatgtgtgtgtgcatgtgtgtttgtgtgtgtgcatgtgtgtgtgcatgtgtgtttgtgtgtgtttgtgtgtgtgcgcatgtgtgtttgtgtgtgtgtttgtgtgtgtgtttgtgtgtgcgtgtgtttgtgtgcgtgtgtgtgcatgtgtgtgtgcatgtgtgtgtgtgcgtgtgtgtgtgtgcgtgtgtgtgtgtgtgtgtatgtttaggatcaaccccttggtcatctagtgaagtctatgggctgattctcaaaacaatgtttgtaaatgcacaaataaaataaatagcattacaaagataccaaaatatactgaaatgaaatcatcaaaatattaatgaaatcatcaaaatattaaagaaacaaatttgtgatctggtaatatgtggtcttctttattaacacattaaataagaagacctaataattgccttaatttaggtctaatattaataattaccttaattcagaaatagtgataatagtatttcatatttgtattagtccattttcacgctgctgataaagacatacgcgagactgggaagaaaaagaggtttaattagacttacagttccaatggctggggaggcctcagaatcatggtgggaggcaaaaggcacttcctacatggctgcagcaagagaaaatgagaaagaagtaaaagcgcaaacccctgataaacccgtcagatctcgtgggttatttacttatttactatcatgagaatagcacaggaaaaaccagcttccatgattcaattacctccccctgggtcctcccacaacacatgggaattctgggagatacaattcaagttaagatttgggtgggggcacaaccaaaccatataaatattttaaggtacctgcagcaacgaaaatataatatgaaaatatttgtgatttataatggtgacaaagtcacaggcaatgatgctattactgtagtttgttgattacacttatgatggaaggaaatcctaaatttcaacagtaggttagtgaaaattaaagatgtaaattttccccatttaagttcatggacccctgaattctacccatggaccccttaaagatctaggtccctgttctagatggtagtatctggtttccctatgaaagtgtggatgctatggggtggggagctctcaggagcaagatttctaagatatgaagatacagttgaagatatttcataaatttctctattgtacaatcttctggaaaagaaaattgttgatacatatggttgaagtgtggcatggttgtattcttgcttatgcccacatcatctgttacccatgaattatccagagtgattctaccatttgatgctttactgagtatatcacaaatactttgtatgtatttcttggtgttttaaaaatgcttgctgctcaaatgttacatttaagtaagaatgtaaaaagggatttcttaaaaagtagaaatctagctcttgaaagggaataattaaagagatgaagttagattctttccattgaacctgattgctaggttacacctagcaactaaccaaaaaaatctagcttttgatcagcatattttccattaaaaatgttcaatgctggcaatatttattgtgtactgaaatttttgtgtttgtgtgtgtgtgtgtttaatttatttagctctgccagctaagcctgagaacatttcctgtgtctactactataggaaaaatttaacctgcacttggagtccaggaaaggaaaccagttatacccagtacacagttaagagaacttagtaagtacaggagcttgtgttttatcagtcagggcatgggggaggcagaggcttctgattcattcatgattcacatcccatatgaagcaaaaagtttcctcaatgacagcttctgggtgattactgtgtgcagccagtggcttgtggacgggatctggagctgcagagggaggggaggcatagccagtgttgacctcctcctggattccccattggctgagatgagtcaccagttataagcacagtggaaaaatctgtttatttactacactcaactataccctgcctctttccagaatgtgttatataaaactgttcattctttctggatccagatatagtaagtaaggttgtaaacccagaactaacaggcaattgaccatggtctgccactaatttgctgtgtgacctctgtcaaacactattccacaggacaatgattccccaattttttttactacctcaagcatccctctttattccaattctgtagaatgaaaattttataatttttaattattattctagccaaaagctagatgttttaagtaaatatttgcaggttaaaaaaaaacttttttttgagacagaatctcactctgtcccccaggctggagtgcagtggtgtgatctcagctcactacaacctccatctcccaggttcaagcgattctcctgcctcagcctcccaagtagctggaattatgggtgcacaccaccatacctggccaacttttgtatttttagtagagacagggtttcaccatgttggccaggctggtctcgaactccggacttcaagtgatccgcccacctcagctcccaaaagtgctgggattacaggcatgagccaccgtgcctgtcctttttaacaaaaatttttaacatagctcattacttccttcttgtgaataatgaataagggggcccatgttgggaagcattgtaagatgacctttagtctttttcatttcaaaacagtctgtgattccaaattctttatttttaagctaaatctcacattgcaagggaagtccactttatgttttcagtggaagaaatgaaaaaaacaagcagtattctcagcagcactgatatagctacgagaacctatgtcagagagatgctttaaaacaggagtcagcaaatttctcttctaaagggccagatggtaaatatagtaatattaagaaggagatcggtctctgtcagaacttttcaacactactgttatagcactcatacagctataggcaatatataaaccaatgggtgcggctgctttccaacgaaactttatccatggacactgaaatgtgaatattatataattttcacacgccccaaagtatttttgttcgttttatttatttttcaaccattaacagcatgtaaatagtcttaagcctacaggctgtgcaagatcaagagatgggctatatttgacctacaggctgtcgtttgcttatccctgttttagaaaataagcatgataaaggcccaataacccatgatccaaatgacttttcttccagatttgtcagttctagtcccagtgttgaatatcaattgctagtagaatgagaatctgggcacctttataggtttactgctatttttctgtcttatagagacatttcccctcttcctccatctttccctttgggttgttattattatcaccagttggacatggagaaatagaaaacacctgggaatccccaggcctatacccagctccccttgatggcctcaggccagctaggctgtctagaactcctaggccacttgcatttttgtgaatttatcaccaagaggatctcttccaagcaaagtggaagggtttccctgtggatggcctacctgggagcacttttcagtaggtcatggaataagccaaaaaccttctgatgtccagaaacaataggaaagaatttttcctggggagttggggatgccttcatggagataatgatttttgaactgaggctgaaaggaggtctagaggtgtggaaaaggagagaaagtttatttctcaaaggtcacagcatgaataaatgcagaaatattcaactacaattatagtaataacagctcacatttattgactctgtgctggacattttaaaagtgccttatgtgtattagctcatttcatcctcataaccctatgctacagatatattactgtcttcattttacagatgagaaaactaaggcacagagaggttaaagaacttgcccaagtcacacagttaataggggcaaagccacgattcaaacctggtctgattctagaacctgtgcttataaccacgacacattgccctggaggccatttttgtgctgtaaaataaccatcaaccactcttgaggtcctttctagtttcaaaattccatgattctatgtgtctatgtctccctgtatgtattccatgtgtatatgtcttcccacacaccagcaaacactggtaccttgcaaggtgggccttcttttctgttctcagcctgctttatctcctccacaacccccagaaccatgtggactatagctagaaccacccatctgattcccactaatatgtgtatttgttttcattaagttacagcttggtagtatatatctaatctatcatctatctatctgttttaaagatttttctgaaaacaatatataccaatgttcaaaaattcaacctgaaaaattataaagaatgtaaaaagttacccagaatcccactgccaagggtaacagcttgaacattttgatgatctctctagatatctccacaaagttatgtaaatatctttatgtttatgtaactgtgatcattctatacatgatatgcatcctactttttttcaccagcagtagatgcatctttccatatcaataaatacagtatgttaaaaaccatcacttacattctatttatgtatctaccataatgtatttaacaaatccttacatatatgaatatatttttacatatatatgtaaaagaataaatttttaaggctagaatctggagttttcagggacctactcatgatttcttgcaactatagcttttcatgctatataggacatgcattgcaactatagcttttcatgacttacagggatccaaagaggttttcatggctcctaaagcatctcaggcagcagaaagcaggtaacctttacctttccttggaggtgaggaaggaatttggaaagaggataaccaaatatcctggactatacagttctcaagaaaacccagagaaaaactaacaaattactgcttaatacattaaatatggttatgtttccaaaccattgtactaaactcatgttgaatcactttttctttcaaagcgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacataggtaagtgttatttgatactcttatatactctttattaaatgtttacctccttctctgttcaagaggtatctgtggactcaaaagtaggctcatcaagttcaaggatatgtgttgtgggtatacagaaaattcatcttctaattaaagaagaaaggaagtgggggaaggagggaaggaaggaagggagggagggagggagggattcaccaaatgggaaaaaaggaatgagaaacaaaagctattttgtgggccactggtttcctcttgtagtttgtaattgcactcaaagaaacaaaaaggtctctccccaccaccccaccctgccaatgtcattgctcataaacgaaaagagcataaaattattattttttaaaatgcctcaccacttctgacttaaaaaaaaatctttttcaaagactaattttcaccatatacttttaaaattataactgtattgagatataattcacattatataaatttcacctttttaaaatgtacagttcagtgatttttattgtattcacaaagttgtacatatgttaccactgtctaatttcagaacatttttattgccctcaaaagaaaattcatacccattagcagtcagtcctcaatcctttgttttctctttcctccattctctggcaaccactaatctattttctgcctgtatggatttgcctatacattttataaaaatataatatgtggtctttttatctaatttctttcacttagcataatgttttcaaggttcatcaatgttgtagcatgtattagtgctttaattctttttatagctaaataatattccactggatgtatataccacattttgtttacccatacatcagtttatggacatttggcttgttgctaccttttgattattatgaataatgttgctgtgaatatttgtatacaattttttgtgtggacatgtttcaattctcttagatatatacctagtgaaattgctgagtcacatggtaactcaatgtttaacttttggtagaactgctaaactttatcaaagtgactgcaccatttaacattcccactggcaatttataaaggttacaatttctgcataccctcaccaacacttgttattgtccatctttttttaattatagccatcctagtgggtgtgaagtgataccttgttatggttctgatttgcatttatccaatgtctaatgatattgaacatttttcatgtgtttattggccatttgtatatcttctctggagaaatgcttattcaaatcctttgcctatttataattgagttgtctttattgttgagttttaagaattgtttatatattcttggcacaagttccttatcagatatgtaatttgcaaatatttcctccctgtttgtgggttttcttttactttttaaatggttaaggtagaaaaatatttatatgaagtcaaaaatgtatatattttttatttgattgtttgtactttaggtgtcatatctaagaaaccattgcctaacctgaggtcagaaagatttactgctgtagttttttctaagagttttgaagtcttagttcctacatttgaattattgatccattttgagttaatttttgtatatggtgttaaataggggtctaactttattcttttgcatgtggatatccagttatctcagaatcatttgttgaaaagatgatttctgaccccatggccccatcccacgttgttgaattgtcttggcacctttgtaaaaatcaattatttcaccataaatgtaaggtatttttcagggtcttcaattctattccattgaactatatttttgtaattaggccaataccacactgtcttgattactgtagccttataataagttttgaaattgggaaagtgagtcctccaactgtgttctttttcaagattgttttagctgttgggtcccttgcatttccatataatattttagtattagcttgtcaatttctgcagagaagtcagctgtgatttcaatacggatattgtcatcttcataataaacaatcttccaatccatgaacatggaatatctttccatttatttaggctgccttcagtttctttcattaatttgttacagtttccagtgcagaagttgtacatttctttggttcagtttattccaaagtattttattcttttaaatgctattgtaaatggaattgctttcttaattttattttcagattgttcattgttagtgtatataaatacaattgatttttgtatatcgatttggtaattggcaaccttgttgaacttgtttattggttctaataggttttttaggtggattccttaggattgtctgtatacaaggtcatgtcatctgcaaacataatcttatttcttcctttatgatctggatacgttttatttttcttgactagttgccttgtctagaacttttagtatagtgttgaatagaagtgttgaaagcagacatccttttcttgttcctgatcttagggggaaagcatctagtctttcaccatttaagtttgatgttagtttagctatgggtttggtagatacccattgcacattgagaaaatttccttccactcatagtttgttgagcatttccttattgtgaataggtgtgggatcttgtcacatgccttttctttatctggtgggatgatcatatggttttgtcttttattaaaatggtgtcttacattgactggttttcataagttaaacaaaccttgtatttctgtaataaattccacttggttgtggtgtataattctttttatatgtcgctgaatttggattcctggttttttattgaggatttttgctcctatattcaacatggatatggtctgtagctttcttgtgatatctttgtttttggtatcagggtaatattggcctcatagaatgagctggtaagtgtttcctcatcttctattttttggaaaagtctgtgaaagactagtgttaattatttttaaacctgtcaatagatttcctcagtgaagccatctgggcctgggctttctttgtgggaagtttttgacttggtttctttataaaactttttttttaagacctccctttggaagacttactccacactgtaaacattggtgttaattcatgatgatagacctggaaggggacaagattattcactttttctcaaaaaccttcattattactatttttactttcttaaaataaatgtattattactttagcaattaaaatattaaaaagcaaattcagttacaaagaaaactcaaaacaaaacaaagcaaactttctagtccttctttcaactagatttagtatctatttaaatattctgtaattgccactgcttaaaactttgaggaggaattttggcctaaattgatacaatactggaattataaaattaaactctgaagaaactctgtttttataatatgtttctaggacctggtaaagtgttgctaagtactaagattttttttaatcctttaatgaaagcatttaatatcagaataataagcataataattttataataattaggttagtacaaaagtaattgtggtttttgccattactttcaatagaacttttcttatttaaattcaagtggatagaactatgacagtgcttttaagagcaattaaaaatattttgggctggcgcggtggctcatgcctgtaatcccagcactttgggaggctgaggcgggcaaatcatgaggtcaagagattgagaccatcctggccaacatggtgaaaccccgtctctactaaaaatacaaaaattagctgggcatggtggtgcgcacctgtagtcccagctactcgggaggctgaggcaggaaaatcacttgcactcgggaagcagaggttgcagtgagccgagatcatgccactacactccagcctggtaacagagcaagattccatctcaaaaaatatatatattttgatctctaattgagatacgtccttcctacccccagtttacagtgataatttgcttaaacctttttcacagataatgccggagtttactttggtccagcctctgacataaattattacagttagtggtatctaaataaataaactttagctatgtttgatatgcatcagtttttgacttaaaatgtattctgtctgattttagtatgcccaccctgctctcttttgtttactatttgcatggaacatcttttttcatcctttcactttcaatctatttgtattttcagatctaaagttagtctttgtagatagcatatagttagatctttttttaatttaaattttttattttattttttatagagacttgctatgttactcaggctggtcttgaacttctggcctcaaatgaaccctctgctttggcctcccaaaatgttgagattaccagcataagcccttgtgcccagccagttggatttttttttctttaattatctgctgatctgtgtatttgggttggagagtttaacctatttacatttaaagtaattgttgataaggaaggacttacttttgacatttaaaattttttcttttatattttatagcttttttatccctctttttttcattattgtcttcttttgtgtttagttgatttctttgtggtgacgtgttttgatttcctttggtgtattttctatagatactttctttgagattaccatggggactacaaatagcatctaaagttataacaatctaatttgaaatgatatcaacttaacttcaattgcatataaaactctactcctacacagcttcattccccatccccattttatgtcattgatgtcacaaattacatctgtatccactgtataccataaagctataattgtttttcatacattagtcttttaaattctttggaaaataaaaagaggaattataaaccataattacaataatactagcttttatatttgcttgtgtatttatactagagatctttatatcttcatctggctccaagttaatgtctagtgtcctttcatttcaacctgaaggactccttttagcatttcttatagggcaggcctattggtaatgaactctctcaacttttatttattttggaatgtcttaatttctccctcatttttgaagaatagttttgccaggtatgtaattctcagttgacaattttttttctctttcagcactttaaatgtattatcccactgccttctgggctctaaggtttttgctgatcttagttgaagatccattgtatgtgatgagttgtatctctcttgctgcttccaagatactgtctttgtctttctggggtttggttgtaatgtgtcttagtgtgggtctctttgggtttatcctacttggtattcactgggattcttggatttgtagatttgtgtatttcatcacatttggggactttttagctactatttcttcaaataatctctccaccacttcctctctctcttctctttcagaaactcccaaaatgtgtttattggttggcttgatcctgttccacagctcccttagactctgtttatttttccttatattttttctttctgttcctcagactcaatactttcagttgttctatcttcacatttactgattgtttcttatgcctgcttaagtttactgctgaacccctgtagtgaatttgtatttcaggtactgtgattttcaacttcagagtttctgtttgcttcttttaaaaaaataatttatatatttttgttgatattctcattttgttcatgtattattttcctgatttcctttagttatttgtccatgtttaactttagctctttgaacatatttaaggtgatcattttagggtcttggtctagaaattctgatggctgggcttcctcaaggacagtttctgtggatttgttttgtttacttaaatgggccatgttttcctgtttctttgtatgccttgcaatttttgttgttgttgttaaaaattgggcattggaaaaaacagctacctctccacgtctttgcagactgactctgtgctggggctgttcttcatagattagctgggcttactctgagcctagggatcagcccaaggtgaaaacttaaagtcttctcagttcttttctgagtatacatcttgtgtaggcctggctggtgctttctcagttacactgtatatacacacagctgcttttttttcttctttttttgagacagggtctggctctgttgcccaggctggagttcagtgatgccatcatagctcatggcaacctccccttcctggtctcaagccattctcccacctcagcctcccaagtggctgggactacaggcacacaccacacctggctactttttatatttttttgtagaggtggcatttcaccatgctgcccaggccagtttcaaacttctgagctcaagtgatctgcttgcctcagcctttcaaagtgttgggattacaggtgtgagccactatgcccggccacagctgcttttgaatgtcttaatttcccaaagagtcttacccagtttctccttatgattttatataatttattgtatgtctgcatacataatctcttgccccaggcttccatgtgtctgtagtctccctgtagcttttatgagcagtgcctggctcttttcctgcctgagattaaagttaggcaaaacagagaccagtcgtttagtctgccctcagacaggctggaatataagtaagtgtgctctgttctctttagttggtagaagggaaataggacctgagatgccaccttcttcaaaccaagaccactgatgtttcagggagagggtggggcaagggcaagtaagacagccacaaaactattttcctgccactttgaaggtgactttgtcttgatttggtgtttataatggttataaaccttgggttgatttccagagctcctacaagtttagttcagccagtttctgtcctttttttttttttttttttttttttgagatggagtgttgctctatcacccaggctggagtgctgtggcgcgatcttggctcaatgcaacctccgcctcccaggttcaagcgattctcctgcctcagcctcccaggcagctgggactacaggcacgcaccaccatacccagctatttttgtatttttagtagagacagggtttcaccatgttggccaggatggtcttgatctcctcactttgtgatccacctgcctcagcctcccaaagtgctgggattacaggcatgagcctccaagcccagtccagtcttttttttttttttttcaatgttttcatgggagaacaagaacttagagctacctagtctgccattttgctgatgtcacttgatataaatcagttcttaatgagatattctgagagctatttttattcagaggaataactaatactttctatctccttggttatagagtattagagttaagtggaactacagtaggtatttgtgtttattctgactggaggtggttagtgtaatgaacaagggcagaaactttggtgtggatacaaatgagtcttagattggcttcttattagaaagttattttcccttttccaataccagttttatcttctgtagaatggatataataaatgttaggtggttgagaggattcaacaaaatgattcacctaaaaaaatacttatcaagtgctcaatacatataaataattttatggaaatacttaatatgtctattgtatacagctctacttactagtggccacacggattgatgaccaccctttagtccaggcatcagtacaaattattttttgagtagctaccaagagttttctgaatatttttacccagttaatgttttaaagtccatgtctctaagtagggattttgctttctaaaactcttcaagaattacaaagaccccattctccatgatgtgattattttacattgcatgcctgtatcaaaacagctcatatgtcccataaatatacacaccaactatgtactcaaaaaattaaaaattttaaaaattaaaaaaagaattacaaagactaaaaagataatactattcaattctagctagcaagagtctggtgagatgggtattcatacaatgttgatggaaactgaaattggtataacctttctggaaagctaaatggcactgtgtgacagcagccctaaacatggtcatgcccttttacccagtcagcctctgctaaggggtctagggaaaccaccagagatgtaaaggaaaattcaaccatcatccatttactcattcacttaacaaatatttgatacctgctaaatgtcaggtgttaattctagactctgtgatcaagaccagcctttgtcctcaaggagttttaaatgaaaaattagaaacactattgttagcggtggaagttatctgagttaccagcagcaaatccgtatgggtctgcagcaacctcagttcttgcctcctcggaagaaagaattcaactgaggggcatacgacagaagaagaaactgaggcacgttttagagcaggagtggaagtttattaaaaagctttagaggccgggcgcggtggctcatgcctgtaatctcagcactttgggagcctgaggcgggcggatcacgaggtcaggagcttgagaccgtcttggctaacatggtgaaaccttgtctctactaaaaatacaaaaaattagctgggcgtggtggcagatgcctgtagtcccagctactaggggggctgaggcaggagaatggcgtgaacccggaaggcggagcttgcagtgagccgagatcgcgccactgcactccagcgtgggtgacagagcaaggctccatctcaaaaaaaaaaagaaaaagataaagaaaaagaaaaaaaagctttagagcaggaatggaaagaaggaagaaggtaaagaacacttggaagagggccaagtgggcatcctggaggtcaagtgccccgtttgaccttggacttttctgcgccttgggttttctacgccggcctacttccggcaccttgcgtcccatttcccttgattcttcccttacggtgagctgcccacttgcacggcggcctgctagaacttaggaggtgagcatgcgcagtgtatttactggagtcgtacgcatgctcaactgaggcgttcttcccttttccattggaatgcccccagaagctcatataccagttaaactctgccattttgcctcttaatggccatgcttgagcccactcgcccagttcctgagatttttttttttttttttttttttttttttgagacagagtctcactgtgtcgcccaggctggagtgtggtggtgcaatctgccacctctgcctactgggttcaagtgattttcctgcctcctgagtagctgggattattggcgcccgccaccatgcccggctaatttttgtatttttagtagagatggggtttcactatgttggccaggctggtcttgaacccctgacctcctgatctgcctgcctcagcctcccaaagtgctgggattacagatgtgagccactgcgtccagcccaattcctgagatcttactggggagctgccaatcaccagttacaggtgtttttatatattgggaaactgcctttccctggtgctggctacagccaattattaggtttgcaaggcagcgtgacaatggtctgagcatcacctgatggtcacctgactttcctggtggggtgtagggggagccctctcctgtccttctcatgcctgattagctacctactgtaataccatgaatgtgcgataatagaacataagtcaaaaaattatgttcattcataaagtagaatattatgaaccttaaaaatcatgttttgaagaattattaatacaaagggatatatgctgattgcataatgttatttttaaaaaacaaaagctttatttagcgtaataccaattttgttagaagataatgcaaataattatacggaaaacggctgaaaggaaatataacaaaatggtaataagggttatctctggttgatgggataatggatgatttttagtttttctttgtatttttctacacttaaaaaatgttgtataataagcatatgctacatttataactagaaaaatgcatattttcaaagagagaaatttaaggctaaaatgtttgcagtgtgcaaggaaaatgagagttattttctagtgtttatagtgggtattccatcatcctaggggtcaaggaaggagaggcctaggggaggtgagagtaaataagagagacagcctattttctggttgtgtggtctctttttacctcccttctgcttggcatagcatatgaccaatcaataagaggctgatttgctgaaaaatcacaggaatgcatccttctctcactgggtattcctttttcagaggtgttggggttgggggggtgacattccttttgtactgccttgcaaatgccatcttcgttccatatagcagaccacaatgcacgtatcattttttttcaattttgggtggatgctattagcaaattcttatctttttgcagatatgagagttgtatgatttttattttcagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctgggtaagttatgccattataataatattccaattagaggcccagaggaaaagaatcattgacaactattgttgacctggaatcattatttcactttttacattaaaaatagaagagagacattgctaagtacttctccttccagttttccatttttccatctggaccttttagattggaagggtgttctacaataggcatttttgccttctgagcacagggacataataaagagtgagaaatttacttctgcattatatccaagtttgtgtctggctatgttggctaccagagagtctatggtttggccattttattttttatttttctgaccttttataaaatcatgaggtataacatacatttggaaaggtgaacaaaacgtaatattacatttaacaaattattattaagtcagtgctcatgtagaaaccactgcggccaagaatagaacttctccaggatgccagagccccctgcttaccctttgctcatgacctctgttagagctgttaccctgattttcatggtaatcttctttgctttcattttttaccatttaaggctgcatcactgaagaacatagtttaagagactatgccctgtttccttgagtcccaggatgaagaagcgcccagtagaaatagaggaggagcatataaagggaatccatatattttgtattttctaatgtttggcttctatctctcaatattgtgcttttaagacttattcatgctatataatgctgtagtttatacattttcattgctgtgtagtatctcatagtatgaacatgatggaatggtggctttaatttgcatttacctgacctttaatgaagttacacaccttttcacatgtttattggccctttggattccttcttctggaagcgctgatttaagccttttgcatgttttttctattggctggtctgcctgatttttcaattgatttgtaggcattccttacatattctatttatgagtcttttatttgttacgtgtattgcaaacatctttcactatgtggcatgacgtttcactctcttaatggtgacttttgaggaatagtcacttaattttaatatggttagagttttatcagtctttacctttatgcttaatgccttttgtgtcttaggaaatgttttcttacctcaaagtcaagaaaatattctgcagtttccatcaatgcagcctgaaattgtatcacctttttgtaatcatctcatatttattgcctttttataaattttagacagggtctcactctgttacccaggctggagtgcagtggtgtgattgcagctcattgcagccttgaactcttgggctcaaacgatcctcctgcctcagcctctcgagcagctaggactacaggcatatgccaccatgcctggctgatttttaaattttttttgtagtgttgcccaggttggtctggaactcctggtcttaagtgatcctcctctctcagcctcccaaagttctgagattacaggtgtgagccatcatgagcagacacattattgacttttaatcaactattagccaattaaatctttaagactttttacctcctgaagacttgccagtaaaacatacctctactatcttatcatttgttggtttttaacctaagttcaggtgttttatttattcttattgaatgtcttcatgttggtcttatctatcattccagcctatttagaatcctgtttggtcacccaaaacttatgattaactttttactttttaacttttcagtatccccagatttgataacacttccttctatacctttatctaattattaataaaaatggtgactacatcagagccctgtggtaaaccagtagaaaccatccagaggatcaacccctcctttggatatggtcatttattcaggtttctatgaatatacctaattaccactatcatcattcagcctacttttttttatcttgtccaggaggctatcatgcgaccctttcccttgtggaaacccatagacaccctgtttactgcagcatgctctccttgtctggaactctttcagaaaagcattatttgtcctattgttgcagaatttttgctccttagttcagctaaatccgggttcttgtgtcaacaggaaaaattaggcacgtggacacattgaagggtgaggagagaggaatttattgggcgaaaaggaaaaaagagaaaaaaattctcagcaaagcgagatgggctcctgctaacaggctaccacctcacagactgaataccaggccaccacacaggagctaaagaggccaggctccttccccctgcacaaagcgtgaacttcccgtggctccaccccattctcccagtgcacaggcgggtccccagtctgttgtcgacatgcgcggacaagaccctgggcaggtttcctcatctacacaaaagcatctgatgtaaacacttgggcgggtcagagattctctgggaaccccccttatctgccttctgcctctatcactgtgttcagagagatgataatggccacttctccccccagcttcctttctaagccagctctggaaccattctctttgaacctgcctacatggaacattagattcattaattgtagtttggggaacccctaagcagagcagtccccggtatagcacaagctcctcttcataccacatgtcatggtctccgtgaacctgagaaacttctgggatagtctactggctataaacccttaattccttctatttggctgagtgcagagttactacagctgctgggggataggattcaacaagaaaaataaaccaggaccagagtccctctggaaaattactataccgcatataacactaagtgagggcaacgggtataaactacccaacccttggcatcctgtaccccgtatctttaacaaactcacccacatctgtactcatctttgcttcctgccagtcccagaggtaaaatgtcctgcctcctgttttcctggaggatgcaggaaggaaggtggaagtctgtactactctttctctctccttagctagcttgcttgcttgcttgcttgctttttttttttttttttttttttgaggtggagtttcactcttgttgcccaggctggagtgaatggcatgatcttggctcactgcaacctccacctccggggttcaagtgattctcctgcctcagcctcccaagtagctgcgattacaggcttgtgccaccacacctggctaattttttgtatttttagtagagatggggtttcacatgttggtcaggctggtctcgaacccctgacctcaggtgatccacctgcctcagcctcccaaagtgttgggattatgggcataagccaccatgcctggccttctccttagctttcaaatacaagcagttatcctcagttgcaatcccagctaaacccaactctgctcttcccaaccttctatcaaagatttccattgttgatggaaaagggtccaaattattaactctgtgagacctggcatctaccgatcccttcacgctcttgctcttgcctctctggtcattctgaattgcttgtttcccttgcatcatgttctctcactctttctgtgcctttcctagaacaccctctgcttttgcacctctcctgccccaatctccacctttcagaactcaggcctgacatatttccttctgagggcctgggcctggtccctcctctgcatgcttctgtcattgcacttaacagcaatgcatttcaactttctcttccagttacactgtaaattcttcaaatgcagggaccttagttttcatctgttttccctttgcctggtgcatgcctgtgctcaataaatatttgtttaaatgtagccatgtaaaactaatgctaaaattccaacatgtccgtttaacaagacccatatttgtatgatattatgagtaacaaagagcttccttatactccaaattatttaatccttgcaaatatcctgtaattgaggccttgctatccccatttttgcagattaggaaatcaagatgttgaaagcttaaatcatctattcaagatcacagggcttgtcagttgcaaacctaagctcaggttttctgtctcccaggtttgccatccatgtgaccttacctcaacaccctccagattcttttgtggccctagtctaaagggtttgcacctttgtataataaagccatgtgagcctcttagaaagggatctcaaaagtattttaagaatttgatttatggactgggtgcagtggctcacgcctgtaatcccagcactttgggaggccgaggtgggtggatcacctgagatcaggagttagggaccagcctggccaacatagtgaaaccctgtctctacgaaaaatacaaaaaaattagccgggaatggccgggcacggtggctcacgcctgtaatctcagcactttgggaggctgaggcgggtggatcacaaggttaggagatcgagaccatcctggccaacacggtgaaaccccgtccctctaaaaatacaaaaaattagccgggcgtgttggcaggcacctgtagtcccagctactcgggaggctgaggcaggagaatggcatgaacccaggaggtggagcttgcagtgagccgagatcgccaccgtactccagcctgggtgacagagcaagactctgtctcaaaaaaaaaaagaaaaaattagcccggcgtggtggtgcggacctgtagccccagctactggggaggctgaggcaggagaatcgcttgaacccgggaggcagaggttgcagtgagccaagatcgtgccactgcactccagcctgggcaacagagtcagggaaaaaaaaaaaaacaaaaaaccacacacacagaatttgatttaggttttgtatcagaacttctgactcatctattaagacaaacactttgggtgagttaggatttggcacaaagcatagattgttaacagtgaacatgatgaagctaattaatgttttagtagggttccattgcctgtgcagagttggggaagttttggatctaagcctgtatataaaggatcaattgatcctggatcctgtcggagccagaggcaccttggctggacaaaataacaaagtaaaggagccttacaggcaccttgattaaaagactgagcagccgtttcatcttctctgaggccggggctgggaggaagaggcttccgtggctacattaggcagaactttctgtgtaatgtacgtgatgagaaccactacacaggctgagcatgtgctaagggtacaacaaagcaggaggaaaaattgaaaggttaaaaagaagaatattatatattttttaaagcatgacaagtaaaatagaggtttattagacttccttacacttgctgtatggattagtatttttattttaaatcacatatggagggcaccatgtggttgggcctttcctggcagtcttaatcctgttctagttggatccctaactaacaacaggctgtctcaagttactctctccacaaccctagtctgccatcacagcatctccggggcctgtttgaagaggatgctcagggaacctgggatttagcccccaaagtgtcattgcctcttcttgttccacctccatctcaccaggctgggagttccaaagtccatctgcggctgtcagctttctgccatagacacatatcctccttctgcccaatttccttaaagcacaggagctgcaattaggtactaattttcacagctgggacatagatgcaagtagtatcaggacttccttctcttgcaggatccatgggacgatgctgtgtgcatactagttaaatagacatgcctattagtgcagtttatttttttattaatcagctcaaaataagctttataaacctttaggctttgggttttataaactttaggtttataaagctaatattgagctaaatgtttatattgaactaaaggtttatattgcagcaacaatgactgtgctcagaaaaggaatagctaaatgtttagtttctcttggagagctgagtcccagaaattatataaagcaacaccttcactttaccaatgagaagctgacatctagagaaaataactgattttatttacctctttcctccccaagagagtatcaaaattaatttatacattcaggccattgagactttcagcagcttgactggtcacccaaagaccagtgctttgaagtgaaagatttgggtaaaacgaaaaagccgaggagtgaagaaatctgtgttctgatcctattctgtagatcttctaactttcatttaaatggttatttaactttcctgggtctcgtggatgacgtgaggattgcatttgatgcagctaaggtctctgtttctgctgttccatgaggcagtatctctaggtgttggagtcacctcctaggcccaggttgccctgggtcatgaggcttgcgtcttctagaacagcaagcagcagagctctgctcacccagaccaggccagaggcaggaatctctgccccataagcttagatacaggaaatgggaagggagttggtggttcatggggatgttcatatctgtgtaggtaccaattgttcccaggcacatatggaagtctgttaataaaaatgatatattttaaaatttgatttagagtgttactagttctaaaaatgtaaaagtacactaggtagtgaagaggaaaatgggaggataacgtgtggtctccatttcagtttaggattgtctctgtcttgtagatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaaggcaagctactccctgcgattcccgtcctgtctgctctggtgtagggctgctttgggctagacttggtggggtttgtcaccacctggttgggaatcatggaatctcatgaccccaggggccccctgtaccatcgagagtgagcctgcacaactttgtgccccaaaggcaaaggatcacattttaatactcatgaggttcttatactatacatgaaagggtatcatatcatttgttttgttttgttttgtttttgagatggagtcttactctgtcacccaggatggagtgcagtgatgtgatctcggctcactgccaccaccacctcccgagttcaagcaattcttgtgcctcagcctcccaagtagctgggattacaggggcccacgaccatgcccggttgatttttgtatttttagtagagaagggatatcaccatgttggctaggctagtcttgaactcctgacctcaggtaatctgcccaccttgacctcccaaagtgttgggattacaggcgtgagccactgtgccccgccagtatcatatcatctgaaggtatcctgtgataaattaaagatacatattgtgaatcctggagctactactcaaaaaataaataaaggtgtaactaatacaatttaaaaaatcacatttttaatgacagtgaggaaaggaaagaggcatggattgcaggttgatggagtgcttactaagtgtcagtatggtcattaagagcaacgcttccagtcagtggccttggcttaaatcccaagccaggtgtctttgggcaagatacctaaactctcagttcattctcagcagtttcctcgcatttattccccttttctatattgaaatagaatatgtaagttgagtttatagtagtacctattttttagtattattttaaagattaaatgaaataatgtgtttagcccatagtagatattcactaactgctagacttcctattcttattatttatcctcctactattatttttaatcctccttaaagcactataaaatatgtagagtcactcccattttggaaatgaggaaactgagtttcagagatgctaataaacagctcagggtcactcagcatgtgttacttttctcaagagccttgcccagagtctgaccctcagtggacgatcaataaatgtgtgatgaatgtatcagttttctattgctgctgtaacaatacaaatttagtggcttaatgcaacactaatgtattctttcatagctctggaagtcagatgtccaaaatcagtttcactgggctaaagtcaagatgtcagcagggccatttccttctgagactctgagtggagaatctgtttccttgccttctccagcttctagtggctgcctgcattctttggcttgtggtccttcttccatctacaatacttatccccccatcatcacatcacctttccccactcttgtgtgtcaaacctctctgcctccctcttataaggacttttgtgatcacagttaggacccacctggctaatccaagataatgttcccatctcaagatcattaacttaatcacatctgcaaagtcccttttaccatataaggaaacatttacaggttccagggatttggacaagattttttttttttttttttttttttttttttttgagatggagtctcgctttgtcgcccaggctggagtgcattggtgtgatctccgctcaccgcaagctccgcctcccaggttcacaccattctcctgcctcagcctcccgagttgctgggactacaggtgcccaccaccacgcctggctaattttttgtatttttactagagatggagtttcaccgtgttagccaggatagtcttgatctcctgacctcatgatctgcccgcctcagcctcccaaagtgctgggattacaggcatgagccactgtgcccggcctggacaagatattttgagggccatttttcagcctaacagtaaatgaatgactaattggatgaatacttggtgatggccacacatcttcttctgaatgatggacaagaaattttaaaatgcccacccttctaaccttcctctgaggctttaaccttatttatttataagggatgtgagttttagaatatgaactccccccatggccatgatttcaggcctcatgatttcaggtggtttagggatacccatattgtaatagaaaattagatttcagtctcatacccaagttgcagactggtctcagataacatctggggtcaacttctgtgctacctcatccacacaataatgatttattcctttggatcctggttgagtttccagtattaacactagtattaacagatgtttggtgcattcaccactatggtcagatgcctggaaccaatttgatgccttctgaattttgtgttccccactggagatgttcatgcagtatcatttagcaaatagttctcttcctttgcctcacttttcagcaggcaagctgatgattaagtgctcccttgggtgccattgtgttttgcctagctcttcccctgccatggctgtcactcttctttctagtgacctcctggtgccatcgtggctcagagtctcaagcttatcacagaccagccagtccctcgtgtcagttttctcagcttgttttgctgccagaaaaaagatttgctatttcatctgatttattagttcagctagcttgatttaattagcaaacacttatttatcaaagtcaccactagagaacttttgcttttgtccttcttcattttttcaggatcccagaagaaactgattaaaatgcaccccccagccaatcctcatttcttgttttcaaatttataaagcgtgtgttttcctatttcaatgaaatgccatttgtttaatgcgtaccacttcaaacctctctaattgtttcaaaacatgtattctaagttgaatgtgaagcactgcctattttattttggatttcaatatattgattattagagttacttacctatatttaggcatttaaatatctactcactacatgatacagaaataatttgattcaaatcctggctttatttcttaaacgcttatgatattgaatacctgcttaatttctctgtgcttcagaaatgatgattagtaacattattgctgtatctgattacagggctgtgggcattaaatgagaaaattcagagaaactgacacttgctaagagctagcttgtattattgttggtctctagcaggggcacctgcacatgtctaactgctgctggttgtggggatgcccatactgtcatagaaatggtatagcatcaattgttgctgcatcagtccagacaattgatgcctttgaatatgtagacattttggttgatttggaaaattttaatttttttttcagagtccttacatttccccctttgattaaactgaaaatccatgatcaatttacggttaatggaaagctggctataataactatagaagacttacatggtagtgaggcagcagtttcactaacagctgcatctgtgggaagtctatactgagaagactgtctctctttggaccatatttgcaggaaatagtggcctcaatgaaagaagaaaatatcaatttaaactcatttattattaccatctacaaaaacaaaatggctgcctatgagataattttttttttttttttttttgagacggggtctcactctgtcacccagactgaaatgtagtggtgagatctcagctcactgcagcctccgcctcccaggctcaagtgatcctcccacctcagcctcccgaatagctgggactacaggtgtgtgccaccatgcctggctgcctatgggctaaatccaagaagaatttcactcatatttctagtcaagtgcctggaatgattatttaataatcagtttagctttgcctgtatctatccttgagatgaatatttaggactgggtagtaatgaacaccttgtctttagatttttttttttttcttactctcaatattactggccttaagtttgactctccacatgattggaacagagagattctgcacgtgagagatggagtaaaggtccctctaatcctgcgggtttccttggaaggtctaatgactttgtagtcctgtacaaaggctgtcttctgggaggaacttggccactgcttacatctcactggcttgtagacagggtgaaaccagcctgttgcttcctgtctgagaaatttgagtaccggctgtcctgtcttatgattcaataaaagcctttgagaaatcagaaaactcatggcagagcttttgagacaacacctcagtgggattcagatgaaataatatgtaaagtcaacacagttcaatatccttataagcaattctaatggaattgcatttatctcattgggagatcctgggcctaacagctagactgtgttaactagactttggcttctgcaagagtagttgtagaagtgtgactctccattaaaggcaaaacaagttattaactcaattgtacttggtacattttcctcattataaggttgtctttagctggagttcagttattttacttttttaaaaacaattcttttgagacacgactcgctctgtttcccaggctggaatgcaatggcgcgatctcagctcaccacaatctccgcttcccgggttcaagcgattctcctgcctcagcctcccgtgtagctgggattacaggcacacaccaccacacccagctaattttttatatgttttggtagagacagggtttcaccattggccaggctggtctcgaactcctgacctcaagtgatccacctgcctcggcctcccaaagtgctgggattacaggcatgagccaccgtgcccagccagtaattttactttaagatatccaatcacctacagtttaaaagatccctgaagacaatctcttacttctaaaaaatagtttagatattggtctgagtggtagactcattctttgtggacctaattacattatctccagccatgctacttcctcaagaaaaaattcagagtgcaactactgcagctttgactagggacatttactctcttctccaaatcgtgggccgctagccgtctcgacatttgtttagaactctctgctttcctctcatggctaaggtgggtgggtcgttctctaatcagtagctcagcattttgatatttcaggtgcatgtcagggcattcaactataaattgccagtgagccatctcctgacaaaacttgcttgagacaggatatttgagagatacagtccagaaatcaagtgaaatgtaaattccttgttttttgtttcatccctatatggttagatcatcagaagcctgtacacttggactattgtctcagactgtgttgtttactggaaaaaggcatgtgtcaggatttatgccctggctatttatagaaaacagctatgaaaaatgcacatatatgatatttctgtgcttttgctctattgggattacagatattggcttttacgttactctctgtcctttttgaaaagatccacgtgataaattccatttatgatttcagtgttcgtaaccagaaaatagtttcccttcatatgaatttctaggtttcctttttattgggccatgggaaataggcacctcaatgtgattcttttttattttgggaaaaccagcgttaaatttagagctcaaggagggacctagtgaagcttattgtcttattcctttgtcatttaattttttcttttattttataacatctcaagtatgtggttttatttttttggaagtagacttggtataaattgtatatacatatatctccttgtgagttatctgtgtcattcccagctataatatatatgttagatctagaggacattagatagtcacattttgatctagatttgggtgacaaattatattacaatggggcctattatacttttcctttatcttacattaaatcatcagactcaagagcagttttatttttttatctttggttgattccagttccttgaccacaaaatgaagacatctttggtcattgcaaagctgccatccctccactcctcaccttattcccaatggctccctcaagcaaatccttcccaactgcccagctaacctttcctgtctcctctgcaactcccttatctctgggttgagtacctcattcttgttccttacagctccatgtggcctggaactgtggagagtcctgaaaccagctgaggcggatggaagaaggccagtgcggttgttatggaaggtgacctccctctggattctttttctctctctttcttccccttccctcctttccctcccttccctcccttccctcccttccatcccttccatcctccttcccttcccttcccttcccttccctcccctcccctcccctcccctcccttccccccaccttccccctcccctcccttcccccaccttccccctgcccactccctccctcccctccccgcctcacctttcccctccccactccctcccctcccctctccactccccttccccctccccagtccctcccctcccctccccttccctctccttcccttcccttgccttgccttgccttcccttcccttcccttcctttctctatctctctctctctttccctccctccccaccgccgcctttctttctttttggcagagtcttgctcaatcacccaggctggagtgcagtagtgaaatcataactcactgcagcctttaactcctgggctcaagtgatcctcccacttcaccttcccaagtagctgggactacagaagtgtgccagtacacccagctaattaaaaaaaaaaaaaaaatatatatatatatattttttttttttttggttgaggctgggtcttgctgtgttgtccaggctggtcttgaactcctgggctcgagagatcctcccaccttagcctcccaaagcattgggattataagcatgagccaccatgcccagcctgtttctttatactgtttaaaagcccttgatctcttacccttctaaaaactgtgattcttgaaattttacccccagaatttccttccctagagggctttatgatgccccaaatctcacattggttggccagctcaaaaaagccctataggtcatcttgcagatggcccaaacatgcatgacagacgctggtccccctcctctttggtctgaaacattaacattcggggtgggtagaaagtgaaagtgcaggaggcaccatgaccttctggaggaaacgatcactgaccagcctctgctggaaggcagcgtaagtctccggaacccccctccccacccagctgtctcagaagagctctgatcagggtcagcttgctggtgtgtcctcgagtcattggcaacatatatggcacatgtgtgttgaaatagtggggcacaaaaacagaagagggaccacatggtccttcctagggcggaggcctgggagtgaggaacaggagaagtcaggtggggaatgcagagaagaagaagagggaagaggacctgagagagggaagtgagagaaggagtagaaaatggggggacaagggaataaacagaaaaggaaaagggcagatggagaaaaaaagagtgaaaagatggggaagaagaaggaagagaggagtgagatgccagaattccttcgtgtgcctccagaattcccaggaaatgctcatgatgttagctcatatttgctgaagtccaggcaagttcaaaatcctgttgaaaatggagcaagtgtcctgctttgccagatgacattccaattacctcagggttggaggctcccgcaccatcgcccactccctccacacccgcagggctatgggactccctgggttgcggaggcggtgctgccgccgcatgggacaacagccagagatggcggggaatcctagagaatcaatcccagatgctgtgctgtctttctcagccatcaagtatgaaaacaaatgattgtggcaacacatttttgggggaggaaagccaacaacctcacacgcccacatgtggtcttagctacatagcagtggcgaagggccaagtagggcagcttgcgaagtagagaagatggatttcagtgcccgcctcctccccgtcgcctgttgggtctggtctttttctccacaccacccccccgcccccccgcaccttcaaaaggaaagagctctctaagaatttgagttggttaaaaaagaatgtactaaaatgctctaaaattaaataatagtgatagttgcatgactgaacatactattaataaaagccattgaactcacattaaaacagtgaattttatggaatgtgaattgtatctcaatttttattattttaaaaagaatgttatttaaaaaagttatttaaaatgttaatatgttattttaaaaagattttaaataacatattaatatgttattttaaaaagattttaaataacatattaatgttattttaaaaagattttaaataacatattaatatgttttttaaaaagattttaaataacatattaatatgttatttaaaaagaatatgtgttatttaaaaaagaaaatggggctgggcgtggactgggccggtaatcccagcactttgggaggccaaggcatggggatcacttgaggtcagaagttcaagaccagcttggacaacacagcaaaaccctgtctctactaaaaatacaaaaattagtcgggcatggtggtgcacacctgtaatcccagctactcgggaggctgaggcaggagaattgctggaatccaagaggcggaggttgcagtgagccaagatcaggccactgcactccagcctgggcgacagagagagactctgtctcaaaataaataaataaatacaataaaatagaaaatgggtcgtcttgagagataaaaggctcctggtcattaggaagattctagctgaccttttatgcctagacataaaagtaaaggaaattcctgaactgggaaggcagtgggacgaagtgcctgctaaagtcccacttataagtcctggacttatattcaggcattacgctccatctatgtgtataatcagtaacagaaggggaagccctataaattctgggaaatactgtctcctaggcaaatgtctggtgagtgggcccaagttcaaggctgaaaataagagtttagcttaaagtcctcaggattccaccttaaacttctcgccaagggtttgggactggcagtgcggccctcttagctaggacgcctggctggggcgcctggtccagggaagctggctcccttctcagagggagaggcatggaaataaaagactagggcatagggtactctccaacctttggatactccaggcaagagatgactcagagccagaccagactttggatgggctgagagggaatgtgtcagctttttagcccttactcctttacacgagtgggatggagcgaaagatacaggcagaaggaaataagggtggcttgtttacattgttttgggcattcttctagtttagcctcatggaattagatgaaatttagtaaatcccctcttctggcacttgaagtgttactatcacagcccaggatcttattcatccctggagggtaattacctgattgtagtttagtatctaatagttagccttattccccaccctcacccccaccgcttctcactgtctcaatgcctttctttttctttgttattggcaataaattttgttttctttgggttcagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatgtaagtagagcatcaacttcttccttaggtgcctggtcccatcaattggccaaggagcagtccctgtgctctcaagggtggctgtttctcttgagtcaaaatgaaaatggagtgggaaccttttaggttgtggtgaagcaatgagaatttgctggtaattaatgaatcacttgaagtcatgttcctttggaacaaagcctgcgttaaaaatcagagactttataaattacagaatacaaagccatacacctagaagttctgtgtgcagctttgatttgttctggtctgggtgaatgtaagctgggtcaagtcctatgaaactgtcctatttctcacatttgtcctccgtgaccgaagctgcccttgaactcttctccccacaaatgggtactcaccacatccccatccttggtttaatgcttgctgtcctgttttcttccttttccccttccatttgtcactatggaaaaattctagtgtttatacttgccaataaattgttcattacacttttggttaagtagtttttgacatattactgctcccaggcaaactcatatttatcctgttttggaataaaaaactttcattcaaagaattgcagacaatagatttcctcttttctctcttatttttctctttcaaacttagtactatcccttattctataaattatcttatttattttactacctttttcttcctcaataggatgtaaatgccatgaaggcagtgattttttgtctgttttcctttcttttttttaacctaattcccaacacttaaaatagcatagagcagttggcatagagcaggtgtgcagtaactatttgtggaaacatatcatagtcaggaatgttctctccaattcaccacctttctctatttgcttacacctagactggttcagacatttacacaaccagttctagaattctctgcctgtgctgccttccatctcttctccttaaaccctcattttataattcctagatatttatatttttgtattttgagctacacttgatattattttagttagcatttaatagtactccctgtagtcctcatttcctgacatcctagttcccgcctgtccaacaccctagtgatgaagttcctgacaaatgcacgtgtcattggggcacacattctttattaatagaggtgctgttaaatagtaacctcagtttcccagtgtggccccaggatgggaggtggtaaagaatagggtataaaagcatgggctttggagtccagcagccccgggttcaaatctttgctcttccacaagataccattaaccttgggcaagttacctaacttctctgaagattagctactcgtaaaatggagctattatataataatacctacctcacagagctgtagtgaagattaaatgagatcatgtatgtaaaatgctttgtctggtgctaattattactattgtcattattattattattattattattattattattattattaatttttgagatggagtttcgctcttgttgcccaggctggagtgcaatggtgtgatctcagctcaccacaacctccacctcctaggttcaagcaattatcctgcctcagcctcctgagtagctgggattacaggcatgtgccaccacaccaggctcattttgtatttttagtagcgacggggtttctccatgttggtcaggctggtctcgaactcctgacctcaggtgatccacctgcctcagcctccctaagtgctgggattacaggcgtgagccactgctcctggcttattgtcattcttaataaaatttctgattgatcaaatttctgttagacacagattatcgactttaaaaatattataaaatacactttaaagttatgctaaattcacttaggttttttttggctttgtgtcagatacgactgtgtgatcatcaattataagggtcctagatcaggtattggcacactgcagcttgcaggttaaatctggttggacacttgttattgtaaatgaagtttcactctaacacaaccacacatatttgctcacatattatttatggcttcttttgtgcaacggtggctaagttgaatagttatgacagagacgacctagcccacaaaacctaaaatctaaaatatttgctatctggctctttacagagaaactttacagatgctagtcccagacataaaagaaaataatgttctggatgtgcacgatggctcacgcctgtaatcccagcactttgaggccaagacgggtggatcgctgagttcaggagttcaagacaagtccaggcaacatagtgaaaccttgtttctacaaaaaaaaaaaaaaaaaaaatacaaaaattagccaggcctggtggcatgtgcctgtagtcccagctacttgagaggctgagggggaagaatcgcttgagccaaagaggttgaggctgcagtgagccgagattgtaccactgcactccagcctgagtgacagagcgagaccctgtctcaaaaacaaacaaaagaaagtaatattctacagaattttgcttactaaagtggaggcaactggagaatgagaataataactagagaataataagataatttttgtaagtataactatcattaagtaatagttatcatacattgtctactagtatgtgtcaggaattgtgctaagataacataggttttcccattttagccttgacatgactcatgatgtagatgctgtgagatctattttatagacggcaaagggattcaggcaagcttagtaatgtgcccaaggtctctggagtgggatgattccagctcggatctgcaggattcccaacttgtaccatatcccacaaccttagatgtgttattcataaagtgacttgaattccggtcacagatgctgtgtgacactgaactggttattgacctgtgcgggcctccacgttcccctcttggaataagggcttggaatgaggttccttctgctcagcacgccctgggttttgtgagacccgagacagcaggcagcggtggcgtggtcccaggcagggcatcggaaagcccggccactgtgtcataaggccagaggaggaagatgggcccaagttggggcagagctcaggatgggccaggacggttggcaaaggagaagcagcaccagcacgtgagccccgggtgactgtcttcatgcagatcacaagaaatcaatggctttcacagtcaaagcccctccctgcttcttcaaggaaggatctgtgtttcccaccacacctggggatgtttggagtaattgctcagaaagctcttgttgaatgatggaaggacccggcgattcgtttatattgagtagagtgatgacttggaaattccccttttggcgccccttggtgtggccaggctttcccctttcaaggttgactcatggtttcctggggccggcgccacgcccctgtggtctccgcagtctctgcagtgcacttggcgctttagacccggatctccctgctcctcagagctccagtgttggtgagaaggagtgtgggtttagacaccaacactggcttcttcaggccaggatttgtgggcaatcattttttaaaaaagtgcctccagggagatgaggaagctgcagaagcaggccaggacagggcagaggctgagatgaaggtgggctttcagggctgccaaaacgaagcactgcagactggggggcttcaaacaacagaactttattgtctcatggtcctggaggccagaagtcccacatcaaggtgctggttggccatgctccctaaagtctctaggggagaatccttccttaccccttccagcttgtagtggccccaggtattccttggcttgtggtagctccagtaactcccataaatccaatctctgcttcagtcttcacatggctagcttcttgtgtgtctctgtttccatgcccagattcctcttttcttataaagggcccactgtcttaactaattacatctgcaatggcctatttccaaatacagtcacattgtgtggcactgggtatatactttggggggatacaattcaacctgtaacaggtacaatctgagataaaagccccagggaggggggttcccactggatcttgcaggggactctatctagagtgtgagtgacatctcatagtcatcccagccaagcaaaacacaagcacacagtaagaaggaagctgagtgggtctgggtggagcgccaacattggctgctagaagagtctagttacatctccaaggctccagcagggactttcagccaggactggctgggtatgcttccaggcggtgagcaggggaaggctggaaggagaaactcagagccctagggttaggtggggtcaatctccaggctctgtgcttcttgccccggcctctgctccttctgtggcttcacatttcctccatgcctcagttgtccttctcagagttaccttttcaggttgacaacttacctggccttgctgctaggactagcccctggagtgtctcataaggaccctgtttgggaaaaggatccgtcaactgtggcttacaagaacaagactcctaaatatacacacagcctgctggggtttgttgccaaggaatagcaggatgcaggacccctggtccccaccccagattcctacatgtggcctaggcttccagcttcaaaagacttttgggtttctttttttttttttttttgcaggacacttttgtgcctgtatccaggatcatctctgacattcattgaaacactcttcctggctgggcgtggtggctcgtgcctgtaatcccagcactttgggagaccgactgagctgggcagatcacttgaggtcagaagtttgagaccagcctggccaacatggtgaaaccccatctctactaaaaatacaaaaaattagccaggtgtgttagcatgtacctatagtcccagctactcgggaggctgaggcacaagaatcacttgaacccaggaggtggaggttgcagtgagccaagatcatgccactgcactccagcctgggtgacagggcgagactctgcctcaaaaaaaaaaaaaaaagaaagaaagaaagaaaaagaaaaagaaacgcttttcccatggattcgagttttgcaggttgaggagtgcaacgctggtgaggattgggtgaggggagagcatgccctggaatttctgagccccgcccagtttgtaccttccacctctgccttgctgcacctccaagagttctcttctgtgtgttcgaatattttcagtaagatctctgtctgattctgattaagttccagatgttggattgcaagccacacactcaacttttctattaaataaatccttgtgacctgtttccagattattttggccagtcctgcagaaaatgttgccatttatgtattgatccatactaggtaatttggatggcaatgtctttatctttctggtagaaatgcaatatttgctgccttgaggataggaattcatatccagtttgtgcagagccagactatatagtgaaagcgtaaagccatctccctggtatgattttaaggtcaccatctcccagcttcccagccacacaattccccagagcctgaaattctacctttggagattctctgtttcaggtttcctttccatttcacttgcagagacacctgtggaaggtaagtctttttagtcatcaactgtctagtgagatccttttctggaaacaggtcaatttggggttaggtaaaggaagattaagaagccacttactcctcaaggtgttgtgtaaggaaaaaggatgcaataaggggagtgaaaagagccccatccggggaggctgcagtggagatcctgaactttggccttgttttacagctgaggcaatgaggatgccagtgtggttgttgcatttggggaatgagttgggtagctgtgaagcagtccttttctctcctttcagcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaaggtagccagggcggaactcacaggttccctcagtgcagggtttggtttcattttcatccatttttagatctttaactttggcttcaaagctgttagtgtggttaatagcatttgtcaagcttgtgcaagcttaatgaagtgacacgcttcttggtatttccaaggcaaggctggcacagaaagctgtgggtgtcaagcagaccaggtatctgatcgatctccaggtggaaaacaccatcttaacacccaccatcagagagtccttcccggatagctgggtcatcccatggataactccagaatgtggatcccagctggcctacctaggatattttcttcagttctgattgcctgtttaagagttaggcccccttcccaggtgattgttataggaatagccttcttttcaggaaagtccctgccctacgtaagatatgcgagtgaggctttactctttatttttaattttgtttaaatttttattttctagagacagggtcttgcttgattgccaaggatggagtgcagtggcacgatcatagctcactgtaacctcaaactcctgggctcaagtgatcctcctgcctcagcctccctaatgaggctttacccttttaatcctgtcaccacaatcatttcttaatgcttcaaacatccatattaagaataatacacaggcagggatgcaggcaagtagaggagatagaagtcacagtgtttgagatccacagggtgatgatatgttgttctagaacttaattaggcagcgtgttcagcgatcctatggatctctctgctgcaatagtatttggtcagaacagacctggggattccctgcctccaaaaaataaaaagctaaaaagctaaatttaaaaataagaattagttagaaaatctgagaaaagcaatagatattagagaccattcaacctaacctgtttattttccagaggtggaaactgtagagaaatggaatatcttctataagtgtttggccataactcttagtctagtattccccccactctgccgtgctctgcacttacacttttttttctttctttttcacagataaattaaaacctttctggtgctataacatctctgtgtatccaatgttgcatgacaaagttggcgagccatattccatccaggcttatgccaaagaaggcggtatgaatggacaagaccctgtggggaaaaggaaacagtgtgacctgtcccacatgccgataaggctgcaagtgcctgtagctcattcccagccatcttagggctcatttgtgcttcatcttgtagtgagctctgtatgttatgaatttgctgaattctgaagctggggtagacattagagatcattgagtccaatcccctcatttcacaaatggaaaattaaaactcagagaggtgaaataacttgcccaaagtcacaaataaacagtgcaaatagagctgctaccagcaataacactgaattaagaccacatcagggagcctagagttcatcctaagctagggatgttaaaaaattatttttaattatgtagcaataagcaaaggctttactggtgaattgctcaagctttacttttatctttttggaagttcatgtcttccagattcaacactggaaaacatcttctgccactcaaaggtagcctatggagccatattcttcaactatttgataataactacactttacagatatgaatgaaaaagctgggtaccaaattggagacatctatgagaaaggactttttcaagtggtcttgttgccacttctcttcttgcttaagagagatggttctagaaaacaattttcccaaacaagctgattcatcaattccctactcaaccctcacccgtcgcctccagcactatggtttggtctgagtactggccagggcctttgtgggggaacgatctcctggagtgcggttcagtgattatcatttatccctctgtcctttccagttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcctcccacagcccctggcaactaccaaactgctttgtgtctctatggattgcctattttggatatttcatatacatagaatcataaaatatgtggtctttgtgtctggcttctttcatgtagcatgttttcaaagttcacccatgttatagcatgattttgtacttattcatttttatggctgaataatattccattgtgtggatattccatattttgtttatccattcatcagttgatgaacatttagggtgtttcaacctttaggctattgtgaatagggctgctatgaacagatgtctgctacgaacatatgctgctgtgtacaaatatgtgtttgagtttgtgtttttcgttctttggggcatatacctagaagttgaattgctggatcatactgtaactctagtttaacttattgaggagccaccaaacagttttccacagtgactactccacactatacattttttactagcaatgtatgagagttttcatttccctgcatccttgtcaatacgtgttatttttcattaaaaaaaattattatggctgtcctggtaggtatgtagtggttatctcattgacttgcatttccctactgactaataatgttgggcatcttttcatgtagtttttgcccatttgtatatcttttttttttttttgagacggagttttgctgttgttgcccagactggagtgcaatggcacgatcttggctcgctgcaacctccacctcccaggttcaagcgattctcctgcctcagcctcccaagtagctgggattgcaggtgtgcaccaccacgtccagctaattttgtatttttagtagagatggagtttctccatgttggtcaggctggtctcgaactcccgacctcgggtgatctgcctgccccagcttcccaaagtgctgggatgacaggcatgagccactgcgcccggccagcccgtttgtatatcttctttggagaagtgtatttttcatcttttttcttatgtttaaattgggttatcttttcgttattgaatttataagagttctttatatattctggatataagttatttatcagatatatgatttgtaaatattttctcccattctttggattatcttttcattcttgatattatcttttgatgcacaaaaactttgaattttagtgaagtccagcttgatctatttttttcttttgatgtttgtgtttttagtgtcatatcaaagaaaccattgtgaaattcaaggttgtgaagatttatcctatgctgtcttctaagaatttttatagttctagttcttatattgaggtccttaatccatcttgatatttaagcaggacatgaataggggtcagaatatgagacagctgagcttggaagcacaggttccaatgctcttattttggtgctactgggacacaattttcagtctggtttggctgtggtgtttgacctttgtatttttcctttagccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgagtatttccttcaagccttaggtacctctccctcacgtttaccttacatcagagagaaatgacatctgccaaaagctggaggaagccaaatgaaagggcagtgcctagtgccctgccatcctgctctctgttcaccaaccttcctggaaagcatataggtgaggagatgggagggaagagcaggcaagttgagagccgaatttggaaatgctggtcattttggtcgttcctcatgggcagccacaaatcatctggaggaggaggtgtcaaattaatgccaacttcagtcttagcaccaaaccagctcccatctcaaggctgtctccccgttcatagtcaccagtttctgcatgttataggttacggtatgtattagtctgttttcacgctgctgataaagacatacccgggactgggtaatttataaagaaaaagaggtttaatggactcacagttccacgtggctggggaagcctcacagtcatggtggaaggtgaaatgcacatcttacatggtggcagtcaagagagaatgaggaccaagtgaaagtgatttccccctataaaaccatcagatctcatgagatttattcactactatgagaacagtatgggggaaattgcccccatgattcaattatctccccctgggtccctcccacaacatgtaggaattatgggagctacaattcaagatgtgatttgggtggggacacagccaaaccatatcactgtacaacagggccttcaagggaaaaccttggttaactcaggactactgacccataggaaggggcttaacctcatcatttgtggaggttttttttgagcaaaaagacatatgatatatttaacttacccacttttacattaaaaaatagcaagaaaaatttactagagacaacaaataatgtaaaataaaatgtagcttcatatgatggctggttaagggagatatttagaggcaggcagatggaatgaggagggggatgaagcagaaagaaggaaggagaatgggagaaacagatatatattaattttgctaagtccttgagtgacagagatttgatttttaagtacgtactaaaactgtcttaaagaatgaacaacgctttttagattaaaaatgaaggaacactgccaagtttttgcaataactgaggcaagctaaaaattgcttgaaatattcttgaaagcctcttatgcatcacatttttcaagaataaaatgctttatcactctggaaaatgtgagtatgacatgttttttttacagagaaaacatattctgttttgatggactaacattgccctctaggaactctttttgatatgctgtttaaatttttttaaagctgtattgaatttttgcaacactgggcacaaatttcatcagctcaaggagttttctccaagggttaaatgaaggcaagatccagccctggaacctagaagtttcctaccctggtctatagattataaatcaccctgcttccatttttgatcctctataatccattttccacacagcagccagagtttcaaaccctgaattctctgcttaaaagccacagtgacttttattatattttaaagaaaatccaaactccttcctataactttcaaggtctttcatcatctgtcccttactgaccacatttttcctactgctttctgcctctatttatcttccttaccttgttgctgcttcaaagcttttgcatccactgtttcttctgcctggaatgcttttctccatggttttgcatggctggatccttctcactattaagatcagcttgaatttcactccttccttggacaccttagctaaagttgctgtctggacgcagtggctcatgcctgtaactccagcactttgggaggccaaggcaggaggatcactcaaggccaggagttcaagaccagcctggccaacatggtgaaacccagtctctgcctaaaatacaaaaattagccgggcttggtggcacgtgcctgtaatcccagctaccagggtggctggggcaggagaatcacttgaacccaggaggcggaggttgcagtgagccaagatgcaccactgcactccagcctgggcaacagagcgagactccatctcaaaaagaaaaaaagtctaaaaattagctgggcatgatggcttgcacctgtaagtcctaggtacttgggaggctgaggcaggaggttgcttgagcccaggagttcgaggctacagtgagctatgatcatgccagtgcactccagcctgggcgacagagcaagacccatctcaaaaaaaatttataaaaattaaaaagtaagtgctcaataagtattcactgaatgaatgctgttggaatgaatgctgccaggaagacacctagatggggaggcacaaaattctgttttttgtttttgtttttgtttttgtttttgagatgaagtttagccctgtcgcctaggctggagtgcaacagcatgatcagcgctcactgcaacctccgcctcccaggttcaagcgattcttctgcctcagcctcctgagtagctgggattataggtgcacactatcacacccggctaattttttgtatctttagtagagacggggtttcactatgttggccaggcaggtctcaaactcctgacctggggtttttttagtggaaagaaattgaatttaactgaaagaaaactaataagacattgtgttgctgaagctactagaagaaaaagttaatcattgatttttgtcaagaaggtgaggaactcactactgacttttgttctttgtttttcaaaggtgtctttgagattatcctcataacttctctgattggtggaggccttcttattctcattatcctgacagtggcatatggtctcaaaaaacccaagtgagtctgcagacaacagtgggtgccttaaaaatcagggacaaaaaggggttgaagtcatcataggtgcttcgtaggagagggcactctaccattaaggggtgttcattcatttattaacttggtgcgtatttattgaggttattaaaggccacgctcagtggctcaccggaattctgaccaagcaagagcactttcgtttcccagagctccatgcccaggtctaggcctttttgaggccaggagagtgccagctgccccacaggctctgtctgctccatttgccatctgagactggagttggagagcagaccctttctctcagtgtctagcagggcccctggctgcagcaagaggccttcttgcgagctctgtctcaggcagagcggggagcagtgtctccacggtgttggagtgctggccagtcgtctgtgggtgcaagcttattgcttgcttgtggtgcagtgttgagggtctggctgcaggggcctttaacctgcttgccctggccactgtggggaagaaagcatgtcttcagggtcttagactttctctctgcagtgagccttatggcaccctaatggtcctcccctggttgagctgtctctccaaattagacagttgtgagtcatctctgtcaagcagctgcacttagttaatggtcaagctaatatcaacctccgttaccaactgtaggtaataaccaagccaccagcatagattcttgtacattatgcacttaagtaatcattttgatcttagcatgcatcagaatcaggcctcacccccaaagtttctgattcagtggttctagggtaaagccccaaaatgttcatttctaacaagttcccaggtgatcccaatgctgctggttgggaccacacttggagaaccattgcaggaaagtatgggtagcttataaggtttataaaatgttgtctttcccagaggataagcctcaaaggaatgactctgtgatggtgcaatttacagcattgggaccaggtatggagatgctgggatgggagagaggggaagataggctttgtatggggagagtctcctttgatcacatcccacagagaacttgcaatgtcaccccccaacacacaccgcaaaacaactccactttcccaggttctattaggcagacatgcccttatttaggagggaaacttacaattccctttagcacagcctcactcttttgactcagccatatggtgctaatgcttcttggattcaattcccatcttaaaatcttctctctcattagcaaattgactcatctgtgttggcccaccgttcccaaccctgctgaaagtagtatagccacatggcatggagatgatttcaaggtaaactctcctgtttttattaaggaaatcattgccgtgggaggtagacgaggtgaatggagatggggaaagagtcctaggctgagcttttttcaaggttcacatcaagagaactggagttgaaaagtctcagggaatggcaggcagggcagatggactcagccttcctggaatgactttgacttcatgctttgacaaggggaaagggcttcaccaggctcatgaggacccagtgcgttcccaggtggaactggtcccataaaggatgctgcagaataaagacactggccctacccttcctgacctgatgggctaattagagagagaggagccttggctataggatttgaagccatttacaaagcagccaagagcacattaatctaaagactgtctaaatatcaccagggaatgttgatgggcatggcagtctgaggctgcctcaggttgtttttctcaggctggggacgtcagagtcaggctttatttaactggcattggggttttctagtgagtattccttaactagaaaccctccatttgcataaatttttaagtggaaaaccgttagggaaattttaaggtttaatttcttgcttacgtagaaacaagcccaatcaaatataacctttaaatccttgttactgaaaggctgtttccagtttttccttgatgcacaaattttaaatattagtcctcgttcccactcagaagtcttttttgagcatgggccttttgttataatgggctttctttctgtttcctcctcttatcagtccggtatactggactgatttatacccccatttactttcctgcttattaaatgtcatttagagagtaaatggattcataggcagtgctctctgataactaacatgctttttgaataatccgtaggttggacctctagagccggcacttattaatcactcactacatgccaggtgctgggctaggccctagggatacaaatgacaaagtcactgtccctgccatgaggccacttctgattttctggtgaggttgaacaagtctgtctctatgatgtggtttttccatccctaagagttctaattttagttcttccatcttaactggggttttgtgaacatgggattgtgtggaaaatagccttgcacactctagcagaagaaattgtttgaattggctgggtacagcggctcatgcctataatcccagcattttgggaggccaaggcaggggggattgcttgagctcaggagtttaagaccagcctgggtaacatgacaaaaccccatctctacaaaaaattaaaaagtagccaggtatggtggtgtgcatctgtagcccctgctactcaggaagctgagggggaagaattacctgaggctgagaagttgaggctgcagtgagtggtgatcatgctactgtactccagcctgggcaacgggagtgagaccctgtctcaaaaaaaaaaaaattatatacatataaataaataaattttaaaaattgtttgaatccagggcactgtttctcaggaaatgtgccactccttccaagctctgtggaagggcatgcagagagggttggctaccacttctgggcctgggaggaaggtgggggctgttccagagatgggcatttgctgtcccaagcctaacgagtttttggctatgtcatatgtgactcctaaatgaccacttgggatgtccctttttcttttccaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaaatgcgaccatagcatgagaccctcggggcctcagtgtggatggcccttgccagagaagatgtcaagactcggcacgcagcgcttgcttggccctgccacatcctgcctaggttaaagtttcccctgccccttgagctgccagttgaacttggtcggcaaagatgcgaccttgtactgggaagaagggatggtgataagcccgagttttgtaaaggaacagcagtctcttttcgtttgttcagataccaagctctcaccgaggcctcctgacagattgactttgaaggaagggcccaggttctgagcccaaaggacccccagggtggacatatctggcctcccaggaattgggtcatggtcccagcctttgctggggctgagcctcagagttccagaaggcctttccctgctgccagaggacagttgttttgttggctcttgggtggtctggtgggagcctgggctctggtcttcccctacaaggtagccctgaagccttcctctctccccatagttggggctggaggtggagtggaccttcctaaggggttgtctgaggctcctcacatcctcttagatctcaagtgcctgtagcaacaccgcacctgagaatcctcacccccaatttagactgcattgactactaaaaaatcaaggaatggggagggccctggggaatgtatgctgccgggcgcagctctgtccagtctccagggggccacttcccagctgctgctgcccttctattcagcacccagcctgggagcagaaaggcacctgacattgcagtggttgtcatatagggacgctggcccctcacactggttcagagcccaggaatgcttacttaaaaggcctcttcccggaagcagcagggcagggcctgggaacatgcaatgcctagcaaatttgcagccccaacaggaggacttctgctccttttctctagctgagcacagagcttgtgacagttagtggagcctttcacgaaagtgtggattgctggcttcagcactgagatagtactgggctcctcctgtaactatagtgacagagtcagctgtgactcccttgacctttgtgggaggccactaggaggctggtgagatcagggcaggcgaggcaatgagtgagtggcccaaggtgcagtgaacccagcacttgccagccaggaaggctgatggtattttttctaggagagtttgaggaatcagtactaggattgcaggcatgaacttcgcaagccacccactcaggtgtgcaaaacatcactttactttcctaaaactaaaattaattgccagcctgagacctgacacttcaaagtaacctcagcccagtatgatgatttctgagttgccgtaggtttgtgactcagtcacatttggggttttgccctcccctgtcctgcctgggactggctctgagtgccgaggatgttcaatggcgcagcgtgcatggggcagagttggtcactcagtggcatcctctgggtcatgtatttgtccggccgtgtttttgtctctggcctcgtgtgtttactatggtccctcctgtccctgttgggtcacctaccacttaccttagccaattgctgcctcgttactgtgggcacaggaaggtgtggctgctctctcaaagctctgtcctcctaacatctccagcggctgcagccacccccccaccacccacccaggactcagtactcctggtttacggaacagtgacttctggtacaccaaggaatgagggaggcccgaggcagggcactggggaataagactctagggcaatgcccctgtcccgttgtcctgcactcaagtccaggtgtaggaagggaccaaacaaaagagatgcgtccaattctcatgccgcccctgatgtctgctctccctgctctccctgttctccaccccttctatggtgtgggctcttctgtgagcccactgtccccagagttccagatggggcctttggcaaccccaccttcagattcatgaacatatggggagattctagccttgcctcctgtcttggcccgaggatgggggagggcacgggtacccccacagctgttctttcaaccctcctgcccacctgtagttgggggaattttctcaaattctgtgggaggtgggtgagaggagagcctggaacaagttctcccaaacttgtctgtctcacacctggatgtagatgaagcttctgaacctaaaatctaagaatttgatgggagagaaaatggatccccaatggctcctgtgagtggattccagagataaggatgttgccctctggcccctgctccttcatcatcaaagctggaagcgtcttttgctggacaatttgcaaatccccacccagcccttcctgtttcatttcttctttcctttctctcctcttgcccctatcttgtgctttgttttcccccactgccagagcttctcatcttttaacacttgctattgttttcttgtttcttttcattcctttctccccttccatcagcctcctttgatcattttccatggttttattacctttgaggggtgggaagatggtggctctgtttctttctaggtgagaggagctgtttctatgagtccccaaaaggcactggtgggccacaccttagctctcctgagcaggttcacaggatgtgagcctcagagttcagggcgcaggtgacttcctctcctggatcgagtcaccaactgtccccgctctgggcaccagggactgcctctgtggctggagaaggccatctgtgttttccctgtttactgtcagagacattgtgaggacacaaacaggaagacttgtgttttagcaaggttattaaaaatggataaaccagttttctgagaccctgggatccatgcagacagctaggttagtggcctttctttaacagtaagagcagaaaatttttaaagaatgacagagaaaccagtctgtggcttaaataaaaagaccacaagttccttctggtgtcttgggaggcagcggtgtgaaaacaccacgcaagggtctggaggaggcaggagatggggagagatgaaaaaggagaggcccacagtatggatgcctccggctgctctgctgatgctctgtgtgcgaggaaagcctgtgctggcctgtccaccccagtctgattctgtccccatttccagcacgcccctagttactcctgctgcagcaggcaccctgccacccagggcagtggcccacgggccaaatccaggccctgtttttgtaggttcatgaactaaaagctataatgacctatttaatggttgaaaacaaaaagaataacattttgtgacaagaaaagtccaagaaattcacgtagtgttgacaaagtgtaattggaacacagccatgcccatcgttgacctattccctatggcggcttgcccctacaaaggcagagttgagtagtttcaacacagagtttttcccacaaagcagaaaacgtttactctctgaccctttgcagaaaaaatttgtggacgcctaccataacccacagacatgaaactcagactgccactatgtttcaactttgaattagctgcaaattaaaaagaaatcaggatatgtcattctgaatttctgaccaaataaggactgccctctttgaagggtgcacacacacttactggttccccaccagccctcctaaattcctgtccccttcccatagctaaggtcgagagttggtggcttacaccagtggtctttcaacaggagtgattttgacccccagcctccaaacctcagacatttggtgatgcctggagatatttttgattgtcacgactgggaaggtgctactggcatctagtgggtagaggccggcaatgctggaaattatcttataatgcgcagaacagccctcacaacaaagaattatctggcagaaaatgtcagcagtgctgaggctgagaagtcgtggcctgaactaccctctgccttctagatccacacacagtgttcacatgggtgagactcccctctaggtgtcccctcttttttctaatttaaaatttgttttaaattcaactttacagcagtaatcccaagagttttaaatagcaattatttgtcatgcttaattaactcctaacatgatctgtgtgcacctgtacacatttttcagctaattgcaaatcatactgaatacattatgttctcccatatataaaaattcatgcatgagcaaagcattttgaacatccatgaaaaaccccatggcgggcctgcatggtgtggtttgctaaggcatcccttggttgataggattcgtttaaaggtcctcctagtatagagtgcaatgcgataaacatttatcttttcttacctttgtcctgtctctttggggctgttttcaaaagtggaattgctggtcagaattttatggttgtcacattttgcgtgactgtgtcccatcaaaggttatgctgatttacagtatcaccagacatgtctgacggatcctttgtccttttccactgagaatcagctgtctaccactgtgagcttgattttgtcaatttatcgggaatagttaatgaaactttatagttatttgtgttgctttaatccttgtgaagccaaacttttctttttttattgttgccatgtccctgtgttgacattacagaatgttctctgcctccgtgctcctggggacattgacagaccagctgagttgctagaaataagagggactcagtaggcccttagcacagcgggtggactttgccatttggttgactatttaaaatacttgtttttgtagggcatctgaaaaagaaatttcacactggtgtattttgttaattgtttctacgtaaatgttgattattgacaagcctacttgtaatcaaaatgtgtagtgtggtcagtgtcttgcactcttatgttgtggcggggggggggggcggttcctgaagagtggagtgtgactaaggataacagcagtcctcatttcctttggacactggggtcagtggggagagagtttgctccgaagcacaaacagctccaatccatgctggaagagaccccaggccacaatagcccttgacacagagctctatgcagggctgtgctgcccaagacgcttgtcgtgtgctgatgaaaagggctggggagaagcaaggggcaggggaggggcagaactccacaagagggcaaaacctgctgtcagcaatgctctcgtggctgttcaagggaagtgagatacttgtactatgcatttcatttttaggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactcagccaggtgcagtgactcacacctttaatcccagcaccttgggaggctgaggtgggcagatcacttgaggtcaggagtttgagaccagcctgggcaacatgctgaaaccctgtctctacaaaaaatacaaaaattagccaggcgtggtggtgcgcacctgtaatctcagctacacgggagtctgaggcaggagaatcacttgaacccgcgaggcagagattgcagtgagccaagatcgtgcctctgctctccagcctgggcaacagagcaagaccctgtcttaaagttttacctactcagctatctaaactgaggctccacaatgtaaatacgtgagagatcagggaagcctggtggctgtgggaaagggctccagttgaccaggactcggcagctcattacactctttgctgcaggaaatgactcctgcctgcatttcctgtggaggatccgagacccacgcccgggctctcattgtcttcctattccaggctccttcccgctcctggagctgccgctgggtctcagctctctgctctgaggctacgccgcagctacagctccctgacctgttcctgttcaggctcccaggaaacctcagagtggcaggtgcctgctgtttcctctgtctcccgcccatcccaccacggcctctcctgtactttcaatttgtttttctttagccattccttcccttcagcttctaaacacagttgggtcacttccattaaagaaagaaagagcccctggatcttcctctccctctggctgcccacagactcttgtcacaacgcaggccgtggtttaaagggaacgtggtctacagcccgtctggcagcttctccaggcagctgaacttgtttccgtttttggtagtgagaaaattgcaccgctagaactttctagaggtgtagaaagcagggagtcactcaacccattctggttcgggggactgccagattttttttaaaaaaaagggggtgtagaaagcaagtgagaccaaacaattttgggacaaggaatacggacacagaacagactggtaagtacccaagtgtatgacaaacatccaccatggatctaggagaagccctggggcagggtgatattcacccgcagagacccctgttcatcactaagcttatgaagaaccattgactggcatttaacaccaggtgctgtgctcaaggtgtggcacgcagtacccagtaagcctcacaactgcattgtgagtaggtagctctggccagtggcagatgaggaggctgtgctcagagaggctagatgacttggcggaggctctctgaggctctaagcgggaagtggggggttggagcccagccctttgactttccttgtgcttttctacctcgggtgagtaagatgaccaagggactggggagatcaagaggagtggagactccaaggggacccctttttggtgagacgtgtagaccattcccctctcccctgggtgcctgcagagagctcttgagactggttttagagccagtgaggtctaagagaaatgctgacggcaggtgtggggatggagaggggaaccatgtccatgttcacagccctggtgacaagaagacagaagcccccagggacccagagcttcagaagggtttacgatggctacagaagcaggtagtcccatgacggtgtagaatctgtaagcacccccaggagctgggcagggcaaaagcaggtctgctggaagagtggatgtcccatgactgttggaataaggtaccacgtgggtgcctcctcccacccctccttccccctcccccacccccacgcgcccttggggcaaagcgagactcgtatcaaaataaaaataagttattggctcacgagttacactttcagagtccacagacttagcaaggattcgtgtcctcttgccgctgtaacacatttccataagctcaatgccttaaacaacaggaattgatgatttcacagttctgcaggttggaagtcacactgggctacagtccaggtgctggcagggctgtgttcctctctggaggccatagggaagagtcttccttgcctcctccagctcctaggcgatgcctttattccttggcttgcggctccttcctccgtctgcggagccagcggtgttgcgtctctcagttctgcagtcacactcgctctgtgtgcaggacctgggctgcacagcatgaaggccccaactaaagcctccgtctccatgtagggactttctcccgagatgccaggtttgtccttttaggagttcctggcccatagaagactgtggctatatagtcttatgtgagatcagaacccaatgggagcttgatgggaactgagcccagaaacccatcaaaatctcatcttattgttgtcaaagctatagggccaaaggatctagggcctagaaaacctagccctagatccatggcccagggggctcactaacagtgcccctagaattagacatcccaggtccctggcccagctggattcccacaggccttgctctgcagggacaagatcctgagagagcaggaggggcagactctgggggtagaaccaggggctgtcttggcctcggcccatcagaaccacaagcgcaggcccatggaagggcgaataaggggaagtccaataacaataaggtccaaatgaacttccatctgaattcagaattcttaaggattagcaagtgctggagtttgtgcagggctcaggggtccaggaaggtgcaccccagttagtgaaaagcctagggtgctggttcagtcaaaaccacgactgcatatgtgcacctcacacatctcccaggggcttgatttcaaaccttccttcataggaaacaagccacaggacacaaaacacatccagttggccttttgaaagaaataatatgtatttacttagaaacaaaattgcacttttccctataagtcaacaaatgctaaggattctggacgtcaaatacctcccaagacgttttatcagccagactttgttgtccttcaggaaaaaatatgagttccaggaaaaatgacaggcatgcaggatgctgatttccttcctgatggtaagacagcagcctcctagactgacgatttcgtgacttctcaggggctgggtccggagaacaccttactttaaacaaagggagaatgctctgtccaaaggcatcttctcttgaacccaaagcaatgttttcccatcatatatcagaattttcactcttttctagatccttatcccctcactaccccttccccatcaaaaatataaaacaagaaattttaaaaaaatcttttttttcttagaaacacagtctaactttgttgcccaggtcagagtgcagtggtgtgatcatggctcactgtagcctccatctcctgggctcaaggaatcctcccacttcagtctcccacatggctgggattgtgccactacacccggctgattgttttgtttttttgtagagatgggggtcttgctttgttactcagaccagactggtcttgaactcctggcctcaagcaatcctgctgcttcagcctcccaaagtgctgaaattacaggcatgagccactgtgcccggcacaaaatcttccaaaaaacaaaacaaaatgaaaaccccaggagtcctgaatatcatcctttgagtcctcctgacctccttgtctgagagagccttgagtgaaggagctcaggacggtacccctgaggcctgcactccagcctaggtgactgagcatgggtgacccgtcactgtgctgccgacagcagaatggactgacagggcttccagatggacaccgtccctgtaagagcatcttaatgcctcaggctaagtcccatgtcagagtcagggcttagctaacttaacaggtgggaagctaacttaactcacggcatgtttacaagtgtgataacatttataaattctaaaataataaagctaattgtattagtctgttctcacacttctaataaagacatacttgagactgggtaattaataaaggaaagaggtttaatggactcacaattccacatggctggggaagcttcacaatcatggtggaaggcaaaaggcacgtcttacttggcagcaggcaagagagaaggagaaccaagtgaaaggggaaaccccttataaaaccatcagatcggccaggtatggtggctcctgcctgtaatcccagcactttgggaggccgaggcaggcggatcacctgaggtcaggagttcgagaccaacctgaccaacatggagaaaccctgtctctactaaaaatacaaaattagcctggcgtggtggcacgtgcctgtaatcccacctactcaggaggctgaggcaggagaatcacttgaacctggaaggtggaggttgcggtgagctgagatcgcgccattgcactccagcctgggtaacaagagtgaaactccatcgcaaaaaacaaacaaacaaaaaacaaaaaaacaccatcagattgcgtgagacttattcattaccacgagaacagtttgggggaattgcccccatgattcaattatctcccactaagtccttcccacaacacgtgggaattatgagaatataattcaagatgaggtttgggtggggacacagccaaatcatatcactaatgaacccacttaattaaatattcttcaattttgtgattttcttttcttggttatttgccatcaattgttttcttcaggtcaagcatatttttgtaggtccccaaaaaaactcactggcctgggagcctgcctctctgttgccaggtggatagaatatctctggctaagtgttgtaatgaaaatgccctgctggcgtctaattggagaccattgccgggtggtcccaggtggagggcatagggttggggtcagcttgggctgtgggtggagaggcaggaggtcacctgcaggctgacaggacccagccatcgtttcccctcgtcccagactaggtgttaaacgtgaagcattaacaggtagtcctgatgggcctttctggagtttgctaaactgaggtctggtgagtgagtctgacgctttgggtggttctgtgtgcaactatcacctggaccctcctgtgaacactgtcaccgcagataaggaccacgcccaaagtgtcccaattctgaatgctgtatttgtacagggatggggttaggaatggaaccttaggttaagtccccccaaagcaaatcctgagacaaacatccaggtgtaactaattcatccagggcacattcccaagagaaactggtgagcgagtgagggaggcttgagaggaggggaagacgccagggcagggtgggatttcaggcagagccctgcaggtcagcgccagtctcatccccagatgatgctggaggtaagtgactcagtccttggcgcgtgtcctccccaggcaaggggcctgggctatcacactcctaagctcctcagtctactagtaaacagctgtccccacagggtatgaaacctccaggcacatttgactgtgtgcttggaggccaggagtcaggctccggtagcctgagggaagctgtggaaagataactgcaggtgcccgcagtggaaagcaaagcccagggaagctggtggagatgggggcagatcctgttgccagatttggcaatacaaaatgcagagcacgtatttacataacacacaccaggtactgtcctgtgtgtttttcaaagactatctcgtttaatcccagcctggccagctctggagtgggtgctcccctagttgtttttttttgtttgtttgttttttgggtttttttttttttttttttgagatggagttttgctcttgttgcccaggctggagtgcagtggcgcaatctcggctcaccacaacgtccgcctcccaggttcaagtgattctcctgcttcagcctcccgagtagctgggattacaggcatgcgccaccacacctggctcattttgtatttttagtagagacggggtttttccatgttggtcaggctggtctcgaactcctgacctcaggtgatccgcccgcctcagcctcccaaagtgctgggattacaggcgtgagccaccgtgcccagcccagtgcgcccctattttgaaggtagaatgtagtcgtttgaagcaggagcactggggtcagactgaattttaagccccagcgttgctccctgctcctctgttgccttccacgagttcctcaacctctctaagcttcagttgctttatctgtaaaatgggtgaaatagtatcaccacaacaattggggcagtgaaacgaagcagtgattctaccacttcattctaccactgtttgctgcacatagtgcttggcacatagtaagcgcggggtgagtaacagtggggcttgttgtcatcattacagatgaggtaactgaggtgaggaaagcccatgctgtttctaaagggtggctttgcattggttttcatttctgtgtggggccaggggaggggtggactctggggaggtgtgaacctggctgtgagtgcatagggcaagagtcccctattttccagccccctctcagggtctccttcctgatactgtccacaaacaagaaggggtccgcccagtctgaaggaccccagaacctcacggcaggcctggggaggctaggcggcgatgctgaaataaaggaggaggcaaggaggagaagccgggcaggggattgtctagaattgtccaaaaagaggaaacgagctatttctcagctctttgcctttagtgcttgcctggagatgccattgttagggtcccaggccagtcccacaatctagaaaccctccctccccacatttcatagacacagccatagtcgtggcatggacactgcatgagcccctgcaagcaatgcacaggcctcctcaggaggggaggtgccacctggtttctggagcctcaggcctccctcaccctccgcaggatgcttctccttggacatgatgttcccaggcttggaagcagctacccttccttcacctcacaggctcattgcccctctctttccctggagcctccagctaaccagtcgccacgtctggccgcgctgctcctgagctggctttgctttcctatttttctcctggcctcagcccccttcagacttcaccctgatgagaaaagtgctcctgagtagtgtcctgtctcaggcttaccctctcttgtccattcctcaagtaggtgttacaataatctcaaagacaagaaagaactagaatagtccccatctcatgggatgaatgacggaaagcccagctccccagctggtgacatcatcaccaagcagggcctggactggggcaagtctagggctcccaacagaaggaggtgctcactttcggggtcacgcaagggcaccaagtacctcccatgactgtgtgccctgggtacctctcttatctcacccactgtgtttcttactcttctctctgctacgggaggccctttgacatcaccagattgtgacctttcatttagcatggaatcagtagaaaatctgacacctgcagaattatctgcacgaagaaagcctccttgtttggaaatggggctggcttacattcacacatgactctattggagaagacagaaacctgtttgatgttgccttaaatgtagtaaaaatgttgtggttggactggcacagtggctcacaactgtaatctcagcactttgggaggccaaggcaggagcatcacttgaggccaggatgttgaggctagcctgggcaacatagtgacactccatccctacaaaactttttttaaaaaattagccaggtctggtggcacacgtctgtcatcccagttgctttgggggctgaggcaggaggattgctccagcccatgaattcgaggttgcagttacctaagagcgcataactgcactccagcctgggccacagcatgagattgtgtttcaaaaacacggtggtgattagacgtctcttttgaacctgcctcaaggtcagaggtgtatgattaggtgccaccttgggcattcctttctgtcctgggagtagaaaaagtgtaagattacctccccacgagcacttgagcatgggttgtagataaatccatctgtgtccctgctggggctgatggagatatgaggactgaggggtcctccttgcttgaagtcacatctttggcaaagggctggaaagagggcagggaatatctagatgttgctcagaggggtcaacaaaaattcttccggccagtcctgaaatacaagtctcattgtaacaataagaattatagtttagtctgacccagagaactgaggcaacattgatttgaaaacagtttgtgcacactgctggctctcctggtcaccagctcatgcctgcacgacaaaattctacagaagatgcttttcctccaggaaggcatcccgatgagcacagctttttgcccgaacataaaatgttttctgaaaaatctttccccaaaaaagagggagtgctttagtaaagtacttacaaagtttctcatatcacagtttctctcttcttatttatttatttattatttttctgagacagattctcgccctgtcacccaggctggagtgcagtggcatgaccttggctcactgcagcctccgcctcccgggttcaagtgattctcctgcctcaggcacccaagtagctgggattacaggtgccgcaccaccacgccaggctaattcttgtatttttagtagagacggggtttcaccatgttggccaggctggtctcaaattcctgacctcaagtgatctgcccactttggcctccgaaagtgctgggattacaggcgtgagcctctgtgcttggcctctcttcgttatttaaacacaaaagttctgtttgcgaaagacccattcactaaaatgacctcatccaatgttaatttttaattttgagaatcacacggagatcaccagaaggaactggcataaaaggagacaagggatttagtcattattcctgggatatgatctcaatattaactaggttagatttcagtgtaaagttttttaaagaccattttaaaaagcaaaatggtaacaggttacattactgggatggggggaaagtctcttaagataaaagtggatacttaaggcttgaatactgttttccacgacagcattgtctgctgtctctcacacaactagatggaaatgttaggaacgagctcccaaaacctgtgcctatgattcacaaaggggatctggtaatgacgaggaaggacctcagtgtccaattgcaagtgaagagttgcatggaactatcttcataaagtacgagtgaacaaaatcaattctatatttctgcattgttccacatcatcttatttaaaatatggatcataggcagacatctgactatttaatcaacatctgtaaagctcacacagttaagctgtccaaaaacttttcttgggatcttctcgttgaggaattgggggattgttttatactgggagctgcctggtgtttggccaggggttggtcgtagcctggtttgtagggcctgagcctacttgcactttctgatgtgttcttaaggcggagcctgatcctggttcactccgtcttcctcactagacagtaacttcccaaagggcagggccgtccttttataacccacaaacccagcgttttctcctgtgctgttggaaagtttgctggcccctcttctctggacctcattttcctcgtccaggatgaggagtttggataaaatgatttaataaggatccatctgactttaattttctctaaatttttgcttttggattgagtatatattttgcttcaaatgaaagctcttgccaaggcacggtggttcagagatgtaatcacagcactttggaaggccaaggatggaagatagcttgaagccaggcatttgagaccagcctggccaacaaagtgagcccgtgtctacaaaaaagaaaaaagaaaaattagccgggcatggcagtgctgcctgtagtctgagctacttgagaggctgaggtgggaggattgcttgagcctgggcaacagagcaagactctctctctcttggttgggggaagctcttgcctgtagccagggtgggatgggaatcaggaaatgatcccaggtttgagatgcgaaggaggcagattcctgactgcctatggcactgtgcaactctggattagaagaaacctgagacacattttaaacattttttaaaattaaaaataacttgtttattcacccacttacctgttcatataagcaagctctgccaaacaccgagcactatgctgggccaggagaggactgagctggggccctctctccagaggcccagcagtaggtgccaggatatagaaggcccttaactcagggggaaggagagagaagaatggaagatttccctcaagagggtatctatttgagttgatttttggtgaaccagtaagaatttcccagcttaacagggactggggactggagaacattctaggggaggaaatcatgtgcatgggctaggttagaagaaactcagtatgttctggaaactataaagtgtgcagctggggggttggaaaggtccagcgaggccccaaaaggacagaaagcaaatgtggggaatgaggtcagcacagcggggcagcagcaggcagcccctctgggagtggcaggagatggagaggagtggctggcggcaccgtgaaggtgaggcaggctggaacgggtgctcgcgctaggcagcgggcccggggaagtctgtggacagaaccacctggggtaggaccgtggtctgagcacccaggaaaagcccctgccggagatcctcctgtcactagttgccatgggctagattccaccattagaggagtctttctttggccaaaagaatgagactccaggggtcgtgtgagggtgcattctcaggaaagtgggacacattgacctcttttgcaggggttgctctatagggtcagagcaaatgtatgtgctagtaggggtggggagccagcctcggagtaaaccttgagggcataaggagaagtactgctctgggctcgaggctcagttaggacacttcaaggtaggcaattgcagggggctgcttgagggcacaaggtgccccatattcacaaataagggtggtggggagggagatgaggggaagagaaactcagaagagtttgaagggcctgggaagcaggtgtgcattctccttaagctagcctgggcatgacgtcatcaagaattttgcttaagtggttgggtacaattggtgtacacatcaaagaatgcggactttggatcaggttggagttggaactccactgtttgtcaaccacatgaccccgggcaagttattcaacctcttggaggctgcatttgtaaatggtgctggtatttacctcataagtttctaggatttcataacccacagtaaacacttcatagatggcatatatttgctcacctttggacaccctgctccggcatgtggcccccagcaggtgatcagaaaggtctgccggttcatttgaagaggagcggcccctcacccccagcagcaatgtctagtctcgattctgaccgtggcagttaaaagtttcttggaggtcctttcctaggcactgatgctggctgggtagccctggtgttcgtatgtctagattgaacaactggcaaaatccacactgactttgacctgaagagtggctgacttttcattctcagaacgcttatgcagaattatggtttctattgtcagaatctcagtgcctttttatttaaatattccccttcatgccattcctttaaaagcattatccctctcataaagcttatagagcctatttccaagaattttctataaattcatttaaaagctatcattagtcaacaggctgcttctgactacaggcaagactgcagggaaaaccttttcctacggggaagggacccagatgtatacttaatagttgtgtcttggacctgttactaagtgaagattgttctaggaaagtaggcctggactgaggtattagatttctaatcaacaggctggtctcattcagagtttgaaccagcactctgggggagaaaccacttgtggccgttgaattactctggctagcctgtctcagaaagaccatccacagccagggctaatgagacagttgaagaaagagaaatactttacctgagggttttggtttttttttggcttttatttttgtgtgtgtggattaccaccatatagctcaccatgttatcccagaaagactacaatttcatacagaatgcacagatgtttaaataaaaagccatttaagtgaggggataattctcactaaaaaaagctcaaaaataagaaatgacaattctagatacacttttttgacatgtaaaatgacataaccatagtcacagggaataaagaatcaggtttgaatgtccacaggtttctaaaactaagctctggcttcgtatctgttgaaaatctttagcggttggggaaaatagctatatttaaaaacaaatattgaattttgagttgaaaggtacattttcctcccttgatggagacagaacttttctatggagaacccaagcagcctttccatgatcttactaagttgtccaagagccaaccccgatcagcagcaacaggactcaagctgttcaccctgctttcgagttggctgagcttcctgctgctttcacacattcttctttttctacctcagttcctctttgcttgtagtctttcactccattaacttgcccaagcactggacttaagtatggaagagcctatacgcagttgtaatatatttcgtattttgaaagtgtagaagtttgtattaatttaaaaagaaaaagcttaaatggaaagttaagcaatcctgaacaagaaaactctctcactgcctttgggctagagaaagagtatgctctcaaggagttacataatcttttccaaagcaggatggactgtatctatcatacacattaggataagatgagccaccacaccttaaagaaatcaggcttgagcctatacaagccataaccaaatagaagattttaaacaaaggagcacatagcccaaagctgacatgttatttctataaactctggtatatatgtgaaggagttactgttggctggcttgtgggttttttgactcactacatttttttagacaaaatcacaatgtgaaggcacattaatagttgagattttcttttccttccaggtggacttgctgactgattagtttcatatactacttagtaacctcaagaagtagcaggaggatgccatgtatcaatcttgaacttcaagtctcactgcaacaaggatggagactccagcagagtgcagggtgggcacagacaggccacaagatggcgcagcacctccatacttgggctcttgacaaccaagtaggtttttttttttttttttttttttaatgtccactaggagggaggatgctacgatttcagacctcagctattaaatagtaaatctggaaaactagtggataaatttgccatctccattctatgttattaagaccaagatagtgtactggttttcttttaaatcacattccattatgtcatttaaaatgtcacaaaacccacacgaagcatctcatttacactaagatgcttatttagctaacaccactaatgataaatgctgttacaaatatgcatagtcagatgatagtaaccacatacagaaaaaaaatttgaacaagtatttatttcttaaaatttacttaagggattagagctaatatataatagaacatttaatataacatttggagttatgtcaacataaaaatagctgtggttacaattagcacatgcaattcactgcaaaggtaaaaatacatgctatactctagacaagccttccaaatgaagttagagtagatggggtaaaacagcaagtgaacatgaaaggattgcacttagaagaaagtgggacatagctaggatataaaagaaacatacctaatgctagtcagtcactgcattgtcctactagcaaattgcacatttatttttagagtatattcaatacacatacatattgagactagagaattttcaaatatctacctttgaaatatccctttgtttctaacacatcacattatggtattaatgtaacagcacttaaaacctgtagttatcattcaaagcttgtgttcaagagataaaagaacatcattcagacaaagcctgtgttcaagaaataaaaaaaacatctatcactatcggccttaaatgcatctcatcacacgacccatcaactttaatgaaatgggtaatgaagttaaactaaccagtttgtacaaactattgactgagaaaaagcccttaaaaatttaggaacaaatgagcaacagaagagctcaccctgagctgccaccttttaatttttaatgcaatgtatatgagaatatcatgctaatgcacatactagtagcatgtatgatggaaaaaaataggttaatgcaaaagataatacgcttggctttgtaaagttttgttttgacttacatcatctgaattctgtttatcgagtctgaaaaggaactgctgccaaggaccagtccaaagaagaattaggctgtaagactgctagttcataccttctttgaaatcaatgacaatgtccaattttaggctaatcctaaaacacttgccattttatgactccatattcttttaatttacagaaaagtacaaattttttagaaagtaatcttatcagcacaatataatctaacaatacctgtaatagaaagctatcccagtaaattttttttgaacaattgaacttttgtcttatgcagcttataactttgttattttattcatctcaacaaaataaaactttattgaaacaaaagtgtatggtttaggaatatgctcttaataacaactgagcaaaattagaatgatgtggactataacagaatgaaggaagatctctcctgcttgatgtacttggtcaatatatgttagtaaacagaaatattttagggaattctatgattattctacttctacatttacatgtcatggttttaactagttaaatgggtagaaaaaagacatctttaataattgatttctatttctcaaactagatgctctactttaaatatgagctttaatgaatgttttgtaacattttaaagttgtaacatttctaagtatactccactaacttcacaataagagctagggtcactggatgacttcatgtggtaaaatcccttatcaaggaataaggctgaaatttaaatgaacaattaggtagagaagaggtatgaacacagaacatgtgaatgaaatttgctttttttccttgctgctgttcccgagtgccgactgatccatagtaaaaaaggacaagattaaaattttaggttttaatggtacaaagtgtgaagttttatagttttctaataattattcagtattatccctttcagagatgagggtaggataccacagacatcagtaactgacaagttataatatcaacacatgtaacatttgggtcattattttataaccctaaagggagcaactgcaggtgcagaagcagtgagtgaactagttttgtccagacaaggttttctgatgtgctattactttaaacaccacttttggacactaaagatttaaagtgataaagccactaactaactttattagactagtttttacataaataaccagatttctttgcctacctaaagtacaatttacatgcatcaacacatagattattctaagacatgcttgggaaagtaattttgaatgtaaaaagttttataatttattttctccttagggcaggtgtacattacatattagtgctcaaatatatgttcatttccagaatgaatttttgcacagtaatcatatatccatttaatatgtataaagtgttcttggggatgggggtatattcactcactgtaccatgttttatacaggcttcaacatgcaaatttgtttatatcatggccttcaatgatcctccattctcattcctgtagattaagagttcatattgtatatctgaccctgaaatgtacaaacttcacactacaacattcttcatgacactatttgttatgaggaaagttgcagctaaatattagtcatgtgacttaaattttgagaaaatggaaaatgtaataggtataaatttcctgacacatacagcaagacaaatccagcccagcctttgatgatcaacttaaaagctggagatgtcattatcttgttgtgtaaatttgggtctatccctacctttacttctctgtgcctgattttcctcatctactttgaattcgtcattctattaatctacttttgcctaaagtgggaaactgaatatatcagaatgaaacatctatttttttcataaagaagatcatataatatgtgaaagaactttgaaaggatgaggcattatataaatgcaagaatataaaagataaacaggaagtctaatgtgaacaatattctgagagtaaaaagtgtaattatatttccattgtaaatgtataccaagttttcttagctttctattctccaataacctctagaaactattctaagcatgcctggtttctgtaacttaaatatggcataaaaacctgtttcctttgaattcacttgatagcagtagtcaatcactaataacgcttgctaatttcctcttactttctaagaaaacccctatatttagcatctgcttccatatcgcacgtggtggttaggggacagcataagtacactagcggctttagcactaaactcgaggcctgggtcacttctcccttgaagaaaaaaggttttaaaaattcctaaatcacaatgtagaactaagttccaccctacctcagaactgcagacattaaaataccatctctttattaagtgtctctacaataatgatatttgctaagaacaagatgtacattttttggggttctgttttgttttggcaaatattgcccaagttgtcttagtgtgcctcaaacatttactaaaaataaaaaaatttaaatctttgcctacttatttaaaaataaaaaaaatactcaaaacaaatttaagctgaagatatatactgtataaagtgttcatctacccagtactctgaagtcttaagaaaagtcaatgatatgtgtgtgtatatatatatatatatatacacacattagcaatttaagccttttaacatgccaattttttagatgctttattggttttttttcccctttactactacttcctgttttcccctttactactacaatttaagcctttaaaaatggcaattttttagatgcttgagatagtttgggggatccctagctcttatcatggcactctgttgagtttgtgaaatgcatcttcaaagaggttgtcaataatatgcaaatttttgaaaactagtgagattactaattattgatgaataaaaaatgagtacttttaatctgccaagttaaagctctagaattccttttctccagtaataactcgcagcatcactaccaatggaagggacctaaggaataccgtgtacactgatatacacgaagctgctcctcatttttttgtcagattacaaaagctgggctcatgtagttatggcctatggacctctttttaagttattttagcagaagtagatgatggtctacaccttgctcctcttttatattaactgtccctaagccactctgatgactattctaatcaaaatcagtatagctgtgctcactaagcatatcactgcttattattcaaataccttctgttttctatgtagcaaaacaaaaagttttataaatttcagataagctttctgtttttcttcagtgcaaacatcctgaaacagcacaaaatcattcagctagtctgaggataaagtcagtttatgtagtgcttaaagtagaatcccagatattctggaatggaaatagctcatgtgaaacttcagttcatttttgtccttaagggcaaatgatcatcttcagagagtgaagactttttaaaatctgaattcacagataaaatcattttagctttactttataggtactgctgaagttgtagcaggaactactagtccttcactgaggcatgtagccgccttgccgtacagtctgtggtaagtaacttttaggcatgccttcatcagtcgcagcctccatgccaactgtttcaaatctttctacttgtccctcagtacctggaccaaaagcatctgctgcagaaacttcctgaaacattttcatttgcccagatccacaggattgtgaaatatgatctgaaatctgctgtttaagtctaacaaaatcttcctcattgactgatgaaacttgctttgacctttcaaaatgtgaaatatctggactggattcatgctgactgcagttctgtttgaagtactgttgcctgggcaaaataccatcaccgccatctacatgatctactaattgtagatcttctggccgctcctctgaatctaacaagggctgggtagactcggatcttgagaagacttggactgacggaacttggtgtctgtagccactgtgtaccacggtagaatactggacagtgctcgaagtgttttgtgaagattcattttcatcactgctagaaatgcttggcctagaagatgacatgcatgaagaccccccaataccactgctgtgtccttcagtattaattttttcctttttgaacaggtccaatgatttcagatcttctggaaaaggctttttgtcatttgcttctatttccacaacacttacatcagtgaaattgccatctgaatacatttgatcttttgaattaaaattgtgctaaggaagagaaaaaattgtatatggcaagtattagttaaagccacagagctaatgcatctctgaaacttcccagtaactctcagtggtacagaaataacctgtattatgtcactaagtcactgtcaactacccaaaatgcagatactataaaatgagtctaagtagtctaaatcaatattgttggtgttacattttgataagctaatggtctacaagtagtatttaatatttcatgcctagactaggcagcctaggattaactggacagaaaactagaaaacattaaggaaaatcaaacctgaatgacagagattttgtagaatataaaaatacataatacattttaatctgttaatataaaatttaaggactaccggaggataataaatataaatgagttcccctttggggcatatttaaaattcagagtttagagtaggttcccagagatcatttcatcagtgctaaaatgataaactgttgaacttggttttaatactcaacccaaaatgcttgaggtagttaccatcacatagcagtttcagcacctcaagttttcagtttgcaagttcaaccaaacatctgtaatgtgtactaaacaatttaaaatatcagaacaaatatactatgatggtgataaaacccctaaaatatgtcatacatattaaattttgattaaaattttcagttatgtactgttttatcttcatttactttttgattcagcttgaatatcttatcttttggtacatttgtagatactcaatatacctactaactgtagatactcaatatacctactaacatgtctgtatattataaacaactcagaagcattttctcttacccttggaggagtgtgaggtgaccactgggcaatatgactctttgaaggatctggaacattaggccagatgtgttttttaattctgaagagaaaagaaaaatggcctatgtaaaaccacacataataaacaataaatagtccctatttctaaacatgttcatcaaagactcttacaaaccaaaccaattacctaaatgaacaaaaaatacctactctaccccaaacaaaaattatttttcttataaccaatagaaaaatactgttgaaaatgcataaggattataatgtattcataatgaattaacaaagctaaatctaatcagtgttcaaatttttttttaaactctcaaaattctgcaattaaaaccacttaaaatctttacccaggccacatgttgtggtattccaattaaaagaatccagataacaaattaatgttcccactgataccaaaaaagttcaaatataaaaatcaaatttaaaaaagtgactgagaatggtgcttcaaagagtgagagcctaccagactgactctcctgtaggaaatacctataacatttggaagtaatataaaaagtagtaaagctgacaacctagacaaaccaatgaatgaatccttgaaagacacaaattaccaaaacagattgaagaaaaagaaagctatatttataaagaaattgaatttttaattaaaaaccttcccacaaaactctgggcaaaaggaaacaattgtattaatactatacaaactctttcagaaaacagaggaggtaacatgttcccattcattttatgaggccagtattatcctgattttaaaaccagacagataaggcacataaagacagactaacttcactcatgaacacagatgcaaacagtattaaactgaatgcagcaaaatccaaggaatgcaaagatgttatatgaaaaatcaataaaatgcaccatattcatggaaggaaggagaaaaaccatatgatcatctcaatagattcagaaaaagcatttgaccaaattgtgacacccattcatgataaaaattgctagcaaggcaaaacagaaataagaacttcccccctgcaagtagtagtaaaggggaaaaaaaaacacaaagcggctgggcgcggtggctcacacctgtaatcccaacactttgggaggctgaggtgggtggattacctgaggtcaggagttcaagaccagcctggccaacatggtgaaacccccatctctactaaactaaaaatacaaaaaaattagccaggcatggtggtgcatgcctgtaatcccagctactcgggtggctgaggcaggagaattgcttgaacccagaaggtgggggttgcagtgagccaagattgtgccactgcactccagcctgggcaacaagagtagaactcagtctcaaaacaaaaaaaccccacaaagcaaaaacttcaacctacagctaacatcacatgtgatggtgaaagactaaatactttcacctctaaaattaggaacaaagcaatgctcttatatggtctagatgtactatatgtactagaggtcttagccagtgcattaagacaataaaaagaactaaaagcataaagattagaacaactataattactcccaagaagcatgattgtgtatctagaaaatcctaaggatccaaaaagctactaataaatgaatttatcaaagtctcagtatacatgatgaatatattttaaaaaatcaattgcatttctatatactaagaattagaaaatatttttaaacatttcatttataataacaaaaaatacttttgtcatgaattcaaaaaaagttatgcaaggcctgtctactgaaaactacaaaacactgcaaaagtaaattaaacaaaacccaaataaataaagaaataaaccaggttcacggattgaaagactcagtagcgttaagactgcagttctctctcggccttagcgccatttttttggaaacctcggcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcaaaaacaaaatgcccatgttggtcctctgccctggacctgtgacattctggactatttctgtgtttatttgtggccgagtgtaacaaccatataataaatcacctcttccgctgttttagctgaggaattaaatcaaaaaaaaaaaaaaaaaaagactgcagttctctcctatagattcaattaaatctgacctatagattcaataaaatcccaatcaaaactatagttttaaaaaagttgacaagctgaattaaaatgtatatgaaaaggcaaagaacctagccaaaataacttctttaaaaaaagaacacactggaagaattctacctattttcaaaatttactatagagctatactcatcaaggcaatgtggtattggcataagaacggacatatatacatttatgaaacagaagtgagagtatggaaatagatacagacttataaagacaattgcttttggcaaaggtaccaaagcaattcaatggggaaaagacactcttttcaaaataaatgacaatggaattagacatctgaaggaacaaaatgaaccttgaccctgacctcacaccatgcacaaaaataacctgaaatggatcatagactaagagctgaaactattgaacttatggaagaaaacatgagaaaatattttgatactgtgtttggcaggacacaaaactcaggaaccacagaaaaaaaactgataaaatgaacttcatcaaaataaaaaacttatgcttttttttttttttttttttttttttttcagacactctgtcacccaggttggagtgcagtgatgtgatcttggctcactgcaacccatgcctcctgggttcaagcaattctcctgcctcagcctcccgagtagctgggattactgacgtgtgccaccatgcccggctaagtttttgtatttttagtagagatgttagccactgtgttagccaggatggcctcaatctcctgaccttgtgagccgcccgccttgacctcccaaagtggtgggattacaggcgtaaaacttctgcttttctaaagccacagttaagacaaaaaaacaaagcacagactgggacaaaagtttgcaaaacgtatttaacaatgttgtaaccagaacatataaagcactcttatagctcaattataaacaaaataacccaatttgaaaatgggtaaaagatttcaatagacacatcacaaaagaaaatatgtaagtgacacatgaaaagatccattactagtcatcggagaaatgaaaattaaaacgatatagtactacacacccactagaatgaaagaagtctgacagcactaagtgttggtgataatatggaacactgctggaggcaatccaagatggtgtagccactctgaaaaagtttggcagtttcttataaagttgaacatatacttaccatatgacccagcactctcactcctattatttgttcaagataaaggaaaacatatgctcgcacagttttgtatgtgaatattcatagcaacattatttataatagctaaaaattagaaacaacctaaacttccataacagatcagtctaagttttgatatatccatactacagaatactgttcagcaataaaaaggaaaaaggtaggccaggtgtggtgactcatgcctgtaatcccagcacttttgggaagccaaggtgggtggatcacttgaggtccggagttcgagaccagcctggccaacatgatgaaactccgtctcaactgtaaatacaaaaattagctgggcatggtggcaagtgcctgtaatcccagttactcaagaggctgaggcaggagaatcacctgaactcaggaggtagaggttgcagtgagccaagatcatgccactgtactccagtaagggaacagagtgagactccatctcaaaaaaaaaaaaagggagaagtatatgcaacatcatggatgaatctcaaaaatattatgtaaaagacatacgcaaaagactacacgctatgtgattctatttatataaaattcttggccgtggctcacacctgtaatcccagcactttgggaggctgagggtggatcccctgaggtcaggagttcgagaccagcctggccaacatggtgataccccatctctactaaaaatacaaaaaattagctgggtgtggtggtgggcgcctgtaatcctagctactttgaaggctgaggcaggagtctgaaccagggaggcagaggttgtagtgaactgagatcgcaccactgcactccatcctgggcaacaagagtgaaactctgtctcaaaatagatagataaataaaaattctagaaaaggcaaaactacagttacagaaaagcagatcaatgactgcctggggttgggctgagaagaagacagattacaaaggagaacaaggaagctttataaaagtgatgaaaatgttctatattgtgattatggtggtagttatacatctgtatgtaattacaaaaattcatcaaactgtacacttaaaatggataaattttattgcatgtaaattcagctcaataaagctgggggaaaatgcaaaaatatgaataaagttacttacaggtctcgcttattaaagcagaacagcactcccagaagagttgtcaataggaatgctaagcaaacaggcacgactatggcttcaatttctccttgagcttaaaaaaaaaaaaaaaaaaaaaaaaagaggtgtgatgggaaataatgttgacatatgaactaagaagacataatacaacttcccaaccagacttactgttgaaaagataaaatacaatcctaattatttttcaaggtctcttcagacttgatgatttttaccctcttctctctttggtaaatcacatcccaaccatttatgtcttatacattaacctggccgcatagcataaaatatatgttggttgggggataaaaatgatcagtgtatcgggtaatctactgggttagagctttcaaacataaccatttgtaacatttatgatctgcatttggtagaatcttagtaaaagtttatctctgagttctaatactgtataacagagaaattatgtcagaacaaatataaatactgggtaaaatggaaaagctataaaaacataattgaactacacatttaaccttctaaaaaataaaaatgcaactctcagaagttttaagagttatttaccatttttcaaaaggaggatatagctggtacagggctaagaactttaggagctgctcaatgggcatgaggagtggcacgagtaggaataaactaaaaagtaaacaagcctaagatccctaaataccacacaaatcctcatctgcatttaaaagaggacttgttcatcaaattaatcactaattgggataattaacattggagattttttaaatgactgtcctgattaattttgaattttacttagtcttttacagtaaaaaatgtatgaaagtaatattgcagccatatactattcacttaattttatccttccaccacacatatccctttgtaagtaactaacatcctatgaagctcagtagaaatcaagaaatcagttaaatgcttgagaataaactatgggttggcaaatattaactcttaaatgctaagcatcatatatatatatatatgggtgtatgtatatatatttatgtgtgtatatattgatatatgtgtgtatatatatattgatatgggtatgtatgtgtgtatatatatataaaatgccaaatctaatttaggcagaaactttgctttattaaacatctgcttttatgttttcaagcctgtgcctttgctcatgctgctctctaagatgccaccttcttcctatttgtccacatactaactcaaggctcaagtattttcttcttcataaaacctttgaaggtaaaattatccactactggtatatttaaattcctactctatttactgtctacatagtccacaggttctcctttttctgatttacttatgcaaaatttcttcaactaagctgtaaggtcctcgttggcaagactcaagccatgtgaagaagccataatggatccatgagactacagatagagaattgaaaaaaggtaggttataaaataatactaagtataatttaattttaggaaaaaaatatatacaaagaagacactaaaaggatacacaaatatgttattttggggtaagggactaggactaatttttcttcctctctacattttactgtacagtctaaattccctataatgaacacctatgtaataaaaaaattttaggctgagcatggtggctcatacctgtaatccggcactctgggaggctaaggcaggaggactgaggccaggagttcaaaaccagcctgggcaacacagcgagatcccatctctaccaaaaaaattgttttaactagccaggcatggtggtgcctaccagcagtcttagttacttgggaggctgaggcaggaggattgcttgagcccaggaatttgaggttgcagtgagctatgactgcaccactgcactccagcctgggagacagagcaagactctgtctcaaaaacaaacaaacaaaaaatatacatatgggcttttatgtgtgtgtgtacacacacacatacatatatacaaagctctgtagagatggctggtctccacagaaatacataaaatatacatttttaagtttattttttaatttttctcaagattatggtataaagttttattttaaataacatacctattaacataccaccacatgggaccaaccttatcccagaaactatattcattactgaccctaacagcaaagctcaggaacttttatcatttattttatgtagtcactcattcatttattccctcattcagcaagcattcaaccaacaaggcacatggaatttactacttatcattaactaggctggcacttgggggtgggggttacaattatggtaaaataaggtaattttctataatgattcaaaatgtagggggagcaagaaagaatgttggttaagtttgctttagggaagatacagaagagccagatgatgaggtgaagacctcactgggggcaatgcactaagaaaagagaagttagcatgaggagcttgcagttgaagaaaatgatgatgaaagggtacgcacaatcaacaggacttgacactcagcttatgtgagagaaaaatatacaaatacatttattgtaatcacatttaaatttatggctttggcatagaacgagggagggaaaatgtatttgggaaggaaagagaagatggctaaagccatggacagagtttgaataggcaagtaagaaaacagggtcaagaggccgggtgcggtggctcatgcctgtaatcccagcactttgggaggccgaggcaggtggatcacctgaggtcaggaggtcgagaccatcccagccaacatggtgaaaccccgtctctacaaaaatacaaaaaattagccaggcatggtagtgggcacctctaccccagctacgtgggaggctgaggtaggagaatcacttgaacctgggaggtggaggttgcagtgagctgagatcgcaccactgcactccagcctgggtgacagagcgagactctgtctcaaaaaaaaaaaaaaaaaaaaaaaaagcaaaaaaaggagaagaagaagaaaacaccaaagaacaaggagactcaggagactgtgctagcagaaaaagtatggttagaaaacccaagggaggagggagtttcaaggatggaaggccaacagagtcaaatgcagaaaaggctggaggcagtggcttatgtctataatcccagcactttaggaggccaaggcagaaggatcacttgagcccaggagtttgagaccagccatctctataaaaaaaattagctggatgtggtggcactggtcccagctacttgagaaactgaggtaggaggatcacttgagcccaggaggtcaaggctgcagtgtgccatgttcatgccattgcactccactgtagcctgggcaacagagtaagaccctgcctccaaaaaaaaaaagtagaaaaaagatgaaaactaaaaagcatgcagtacatatgatgatcaagaggtcttctgagtgacaccagagaggtttcagtgcaggggtggggtaggacccctaatttcagtatgttaaatactgagtgggaggtacggaagtgaagactgtaaagtggactagtccttcaagtaatctctcaataaaagaaagaaatgaggatagagaaggaaagaacacacccaaaccagtgaaaaaaatgaacccacatggaaagatacacaaattcttttaggatttttagtacagctgaatatagtcagaagcagttaataaaataccaaaaaggtgaggaataacactttctataaagaaaccaccaaccaaagccagataatataaaaatcatcatgaatccaaagatgtactttttaacacaattttagcacataaactaagttcatttctaacctaagtttgagaaagaaaaaaaaccaaacttcattatttcttaccaaactttggggtagtaaaagtgaattctggaccatccttcccaccttcatctgtgtatgctgccattcgtaccatgtacaatgtgtcactagtcaaagaggacaatgtatattctgtgtgggaagaatccacattcacagctggaagaaataagaactgtgcttcattcaactattcaatgcttttgcttatttggcctatatttggcattgtgaaagtgttaaaaaagaagcgaagtatttttgttggaaaacaacttttataatgttctgacataattttatgttctaaagcacaacacaatactttttcaataaatccatgaaagtaaccataaggcaaattctcaggtgtctcctgaggccaatatactataagatgtataagaagaacagacttaaattagtacttaaaagcttaaggaaaaaataactgattcttaataactgatacagttttattaccagtttcatttccaatgatggttctataaaatatagtataatttctgataaatccattctgaacatcaacaggaagttggtcccactctaagacagcttcgtttttccctactttttttgtccgaacagtaggtcctttggaaggtgctgtaacagagtgaacacatttgctaactgaaaatcatttacaatctagtaaaatttccttgtcataaaatcatttgaacataatgagatacatctttatttaaaagcgataaaatgtttctgttaatacaaagccctaaactttttttttcaaagaagtgagtttggacttacgagcttgtttaaggtatgcctttatggattcagggcttcctggtccatcagcatatactggagtaactgttatcaaatagcatttgctctctgctaagttccctaaagcaagaatagcagattaagcatgtttttccataatgaaaaagtcaagttaataccgtaatttatttttacattataatttcatgaccacttaattttcttttaaaactgcagttttctaagtaagcattgtcttttgtgtactggattcaagcttaatcaggtaaaactgtctgtaaaagtattgccaatgcagtggataaaaaatacattgttaagaacaatgatggtatttacatttagaatttataaaacaatgatctcaaattactctggattttatagagtctgacaatttttgtatgtcttacctacaagagagaacagcctaaggagcaagacgactaaagcagtaagacctaggggaaagcactaacggtcctagtttgcgagttggaaaaaagggtatcttaaaaaatttcctcggccaggcgctgtggctcacgtctgtaatcccagcactttgggaggttaaggtgggaggatcacttgaggttaggagtttgagaccagcatggccaacatggtgaaacccccctttactgaaaatacaaaaattagctgggcatggtggtgggcacctgtagtcccagatgcttgggaggctgtggcaggagaatcacttgaacccaggaggcggagcttgcagtgagccgagatcgcaccactgcactccagcctgggcgacagagtgagactctgtctcaaaaaaacaaaaaccaaaacaaacttcctttatttttatcttttttagcatgcaccactaaaatttttcttatttatacagtatattatctgtacatattagaaaatgttttattgaaatttataccttcaataagaatgtatattccttaactattactcatgaagttacatgctcctttaccttcttaaacagattttaccttttcttaatgattcaatattaccaaaaaatgaacaatttttatattctactctaatgtgatgctttcagggttactgagcaacatacgactacctacccaaacttaatgtctccacaacttatgctagcttctattttttttgagatggagtttcgttcttgttgttcaggctggagtgcaatggcatgatcttggctcactgcaacctccgcctcccgggttcaagagattctccagcctcagcctcccaaatggctgggattacaggcatgtgccaccacgcctagctgattttgttttagtagagacggagtttatccacattggtcaggctggtctcgaactcccgacctcaggtgatttgcccgcctcagcctcccaaagtgctggaattacaggcgtgagccaccgcatcggctgctgctttaaaaagtttctattggctctgagcagtggttcacgcctgtaataccagcactttgggagtttgaggtaaaagaatcgcttgaggccaggtgttggagatcagcctttgcaacacagtgagattccctctctacaaaaaaataaaattagctgagtgtggcagcatgtgcctgtagtcccagatactccagaggatgaggcagaagggtcacttcagcctgggagttgaaggctgcagtcagccatgatcatgccaccatactctagcctaggcaacagagtgagaccctgtatttatttttttttaagaagtttctatagttatttccagcctgtttcaggacttcctaagctccaccatgtttttaatttgataaagtcagtaaactagataaccaagcttattaaaactgtacactaataacatgtaagtccaaacagcctgtattatgactaaagctcaaaaactttatggcaggaatctctctgcttagggcttttctctaattaaccatattattcacagctgaattctaattattaattatcaacaaaagactataaactgagtttttttctcttcaaagttgttgtatcactttataaccacttaagcagcaccataacacacagactggagcgctacgattcattacttctgtcctttgttactacttccaattgaaagacataaggaaatctgagttctagttctgcttcctctatctgatggttctaagacattacacaagtcatccagatgctctaggaaactattttctcatgtgaaggatgaggtacagagaacatataactaatcagcagcaaaggttggactcttatatttctctatactctatagttttaggagttttcccttgacgataaaatcatattggggtacaaaaagaagaaagtattaaccccactctgttcataaagagactgtaattcagagaggttaagtatgacttgctgaaagtcacacatctagtaagtagtgaggctatgataaattggaagtcgtttcaacggaccaaaacactataagcaaaagaaaaagctgcctaaagagttagaaaaaggatatcaatttagatgtttctagccaggtatacctcttaaataggtgcgatgcacggtaccatcttcttgttgccagtctgtgatacagggtgctttatctgataacacacaccactcaagtatatatttctttacagattcccttggagtagtccattccacccaaagcatgttatctttggggaatgctttaagatccattacagggtgagtagctttaaaacaaagtttgaatattgaaataataaatattaacaaatttgaaatttccatattttacagtcatttccaaaacatgtgatttatcaatttttgtagcatatacttccttgcctaaaagcactttattataacttacaggtaaagtagtcaatttttaaacttagattttgcttccccgctgggcactgtggctcattcctgtaattccaacattttacgaggccaaggcaggtggatcacttgacatcaggagttcgaaaccagcctggccaacacggtgaaaccccgtctctactaaaaatacaaaattagccaggcattgtggtgcgtgcctttaattccagctacttgggaggctggtgcacaagaatcgcttgaagccaggaggcagaggctgagatcgtgccattgcactccagcctaggcgacagagcaagactgtctcaaaaagaaaaaaaaaaatttgctttccctaaattcttcaaatgctttcggtttgtaattgcaatttttcttctttgaaagctacgaataaagctacagataaacgtttcagtcatatgtatacaaagttctcaaaatcttgaaataatattttaaaaaccaggtaagtaatcagaatatgcttaaatgaatgaagtagcttactgtgaagtttaagtgagcatgtagtgatggaaatgttcttgcatcctgatgaaatttgtctgctgactgattcctaaaaatgcgatcactagctgggtttggtggcatatgcctgttaatcccagcactttgggaggccaggggagatcgcttgagctcaggagttcgagaccagcctgagcaacctggcgagacccagtctctgaaaaaaagaaaatcattatttataaaatttaaaaaattaaaaaataaacaagtgattatccctgatactgaggagacagtcttagataacttgtgttttttatgggagccctgtccatacctaaccaccatttttccacccaagagtcaggctccatctcacagatacaaaccttgaaagtcacaggcagggatagttaaaacagctgcatctgatttgccaacaagatttcttactgttagggttgctagatagcgatcatttgtgagatttactgtcagttttgtggcattaactgtgtaattttgtaaatgtgatttccatcttgtgagagtcacttcataatccaagatttttccattggcttcaaaaggaggcaatgtctgtaataaaatagtttatttttaaaaataatctcataaatcttgaataaaaaatcagtttttcttcatattcacaaatcatgccattatgtcaaatctctaaatatttaactggaaaggattcacaatctccattttaaatttggttctaaaataaaactagtacatactaaatgaagagtaaaagcatgacctcaactaaaaaagggtaagtagcatcattccgttagcttttggttctgtatcaattctgcactgtggctatgtaggtctaaattatttattttatgcttgagtatttttctaccttcttttttagtatgatctactcatgcacttaccagcatacattttgattatcacaaacttttattattttctgagttactctggaaaattccaaagtacaaaaacaacattcctcttcttatagaacttatactttcacagaactgtacttaaatacctataaggtattatttgtagtttatgaacctgacttctatataatattaatacatataaagcattacctttctatttagtaaaaatagtaatcaaatgctttgctattaaaatgaataaaaatttatctatttaaaagacctccattcataataccatacaaaatgtatttataagggctgggcgcggtggctcatgcctgtaatcccagtactttgggaggccgaggcaggcagaacatgaggtcaagagatcaagatcatcctggccaccgtggtgaaaccctgtctctgctaaaaatacaaaaattagcggggcgtggtggcgcacacctgtagtcccagctactcaggaggctgaggcaggagaatcacttgaacctgggaggcagaggttgcagtgagccaagatcacgccactacactcctgcctggcaatggagcgagactcggtttcaaaaaaaaaaaaaaagatttataagagataaaatataaatgtgattttttaccttccacacgagttgtacagttctgtagccttgagtatgggatggatctattttataccagaaacttggtgctttagatggtcctaaagaaaagacataaactccttaaaataaaaaggttttaacagtaaaataaaattctgcaaattattcttttactttgttcttaatactcttgccctccaattgcatggtgtctctacctctttataccagcattttcccaacccagcacaaaacacctggctcttcctttagtcagggtgatagcctgatcaattatactggaactcttttctaacctcaaaattgtaaaggtaaaaatgtattctgagcaacaactaaagaggcatcactctttcttataacttcatgttctttattctgtttgtgtgctggcactgtatttatctacttgaatctcctgtaccagcagccttttcccagccttcctggtctgcctgtcctcacttctgttttgtcatctgtaattgcctcttcatgatcaacacatcactgcttagattttattcaactcctctcttattctattaaataccaggtcttctaattatatttataaaaattttgaaaaattagttaatatgattttttaaagaaaaaaactttttaaaataaagtttttaacagtaaaaaataaaaatgaaataaacataagttgatactacttatcgctgaaaatcaaactggaaaatctatttaaacacattgcttactcctaaatattcacaagaataataaaacaaattaagataaatgtactaaaataagtttattactttatataaggatgattgagagtgatgggatgtaataaaaacaaattcacagtattgttgtgataatcactaaccatctgaaaaagcaatccataaaacatagtggtttttttccagagacagtgtctcgctctgttgcccaggctggagtgcagtggatgactatagtgcactataaccttcagctcctaggctcaggtgatcctcccacctcagcaacccaagtagctggggtttggccaccatacccagccaaaacataaattgttaaataccagtaattaaattcggttttaaaaatacctgtagtattaatttttcaaaacttataatagccattaaatgtagcatataatttttaattttttagcaataagtaatatcaactgacatttcatttttacttatcattgttaagctttttgtaaaaagtttgtcttaaaaaaatcaatggcattaactgatttctcaaaatttttatgaatataataacaagatatggtagtcagtagaataagacaggagttgaataaaatctaagcagtaaggctgggtgtggtggctcgtgcctgcgatcccagcactttgggaggccgagggatgtggttcacttcagttcagtagttcaagaccagcctgggcaccatgacaaaaccttgtctccacaaaaaaatacaaaaatttgctgggcatggtgacacgtgcctatagtcccagctatgttgggggctgaggcatgaggatcgcttcagccttggaggtagaggctgcagcgagccgtgttcatgccactgcactccagcctgggcaatagagtgaggcactatttccaaaaaaaaaaaaaaaaaaatttaagtactgatatgttaatcatgaagaggcaattacagacagcaaaacagaaaggataggacaggcagaccaggaaggctgggaaaaaggctgctggtacagaagttaaaatagataaattcacatgagtacagtgcagcactcaaacagaataaagaacatgaaattattaaaaaaaaattatgagctggaaatatttcctaacataaagggaacccagagacttcattcacgcattgatttgacaaagattatgtacacttgtccattaaaaatgcacacaggcactaaccacaatattttacctacattttaaactatttcatgaactcctccccatgtatctcattttaagaattcctggtcaagacaaagcaatctggctgaggactcccacagcagcaatagcaaaattgatttctttctcagcatttatgagagaaatcttagggcagaagggtacttttctgcctttgatgttctcaagtcacatgacctaaacctctagaagagctggaagtaaagggatataggtggtaggggattttttcagccacagctactgccattgataactaagagatgagtctgtgataggaaggtctcaaaatgaaaaatctatgccacgggattatttcttgaacttagtaacatcagatgctttgcagtgaggatcttactttagactgtacactctttttgtgccttttttattctatatcatatatattatctataggagaaaaaaggaaaataaaaactaaccaaccaaaattccaggatcaaccgcttcccaggggcttatcaagtgctattagaaaaaaaatgaataaaaggtataatacaagtatatttttgatagtggggatctaaggtgtagtttgctagacagtgtggttttaatgattcaggatatgattctctagttaggagtatctctggacaagtctccttgaataaaatgttctagacttatcaacagttaacggttttctgatagatgtatctaagtcaccattccatgatgaattttttttttttttgagacggagtctcgttctgtcacccaggctgaagtgcagtggcgtgaccttggctcactgcaacctccacctcctgggttcaagcgattctcctgcctcagcctcccgagtagctgggactacaggcgcccaccaccacgcccggctaatttttgtatttttaatagagaaggggtttcaccatattggccaggctggtctcaaactcctgaccttgtgatccgcccacctcggcctcccaaagtactgggattacaggtgtgagccaccgcatctggcctccatgataatttaattaggtatcaaatagacttatactatcaatgatccatattcaattttacatcttaatgtccttaaaaattaaaacgttaaaatactgcagtttgaataaaatgatcacaaactaagaagcaatgaggctatattattaaaaccagaaccagttcacatctggaattccaatagctttacttcttcatatacttatgtacttactatcttcataggtgatcccacttgcttcttcactccagtcactccagtatcccttaccatcttccttcatacagcgaatcctaaacacatattctgtaaaaggtttaaggtcttggacagtgaatgaagatcgggtggatgctgtgtcttcaggaggaatctgaaacaaagcaaaccaaacaacagaaaacctcaattagtaaggtcttctaaattgtgttaaaattcagaaacttttttttttgaggcacagccttgctctgttgcccaggttggagtgcagtggtgcgatcttggctcaacacaacctctacctctcccaggttcaagcgattctcctgcctcagcctcctgagtggctgggattacaggtgcccgccaccactctcagctaatttctgtacttttttagtatcaacaagattcaccatgttggccgggctggtctgtaactcctgacctcaagcaatccacttgcctcggcctcccaaagtgccaggattacagatgtgagccactgcgctcagcctagaaactatttatttttgagacagagtctccctctgtcgcccaggctggagctcaatggtgcaatggcgcgatctcagctcactgcaacctccgcctcccaggttcaagtgattctattgcctcagcctcttgaaactattttattgacacaagactaatacattaaactcaacctctggagagaaataagtgtaagttaaaaagcagtccaaatcagtaaagttatttggttttagaagtatggaaacatctattatctttccttttttccctttatttcttccacagggcctgtaatataacttaggatttctgcaggaaacagatggcacactccatttagaataattcaaggagggcttcataaagggactacatgcagagtatatggaatccttagacagtgcagttagtactctggggcttagagctgtttctacctctaggcccaaagggatgaggggaagtaccagaacctgaaagaagccggtcagctagagagggctgtcttgacaggtagtgaccctaagttgaaagacagccggctgggtgcggtggctcacgcttgtaatcccagcactttgggagactgaagtaggtggatcacctgaggtctggagttcgagaccaacctggccaacatggtgaaaccccatctctactaaaaacacaaaaattagctgggcatggtggcacacacctgtaatcccagctactcgggagtctgaggcagaagaatcgcttgaactagggaggtggaagttgcagtaagccaagatcatgccattacactccagcctgggcaacaagagctaaactccatctcaaaaaaaaaaaaaaagacagccagttcctggaaggaagcagggaaaatcaacatgccaatttcacttttcttctgtcttctctcctgcctagtcccttccttccattaaccacagtcacaaggaagctagaaagaatggaaacccacagatgaaatctatacaggtcagcatgacacaacaaagagaagggtagagcgtagatgtggacaggcaaaaggaagatatccagcccaatcaagaaaaacaaaagttttcctggcttttaaacttggctttcagaaaaaaagaggagattaaatacagataaataactggtcatattactctgataatttagtattagatacaaaataaacatcagtcttttttgtagcactgaattaagattctatacttaataccacattttgaagaacttcaggtatgtatattctctgtacaacatgaagcattaatccaattttgttttattgctttttctgattgtattctgagcactttagataagtggggtaaggagagaagtagtaaagtcattagcccaattccctaacaagctcactgtgaccagagcaacaaaagcaaagacatactgtttgtgataaatggaatcaaaacagagaagagtatggatagctgaatgctatggtgatagcctttttaaaagctccaagtatttcttttgctggtagcatcatctttgggtatactatcattttcagtcttacaagctccctatcaatcccttcctctacctcagtggttggcaaactttctataaaaaggtagataaaatatttactaatattttaggcttgtgggccagagactctttttgcaactactcaactcttccactgtagaatagagacaatatgtaaagaaatgagtgtggctgtgttccagtaaaactttatttacaaaaacaagtcacaggctgattttggtggactgcagcacaccaatccctacactagctaccttatccttataatctctttatttttgctcctctacttaatttgctttattacttgtattctttgtaacacccatcaaaaatgccatttctaggctggtagtggtagctcacatctgtaatcccagcattttgggaggccaaggtaggagaatcgcttaaggccaggagtttgagaccatcctgggcaacacggcgagactccatctccacaaaaaataataataattttaaaaagccaggtgtggtggtgcacacctgtagtgagactaaggcaggaggatcacttaagctcgagttcaaaattgcagtgagccagcggcctgggcaaatggagaccctgtctctagaagaaaaaaaaaaaaaagccatttcctatcaccctatatcattttcatgttttacttaaaggctactgtatttagcaaagctgtattttctatctggatatcttcctgattccccttgtttgaaataacaacccagaagaggttatcaagcaaaatatttcacataaccagaaacttaaagacatttagaaaatgactgaaactttttaagattagagggttgaaagaaggactatttgaataaacggtaactttcaatttacctggctccaagttgaggcatctttggtcctatattgaatgttatattttagtattataacactcttaatacttgggttggtccatgtcaattttaagatactagacagttcctctgagttgatcactgataaattatgtggcggattgggcttcactgaaaaataaaataaatcctaaggtttattatgttttccaatttcatatacaaactcaaatatactctttatattgtccttcctttattttacaataatttatccttaccaaatgaactaatttctctgaaaattatgctatgctatataccttataatggaaaaaaaaagatttctaaagaatcttcagttctccttgttaatttacatttgttaatctcttcaggttcatatgtcaaaagacaaatatttatgatatcaaatttttaaaaaagaataaaaatggaacatacatactgtaattacaatggtgtaagatgtttgagaacagaaaacattcaaagtgaaaacagctgttaagtgtggttggattatggatatttttctttttccaaattctatttgatattattgataaaatgacttcataaaaatcactaagataaatgcttgtttctacattaattaaaatctaaaatctacattaattaaaatctaaaaaagtaaaatctaaaaactacattaattaaaatctaaaaatctacattaaaatcttaaaaaatctaaatataaaaactactttaatttgtaaacgactacagtgtcaaataaactctcaaattcaggtttataactacctttatatacaggatcaaaattgatatgatctgatgtaaccttcccaagggcattctctgcttctacccagacttcaatgttgacaaaatacacagtagaataatcaacagtgcatgaggtgggggtgtcacgttttgctttgcaatcagcaaacttgtgtgttgccctaaatacaaaaaattgaagaatcagtcattaaaaacacatctgaaaaaattagagtgaaaaaaattacttgcaaagagtttgatgagacctagattgttgtagcaaactttgcaatataactgctggtcactaacaaaatttcttaaaaataaacctttctttaaaattaactttgatctatatcttaaaacataaaattattttcaaatttgtagtctaaaaatattgtgctttaaaattttatgctccatccccacttactcctctccaaaaattatctatttccttgtgatcccagtgctgttttttctttttcctaaaacagaacccttactgtaccacaaatttctttaagcacaatatgctagaaggtgacaggaggttaggggtaagaatttctattaccccttagcctttagtcttagggctaaaatctcttagcctctttctagtcaaacttaggcaactactttctgatttctatcaccatggaaagtttcaagtaatattactatatttatttacaattatataaattatgcctcaattaaaaatattcatatacaacactgtttttaaaaataggataaaccaaaccccaaattgaaccaaaacaaaaatggttagcctctaaggagaaggaaataaggtagaggattcaggaatagaatatagacttttctgaacaagccttaatactattaatagatttgactttttggattgttttatataattattaagaaaaattcctaaaaattaaaagcaaaatgaaacatatgaacttgtgtactgagtatgtagtataaccacatagaaaagaactattccaagtaacattaaaacacagtaatctgactattacacatccttcacagagaaaaacaatcttaaaatcattcttggtaatcattttgttggtgctaatactgttgttattattctgcagctgctgtattaaccgtaggataaagcaaatgaataattatgttagtgttgttgtcaactatgtttttcagttcataagaaagaagatgtagacgtcaggtaaatataattatgtaaaaacctatagccctaattttaaactgaaaatatcagtatgaatttgtatttttaaaagatagtattatatctcaaaccacaaaacatgtcctagctctttcgactgaaaaaatctaaaaaatctaaaaactatgacaaaccagtagtgatgaattcctgtagcacccagattgtagtctgtaaatattatttcacactaaatgaaaccagagagttttgggaaaaggttgattccaggtctgggtgaggaaatacatgatgaccctgtaaaagcatgttatatcagagagctatcaaaggctaaggaagttgtgtcaagacgatgaatgagccgggcggggtggtgggtgcctataatcccagccactcgggaggcagtgagccgagatcacgccacttcactacagcctggtcaaaagagcaaaactctgtctcaaaaaaaaaaaaaaaaaaggatgaatgagccaatttgagtaaactgccactgatcaaagatgggacaatccataatgagttaaaacatatcaaatatgtttaaatataaatttataatgagaaagaaaagccctcattattctacctttggaggatactagggaatcaactaattataaaactggtaattaaggaaaaatattaaacctatcttgcttctcctatctgaactgtacttcagggtaaaccacagttgataaaggcaagtttttctttaagtatttcagctaaaacaaaacacagaataccatagttttgtaatttatatacaaattataatcactgatgactgctcaaagctgtaagggaaatactagtgggaaaacaacatgattaaatttcggaaacattctgttgagttataaaacttttcacagaagagtatatactatataatcccatttatatgagacattctgtaacaggaaaaaataatctatggtgaagaatatcagacaggtagttgctcatggggtggggcacttgctgggattgactgaaggagcaggaaggaactttttaggtgtgttagtcatgttctatgtcttgatactgattgagttacacaggtgtctgtacttgtcaaaactcactgaatgatacactaagatttgtgttttcactatatgtaaattttatttaaaaacataatactgaactctagttcatgtaaatactgaagtgattaagaatgaggtatattaatgactgtaactcactatgaaatactgaagtgattaagggtgaggtatattaatgactgcaactcactatgaaatacataaaaaagagatagattgagagatggagagaaggatgcatagataaataggtgataaagcaaagatagtaaaatgttaattgtagaatctagggtatgcaagagtgttcactgtaaaactctttcaacttttctgtttggaaaaaacaaatgggaaacttagtaaataaaggaataaggctgacaacacccgaaaccactgctcaatcttagtatcagaaaaaagaaaaacagtgaaacattatctggtctttcctgacagaagtacacatcactcctacaaaatatttttttggggaaaaaaaaaaaatcaaacccaaatctgatgaaatctgtagatctaaaagcaattttttggaaagaaaaagacaagggggccaggcgcggtggccacgtctatcatctaagcactctgggaggcagaggcagccagatcacgaggtcaggagttcaagaccagcctgaccaacatggtgaaaccctctctattaaaaatagaaaaaaattagctgggcatggtggcacatgcctgtaatcccagctactcaggaggctgaggcaggagaattgcttgaacctgggaagcggaggttgcagtgagcagagatcatgccactgtactccagcctaggtgacagagcaagactccatctcaaaaaaaaaaaaaaaaaaaaaaaaaaaaaaaaaaagacaagggaatatgttaaacaatgtacaatgtataacagtttaacaactgaaatgtaagaaaaaagaacaaatagaacctataatttaagagacaagacataaattcacaaagtatggagcttattcgaatcttgactgaaacaaatgtaaaaaaaattatacatataggcatattcatgagacataggggaaatcaacactaactgaaaatgtaatattttatatctgagtgtaacagtggtatgttgttatgcttttttttaaaatgtcctcatcttttagagacgcatactgaaatatctttggatgaaatatgatgcccgcgattctctcttcaagacaatataggcaaagagtacctttgaaataagactggtcatgagctgaccagtgttgaagctgagtgatgggtatgtatgggtattctactattctttctacttttattttttatttatttattttttttgagatggagtctcactctgttacccaggctggagtgtagtggtgcaatccgggctcactgcaacctccgcctcctggatttaagtgattctcctgcctcaacctccgagtcactgggattacaggcacccgccaccatgcctggctaatttttgtagttttggtagagacagggttttgctctggttggccaggctggtctcgaactcctgacctcaagttatctgcccacctcagcctccgtaagtgctggagttacaggcatgggccgccgcgcctgggggattacaggcatgagccaccgcgcctggcctctacttttacatatatttgaaatgttacagaataaaaaattaaatgttttaaaatagcatttaatattattacttggtaaaataaaaattccagcaaaaatgactaactttaataaatctaacatgaaacaaatttaaaataacgtaccattcagattttaaagtgaagtttgtctccaagtgtgtttcccttccaccatcccactcacacctcattttcttcccctcgttcacaatgcaactcaaatttttaggtttttctggaggcactaaaagggattaattagcatctttcagaaagctttatatccacaaatattatgcaatttatatactacccaaggcatttgcgatctaaattagatgaaaaaaatcaaacccaagcaaaaagtatggacacaatgaaaggctgatgacaatttcttttctatcccaactcttacacttcttttcaggaagtaatatatatacatccatcctaactgtcatcaactggtttgtttcacattaattttctatgtaaaatcaactttcatttataactggaaaaaaatatcaactgatttctccattaagtatatttttaaaagtaatatatacatatgtttgtaagaggcaactaagtagaagccaaaatgattcatttatatttctcttcttattgctttcccaaactcgttggaagaaaagcaaatgccaaaacagtaaagtctgggtgatccacaaattagataacccacttttggatcatagtaagtttattttgtttactttgttactccaaggccaggcacagtggctcacgcctgtaatcccagcagtttgggagcccgaggcaagtggatcacctgaggtcaggagtttgagaccagcctggccaacatggcgaaaccccatttctactaaaaatatgaaaaattagccgggcgtggtggctcatgcctgtagtcccagctacttgggaggctgaggcaggaggattgcttgaacccgggagggcagtgagctgagatgatgccactgcactccagcctgggtgacagagcgagactctgtcaccaaaaaaaaaaaaaggatttactccagtatttgttcgctttcttcaggtagctgctttacacgtgcattttctcagcaattaagggatactgagaattaccatcattatgtcaattcaacaatactttcctgtggtggggggggtctcatgtcaaatatttctctagtaaagtgaaactgcttgactttcaggaaagacaggagacttgtggttcctacttctaagcttattttttaaaaaccaaacatgtccaagtcactaagtccacaagttactacattttataaagatgaaaggacaacattaaaaatgcagttcaatagtcatgacaaagtctgaaataagacaaaaacaaaacttacagcctgaaattattgtgattccataaacattctgttcaagctgtccgaatgtaagaatgttgcaagtgagctgaatatttaatgaagctatatctgtaaaggtgacactggatgctgttctgtttatgatagtatattgctccttaggaatagtaaaatggtttgttttccagacaatgtaattagcatttacatgaaaataatccatacatttttcctttagcacacaaactgcagtgaaattagaatgaagttgtacaactggagattcaggactgatataaccacatggatctagaagttcacctaaaaaggaacaatagaaaatatataaatggactgaatttttctggtacaaaatgatatctagctggtagcactcaatgtagagtccctcaaccgtcactaaaatatccctaaagacacagaaaaagacaatacacaactgaaaattaatatggttagaatttaatgcctgaatttgtaaagaaatatacaaattataaagataatagagctgaattaagaaaaacccattcatgctttatagcccatggtataaactatttctttaagaaacacagactgcctgcagcatgattcatacttgccccacaacgtatcctgtccctccatttagatcccaggtctaaactaaactctccagaaaacaggcagtggtggtctcctctacagtcctgaatgctgttgtggagtacagttggggtcacagacagtatacattgtccacacatcaaaactcagacaacaaaggaaacagcaagggaccaatacaaaacaggaagaatagaacaagatggccaaatagtttagttttaagaataaatgcatggccctgggtatgatggtttgcgtctataatctcagcacttttgggaggccgaggcaagaggatcgctcgagctcaggagtttgaaaccagcttgggcaacatagggagatgccatctgtactaaaaacaaaaaaaattagccgagcatggtggtgcacgcctatagtcccagctattcgggaggctgaagtgggatgatggcttgagcccaaggggtcaaggatgtagtaagccactgcactccaccctggacaacagagtgaaaataaatgcatgggataggatcccctatttaaaaacaaagaatcagcctaaccaacatgctaaaacccagtctctactaaaaatacaaaaattagctgggtgtcatggtgggcacctgtaatcccagctgcttgggaggctgaggcatgagaatcacctgaacccaggaagtggaggttgcagtgagatcacgccactgcactccagcttgggagacagagtgagacagagtctcaaaaaacaaaacaaaacaaaacaaacaaaacaaaacacaaagaatcagattgggtaaaagagaattaaacacaactacatgctttacctatcacctactccacattgatgacatctcaatccctatctctagcactaaacccccatgctttcaatagcccattagacatatatctacctgagatatcccatagctatttttaaatgagcatgtccaaaactattatgtatcataatcttttcaaacttattattttttattcttatttctctgcctctgctaacagcaccactcccatccagacatccaggacagatactctgtagtcatcttccaacatctccaattagcctcctctaacctccaacttaacaatagtgcactgtattggttctatatgcttaataagcatatcaacatcttctttccaatgctactttgactgctgaagcacaggatactatatcagtctgacctccttccagtttatcttacatactactgtcagttactgttctaaaataattaggacatttgtctactttaaattatttagtggctacctactaccaagataaaagtcccaactatttgacatgattttattctttttctctagcttcaatgtccacaattttaaggtggctttcctcaatgaatcctatttgctgtggggttcctgggtagttacccatgaagtgtttttgagattaaaaattactagcctgggcaacatggcaaaaccccatctctacaaaaaaaatataaatattagccaggcatggtggcacacgcctgtagtcccagctacttgggggtgagggtcgtgtgctgaggcaggaggattgcttgagcccaagaggtcaaggctgcagtgagcccagaaaaaattaaaaacagtttttgcagtcaaaattgtatccccaaatggaatcccaggacctctcacaaagcctgtaaaacccagagctggaatgtgtatttctttgtttcaaacttataatgtggtctgtttatatcatcttgctgttatttataaatgcctactgtaaatcttagtgcatatattactctcaatttccaatagcatggtccttcatccagtggagaatctctactaagttactctctgatactgggtcagaccttacaattccctagacatcactttattctttggcaaaatcacttgttatactttctctaaagtaatcatagggatgttaaatatgaaatatactctagagttctaaaaagatataattagagactcagtatgaataatttttaatcacacagaataagagaaatattaaaaatgggcaaatgggctgggcgcagtggctcacacctgtaatcccagcactttgggaggccgaggtgggtggatcacgaggtcaggagatcaaggccatcgtggctaacatagtgaaaccctgtctctactaaaaatacaaaaaattagccgggcgtggtggcgggcgcctgtagtcccagctacttgggaggctgaggcaggagaatggtgtgaacccaggaggcggagcttgcagtgagccaagatcacaccactgcactccagcctgagcgacagagtgagattcagtctcgaaaaaaaaggggcaaatgttccgtttttcaaagtgagacacagcttcaataataccatcccatgtcaaattaatcccattttacagggctaccaggctgagattaaattgtaaaaagaaagtattttaattaagaaaggtatctgataaagttattttgaatgtttatagggcaagatgaagaaatgtgaattagaatacactataactgggttggacgcagtgactcacgtctgtaatcccagcactttgggaggccgaggtggatggatcacctgagatgaggagttctagaccagcctgaccaacatggtgaaatcccgtctctactaaaaatacaaaaattacccgggcgtggtgacctgcacctgtaattccagctactcaggaggctgaggcaggagaattgcttgaacctggggggcagaggttgcagtgagctgagattgtgccactgcactccagcctaggcaacgaaacgagattccatctcaaaaaaaaagaaaaaaagcaaaaaaaaaaagaatatactataaccgatattacaatgaacattatgaaattgctgatattttgctacttttataggttcatactcaaatttatatttgattacccatatataaaaaaactgacttaagaaaaaagtcaattagaggatagtcttaagtagaatatgctgaagtgcatgccctcaatccttggagaagactgtattttaagaatggccacacctacatatttatcccatcccacgtttttcttacgatgtcacgcatactcttttcatgaagaggtggggactgcatttcccccaaccacatcagatctgtatgggtgccttgtgtccactccagccaatggagtgtgctatgagacttcagaggctagatcattaaaagaatacagactccaattagctttctttctctctcccgggatatctgcccttagaacccagccacacattgtaagaaagccagggccataaaaagaggccacgtatggtgttttggacaatggccccagcaaagccctcagcctgcagataccattaacaacagacatataagcgaaggagtctgaagatgactccagcccccagtctgaatattgcagctgaggccccagacattgtacagcaaagatgaatacgtctgattgtgcctgcctatctatagtcttgtcctatacaaatcatgagaggtattattatcattttaagccttgaagatttggagtatttgtgaggcagcaacaggtagctaatgcagtcctgttattttcaacattttaatcaacaacttgggaaaagacagacacacatgcttatcaaattagcagaggacaggactacaaacaactgccaacacttcggatgaaaatgttgggatttaaaattatgctgaaagagtagaacaccaggctaaaactgataaaatgaaattagcaacagaggaaatatatcctatttaggtaataagaaatatacattgggtgagggagaactagtttaagagtaactcatgtaaaaaccacctgagaattttcactgatcactagctcaacatgaaacaagggtatatctcagctaccacatagttacgtaactttataaaaatgatgttcagatcaaagtaagtatgagtgccactgtagtcagattggttttggtatattacgtttatttttttcataaagaaacttttattcaaagacaacaataacctttataataaatatgcagtaactatcatttttataatgcttactgtaggccaaacactgtccaaatatttcctctatattaacttatttttggttgttttttgagatagggtctcagtctgccaccctaggctggagtgcagtggcacaatctccacacaccgcaacctttgcctcccgggttcaagtgactctcccacctcagcctcccaagtagctgagactttcaggcatgtgctaccaagctcagatttttttttttggaaacagggtttcactctgtcacccagactggagtgcagtggtgcaatcttggctcactgcaacctccgcctcccaggctcaagcgattctcctgcctcagcctcctgagtagtggggattacaggcgtgcggcactaccgcctggctaatttttgtatttttagtagatacggggttttaccatgttggccaggctagtcttgaactcctaacctcaaatgatccacccatctcggcctcccaaagtgcttggattactggcatgagccaccatgcctggcctctatattaacttctttaatcctcactaataaccctaggaggtagtggcctttattatcaccatttcatagatcaggaaattgaggtacagaaaatgactgaccaaggtcctacagctagtaagggggacagctgggatagtattattcatacacacacacacacacacatacacacacacacacacacacacacacgtacacataaatatttttacgagacagggtcttgctctgttacccaggatagagtgcaatggcgtgaccatggctcactgtgacctcgaggtccagggctcatgattctcctggctcagcctcctgagtagttgggactagaggcatgatatggtttgaatctgtgtccccacccaaatctcatgtcgtatcataatccccagtgttggaggtggggcctggtggagaggtgattaaatcataggggtggatttctcacttggtactgcctcgagatggtggatgaggaatgagttattgtgagctctggtcatttaaaagtttgtagcaccttccctttctctctctcttcctcctgttctcgctatgtgagatgcctcactccccctttgtcttctgccatgactggaaacttcccaaagcctccccagaagcagatgccaccatgcttccgcacagcctacagaactgtgaatcaattaaaccttttctttataaattacccagtctcaggtatttctttatagcagtgtgagaatggactaatacttggctaattaaaaaaaaaaattgtagagatggggccttgctttgttgcccagactgaattcctggactcaagttattttcctgcctatgcctcccaaggttctgggattacaggtgtgagccaccatgtccagccagtattctattttaaatgtaatacaggcaactaagagaagaatcagtagggtaatcagcatgcacagggttaaaaaccagatcctatagaatgattagatatctgggtaactgtaatttggggacaaggacttacagacacaggaaagcagcccttcaatacctgaagagcatgtagtatgaatgacgtaaaatttaacaagatttaacaaattttctcctattcatttactgaagaaaaaaaaaaaaacccacacacttctttccttccccattttaaagttattgttagtattgatatacagcatttaagattactgacttaaattactgacttagcatgtaagatgactgttacaactcaaattatacaaaaacagattatcaagaatatttttattaaaatcaatttaagatattattctctcgattatcctagaaagaatatatgaacataataattaaacataagcttaattatataataatataaaaatatataaacctaatttgtgaagttagaagatagggtatttcatgaaccttacctgtagattcagtggtgaggaaaataaacaaggcttgcactagccaagtctgcaacgtcaacatcttgcgcggatatttctgcaacagacacatgtaatattacttttaatattttttctcttatatacacataatttaagacacaatcttgtttccatgctgtagctgtgtttctaaaaggtggtaaaattcttatgagaatgtagaaaacttaagtcttcacattatttttctttattcccactgaagttatggctatggaaaacactgctagaaaacataatttatactttaaggttaattaaaagagatatcttgtttctttcttatgtgaagtcttatattagtaaataactgtgagattaagaacttcagactgacaaatttctacatggcaaaactcaccataatatgtatccttaaaagatacctgacaaatggaaaaaaatgtttgtaattcatagcatggccaaaaattttcccgatatataaagaatgcctacaaatcactaaaaaattctaacacctaatagaacaggcaaacatatttgaatagtttatagaaaaggaaatacaagtaaatcaagcatgtgaaaagatactttcaacctcactcaaaatgagagatataaattagaactactcagataggaacgcaaaatgatacagacactctggtaaacaatttgatagttcgttaccaagttaaaagcacaccataagacttggtatttccactccaaagagcgtactccccaaaataaaaacatatgcccacaataagacttatactcaaatgttcacagcagcttcattcataagtcccaaactggaaacaatccaaatgtccaccaactgctgaatgtataaacatacattcaaacaatggtagagacatataatagaatactactcagcaaacaaaaaaaaaagagtatgaactggtgatacatgcagtagtatgaatgaatctcaaaagcattacactgaataaacgaagccagacacaacaggttatacattgtataactctatttacaggaaattctttttttttttaagagatgggggtctcactatgttgcccaggctgtctcaaactcctgggctcgagcaatcctcctgcctcagcctcccaaagcactgggattacaggcatgtgcctcagaaattcttgatacggcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggccgaggtgggcagatcacttgaggtcaggagttcgagacgagcctggccaacatggtgaaaccccatctctattaaaaatacaaaaagtagcttggcgtggtggcgggtgtctgtgatgccagctactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggcttgaggcaggagagctgtttgaacccggaaggcaggggctgcagtgagctgagatggcaccactgcactccagcctgggcaacaaagcgaaattctatttaaaaaaaaaaaaagactacatttgtcaaaattcactgaattctgtgtcaactgtttcaaaggcactgagattttaccttactttcaagctaacaagtcagcctaccacagtgtcatggatactggcaaaaggcatgacatttttgcgtcagaagcaaaggactgtattactcataacagtagtcagagtatcagcattttcttgcgccagctgcttgagtcccaactgtcacagggcattgtgaagtcagatgacacctgaacaggctgcttcacaggaaagaaagacagatcttaagtaaccctaaacttgaaaaatatgcaggaagcatgtctgccatttactctagagggagacattatctgtatctttgaagactgtaagtaagcctgtcctttgctccacggctctgagagtctaccttccaacattctttaaaaggtaagttggctgggcatggtggctcacgcctataatcccagcactttgggaggctgaggcgagtgaatcatgaggtcaggagttcaagaccagcctgaccaacatggtgaaaccctgtccctaataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaacgcagaaatgttagactcatgggtttcctatcaagttgtaactaaaaaatggtgaattttattgtttataaattagaccttaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaatctcatatataatacagaatgaaagaaatcagacaggttgggtgcagtggcccacacctgtcatatcagcactttgggaggctgagggggaagaattgcttgaggccaggagttaagaggccagcctgcacaaaatagtgagaccctgactctacaaaaaaattttaaaagagaaaaaaggcaagaaagtacgctctgcatgatttattttacagaagttcaaaaagaggcaaaagtctacggtgtttggtgacagaggtcagagcagttgttttttgtgaggaagggtataaaaggggacattctgggtgctgagcatgttctgtatcttgatctggacagtgataaattcactgagctgtacacttatgagttctgttttgcagtatgtaacaaaaggtaaacaaaccaaaaattatcccaataccattcttacatattagtgttggcaaaaatataaaaacccaaaaagtatcaacagggtgttgtgagactaagcaacgaaagtatcgtcacacactacaggttatagtgtaaattggcataagcttcccaatacattgaacactttaaaaatggtcagttttgttgtttgtaaattagacctcacttaaaaacaaagaaaaaagctctacccaaacaaggcagagagccagttcggcaatatcaatcaaaattaaaacacacacatttgattctaatgattctactttattttatcctacagatatgaataaaacaacacatgtacaaagttattcactgcattgtttttaacagtaaaaggctgaaacaacctgattatgatgggacactagttaaatgatggtataccaaaaccatgtaaatgtaaatacttgtagccatttaaaaaaaatgaggaagctctatatgtacagaaacataaagttatctaaaatacattgttacattgttaaggtacagaacaacgcatttgctattatttgtgggcaaaacaatatacaagaaaacaaaacacacattcgtttttttatatatgcacagtatctctaggaggataaaagttcaaatactggctgtgacagggtatttgagagatcagggtggtagggagacgctccaccatatactctgcagccttgcaatgttgaccatgtgaatctttagtacttatgcaaaaaataaatttaaattaaaaaatacttaatgtcagctaggtgcagtggctcacgcctgtaatcccagcactcagggaggccgaggtgggtggatcatctgaggtcaggagttccagaccagcctggcctacatggtgaaaccccgtccatactaaaaatacaaaaagtagctgggcgtggtggtgggcacctgtaatcccagctacttgggaggctgaggcaggagaatcacttgaacccgggaggcggaggttgcagtgaacggagatggcgccactgcactccaggctgggcgacagagtgaaactccgtctcaaaaaataaataaaataaataaatacttaaggttcaaactattgggtactatgctcaccaactgggtgacagttcaatcgtactccaaacctcagcatcacacaatatactcatgtaacctgtacatgaactccctgaacctaaaataaaagctaaaattattaaagacaaaatacttaatgtgtaatttttttcttctaaataaaactattaactcttcttgatgagaaatggcttcctagttctgcacttggaacacaatattgttttattaaatatacatactaacttgattttatgcactccctaatcatgtaacagcttgccagcatgcccagctaattttttaaaaatttttctgtaaagatgggggtctcactatgttgcacaggcaggtcccaaactcctggtctgaagcaatcctccttctttggccacccaaagtgctggaattacaggtgtgagccactgtgccaagccaaatgtactatattcttgcaacaaagctgctccagaacaagaggtccatgaaagaatttatgattacttcaaagcaattagatttgtttgagtagtaccatggaacacaagcaaagcgaactaggcaaaggtagattccacatttcacatttagaaagtaatctttcctaatttttaaaagattgtaatggagaggtgatgaagaaacatctattatgggacttgatttcatagtccaaatctaagagatgaagacacagtaacactatataaaatattatatgcaatacagttaacttcacttggggcttgcttaaaaattgacagaattatggccgggtgcggtggctcatgcctgtaatcccagcactttgggaagccaaggcaggcggatgacaaggtcaggagttcaagacgagcctaaccaatatgatgaagccccgtctctaataaaaatacaaaaattagccgggcatggtggcgcacacctatagtcccagctactcaggaggctgaggtaggagaatcacttgaacctgggaggcggaggttgcagcgagccaagatcgtgccattgcactccagcctgggtgacagagcgagactccatctcaaaaaaataaaaaaaaaaattgacagaattgacagtagtttgcttattttttccctcctttccttctgttgatactaatatttaatttaaaattatattaatagcactattacctcacctcttgcagagttttctatgcatatattataaccatacattgcatacactaaccttccttgaaatttgcaggtaacttgagaagcttctatgaagccaaaacctaactagtaaccataaatacaggaaagattatttctgaaaaccaaaagctgtaatcattcctcaactatggtgatataacatggtagtgtgccgaaaggagctagatgatgtataacaagtattgctacttttaatgttagagaaacaaagttcataaatgatttatttaaaatagaataaattcaagattatccctatagttgttcattctcatttactttcatttccatatgttttctcaagtgagagaaaaagcagtagagttacaatggataaatatttaatggttaggctctttataaattatttttgtcacctatggattgtgatttttttttcattttctaacttaacctaaggatgaaataaaaagcacgaatatatttagatttacattgcatgtgaaaaagaatgtcaatataaactttgttactatggtaacattactattacaattgtagaacagtatatgaactaaaattgccaaatagaaggcaaaataatgcttgttgaattaataagttgcgtggggatcaagatgaagaaaatttctatatatctttcacagtacagtgttactgtgaataaactgccagaagttggtaatacctacacaaaattaactaattattaaattagtttttaaattatccactctgttctcttccattagtatcaattatgagttcataacaattaacactaggatattattttacattacacaaaatgttgtcacataaattatttcactttagtctcctaatatcctaaagaatcaggtgagtagggcagggattatttattggaactttgtaaaataaaaaaacaaaaaattcagacaagatcaattacttacccaaatcacaaaattagtaagtgaaggagtagggatttgaagctaagtcttctacttctaaatgtcatgctttttccattgggtttcactgtaaagagaggagagtcttgttcagaaggctggctttgataattttattatatgtgtactttaaaaatccccatctgctcttaggcttttgggtttgcagaaagtatcctactttagatatgttctgagcttcagaataaaataaacccataaacacttgtataagagtattcaaatattctagtgctttttttttttttttttgagacaatgtctcactcccatcaccaggctgcagtgcagtagcacaattacagctcactgcagcttgaacttcccaggctcaggtaattctcccacctcagcctcccgagtagctgggactagagatggcaccatcatgcctagctaatttttttatttttagtacagatagtgttttgccatgttgcccaggctgagctcaaagggatctgcccacctcagactcccaaagtgttgggattacaggcatgagccaccgcgcccagccctagtgctatgatttgatatacgcttgcaaacattattggctcacccacacctaatgcaaacttccctgacgtctatgtaatgtcacagaaacatgacaggaacatttatgacagacggagttctttaacaatcacatatttcttcttctactagcactaaattaagcctgctaacaactattctatgtaaccagagataaaaatccattttaagatttgttcacttaaattctagcttaagtactagtgctcctctttgaaatacaacaagtaacttcaaacttaggcaaggagttgaatcttccattattgtttcatacacattaagcctttgatataacttaataacacataaggaattaaatttataaaaatattttttaaatgtctaatgaaaagaaactgaaaaaatgccatgtgaaagtgcactataatcccaccaagagataactaccatgaacattttggtggatattcttgcaaaattttttatacatgtattatataactttacattgtataaatatacacacttttctattttacaaagatgggatcatgtaagtgagaaatgttttataacctttttcacttaacactacatagtggacatcttcataagttaatatatagagagtaattccttgtagcctttgctcaaattcacctcctcatagagatcttccctaaccaccctgtgtttcttatacccctttactgattttttttttttctacaacacttaacaccttctaaaataggctagcaaacattttctgtaaagggccagataataaatattttagatttcgtgggctttaagttctctcttgcaattagttaactccgttattaaagtgcaaaagcagccatacacaatatgtaaataagtgggcataggtatattcccatgcaactttatttataaaaatggctgcaagctggatttggcttatgggctatagtttgccaacccctgttctaaatacaatataattaaattaattttctttttgtttgttatgggctgaactgttccccccaaaaaatatgttgaagtcttaaccccagtagcacaaaatgttactctatgggcagatttaattggatgttatagtggagtataataggcctttagtacaatatgactggtgtctttaaagagacagagccaggaagaataccatgtgaatacacaggcagagattggagttatgcagctgtaagctaaggaatctcaacgacgatggctaccaccagaagctaggagaggcaaaggaagattctatccaaagtctcaaaaggacttctagcctccaaaaccttgagagaataaatttgttgttttgagccacccaatttgtggtacaggttgaacatcccaaatctaaaaactgaaatgctctaattccaaaacgttttgagctctggcattttggatttcagattttaggatttgggatgcttaactttaagtatataatgcaaatacaacacaaactgaaaaaaaaaaatccaaaatccaatatacttctgttactaagtatttcaggtaagggatactgtaacaaagggatgctctattacagtagcccctaggaaactaacacatagtgtgtgtccccaaaatagaaggtaagtgaagagtggaatggctaggccctacggcaggtgtgtgcttggctatatcttctttgatgatgtgtctgttcaaacatattgatcaactgggtttcctgttttctcattaagttttgaaagttctaagaagatattctggcctttattagaaaatggatttacgcattattttcttgtatgcttgtcttttcattcttttaacagtatcttttgacgaataggaggtttaattttaataaagttcaattcatcaatttgtgtttttgatgtatctaagaagtctttgcttaatctaaaatcataaagggcccgacgcagtagctcacacttgtaatcccatcactttgggaggccgaagtgggtagatcacctgagttcagaagttcgagaccagcctgggtatatggtgaaaccctgtctctactaaaatattttaaaaattagccgggtgtggtggtgcacatctgtaatcccagctacacaggaagctgaggcaagagaactgcttgaacccgggaggcagaggaggctgcaagtgagcagagatagcaccactgcactccagcctgggtgacaaaatgagactccttctcaaaaaaaaaaaaatataaaaaataaaaataaagtcaaaaaggttttttcctacaagttttatagttttagggtcatttaggtctcagttatttcaagttaatatttatgtgtggtgtcaagctgaaatttgagttcattttgtatatacggataattgtttcaaaactatttgctgaaaaaattatcctttctcaagtgaattgcctttgcgtctttcttaaaaatcagttgttcacaggtgtgggtctatttggctactctcaattccagggtgggcaagcttttcatgtatgaggtaggaggtaaatattctaggtttgtgagccataaggtctctattggagctaccaatctactgttacgacacaaaagcaaccatagaaaatacataaacaaacaggggtggctgtgttctaacagtactttatgaaaacagaaggtaggatgactcctactctatttgttccactgatcaatttgcttatttatatgctaccaccacactgtcgtgatgactttagccttataaatcttgaaatcaatattctgtgtgcacttaaaaagcactgctgctgctggtagagtgttacataaatggtcattacgtgaatttggttgatagtgttcaaatcttccatatccttactgattttctgactactacttctatcattgttcaaaaagggatattgaaatccctgaatataactgtggatttacttctccttgcagtttttaccctgttgtgttttgaaactatgttatttggtagatccttttgataaattgacccttttatcattaggaaatgcccttctttaccactggtaacattctctgaaatctactttgatattactatagccaattctgtcttactttgattagtgttatcatgacatatcctctcccattcttttttgtttaatctgtatgtttcttcatatttaagtggcatctttagggggtaggcagcatgtggttgtatccaatctgataatctctgctttccaattgggtgttcagaccatttacatttaatataatttgtgatatgattaggtttaaagctatcagcttcatatttgttttcttcttgactgttctttgttcctgtttacttttctgcatttatttttcttaattattttttattctcttttccttgttagctaataagctataattctttgttttcttattggttgctttaggtttatagtgtacatctttaacttttcacaatctatcttcaagtaatattatgtcacctcaggcatagtatataatagtatacttccatttctccccccagacctttgtgctattttagcatatattttacttttgcatatattaaaacttcacattggtagctcccacctgaaatcccatcactctgggaggccaaggcaggaggatcacttaagcccagaagtttaagatcaggttgggcaatatagtaagactctcgcctctacaaaaaataaaaagttagacagctgtggtggtgcatgcctgttgtcccagctactcaggaggctgaggtgagaggactgcttgagccttggaggtcgaggctgcagtgagttgtggttgcactactgcattccagcctgggtgacagagtgagactggcacatatttactcgtgtggttaccatttctagagcttttaattcctttgtatagatccgtatttccatctggtatcattttccttgggcctgaaaaactgcctttaacatttttttgtagtatggttagagaaaagtctaaatagatttgaaaacaaaaccaaagtgtgaatgctaacaagtatttagcctaaaataagcacagttcaaaatgagaaaagatactgctaattactatattaacagaccaaaggaaaatgacagggtcattccaacagatgtttgaaaagcatctgataacattcaacaactgttcatctaaaacttaaaaataacaacaaagtgtcagaaaactaagactgaaagagaccatccttaccttggtgaaggataacaaagatgatacagggactctagaaccagattgcttgtgttcaaatttcagtccctatattttaacatcttaggcaagtttttaaatagccttcacttttacttcctttatctgtaaacatggggtaccaccaccacctacccatctaggaatgttatgatgattaaataactcattatacataaagtgcttagaatcatttggctcattgtaactactcaataaaaggttaacagctgttattattagtgcagctcttgctgttgctgccacaggtactactataagaaacctacaaggccaggcatggtggcttacgcctgtaatcccagcactttgggaggccgaggcaggtggatcacaaggtcaggagtttgagaccagcctggccaatatggtgaaacgctgtctctactaaaaatatgaaaattagctggtcgtggtggtgggcacctatagtcccagctacttgggaggctgaggcagaagaattgctcgaacccgggaggcagaggttgcagtgagccgagaatgcaccactgcactccagcctgggcgacagagtgaggctctgcctccaaaaaaaaaaaaaaaaggaagaaagaaacctataataagcatctataggtttaaaggtaaaaattagaagcgttcctattaatgtcaagattcagacaagatgcttgaagtcatcagttattcaccactgctctaaagggcttaagcaaaaatataataaataagatctaaaaatggaaaataaattgtgaatgatatgatcatctatcaagaaagagtgagaatcacatgacaaactattaggactattgagaatttaacacagtagtcaaacaaaacatcatcaaaaaataataggactatttagagtttaacataacagtcaaacaaaacatcatcaaaaaatagctctccagctggcgcggtggctcacgcctataatcccagcactttgggaggccgagataggcagatcacctgaggttgggagttcgagaccagcctgaccaacatagagaaaccctgtctctaataacaatacaaaattagccgggagtggtggcgcacacctgtaatctcagctacttgggaggctgaggcaggagaatcacttgaacccagtaggcggaggttgcagtgagccgggatgtcgccactgcactccagcccaggcaacaagagcaaaactccatctccaaaaaaaaaaaaaaaagctctcctacataccagtaataactaattagaaaatgtaacagaaggctgggtgcagtggctcacggctgtaatcccagcactttgggaggccgaggtaggtagattgcttgagcccaggagttcaagaccagcctaagcaacatggcaaaaccccatctctataaaaaataaaaaaaaaataaaaaaaaaaatcagccgggcatggtggaccatgcctgtaatcccagctactcaggaagctgaggtgggacaaccacttgagcctgggcttatagaggctgcagcaagctaagaagccaagatcttgccattgtactccagcctgggtaacagtgcgaggctctgtctcaaaaaaaaaaaaagtctcgcagaaaaaaaaaaaaagggcagtctaaaggtaaagtaaacatagcactgattggcaaatgaatagacaactaaatcaatggtacaaaacaaaacacactcaagtgtatataagaatttagtatctgattttttaaaaggttgctcatttgctgggaaaataaaggactattcaataaatagtattgggacaactggctccataagcaaaaaagaaaaaaaagaaccccatttcatcagacaaaaagacacacactcatgcacgtgcacatgcatgtataagcatacactctctctccagattaaggacctaaatgcaaaagcaaaattataagcatattgaaaaacacatagaatatgcttatgaccttagggccttttaaaattagactattttagccaaatgaaaaggtttacagagcactttgatgaacatccatgttctcaccattgcttaagaaataaaagctcaagcttttattcaatttttattccgttacaaacataattgaagccatataaatagttcttgcctttaagaagtccaaagtttagagatgcagaatatgcacaaagtgccacaggagcacagaaaatacccaattcagacaggggccaggagcgcccagtcttaaaataagggtaggggttcctagatagagaaaatagcacacatatgaactctacatcatctttgactctaattgtcaagtgaagattaccaatgacaaaatcccagagcatgccagtctaaccagagctatgctatctgaaacatagctctgattaactcactttgcactagggggtggggttgggggtaatacataaaacagaacatccaaacaaaaaaagactgagcagatcaatcaaccttagagcaaagggtgaagctgattgcttaaaagaaaatgaaactttggaggcagaacattccaaatgtaacagggcaacagatttacagtgctgaaaggaatgaatctcctgctctggatatgtatacacacagctttaaaacaatcatctatatactatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatatcctggtttctatgtaaccagataatgtagttgaattctttcctttatcctctttcttgtctcctttactgaattctctgctagcttttatctccaggctatgaaggtacccaaagataaagtactgggcatcgacttttctttttaaataccaacttctttgaagacatgacttcaactactaccttcaaacaaaataatttcaagaattttggcttggatctttcttttaattccagttacatttcatcttcttagatattctgtctctgagtcttatcaatttaagaggtctaaaaacaatacaccataggtacatgctcatgaacacatatacacataaatgcccacccactttttttgtttattatactttaagttctagggtacatgtgcacaacatgcaggttacatatgatacatgtgccatgttggtgtgctgcacccgttaactagtcatttacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggacatttgaattggttccaagtctttgctattgtgaatagtgctgcaataaacatacgtgtgcatgtatgtctttatagcagcatgatttataatcctttgggtatatgcccagtaatgggatgaatgcccacacactttttaaaaagtcacaaggacttaccatttttccctatctacaaacaactcatcctcttcaactgcctaagtcaatggagtccatcgtttctctcatctatgcagtacattttagcttttctcagttacaaatcttatcctgtcttctctcccataatatctttcccacccatctcttctttttactctctaccacaaactaacctaatttggacattgatcacctcaataatttcaactgtgttcctgcttccagtctctttcctccccaccaagcattctgaacattgttggtggatcactctctctacaacacaactttaaacctgtcattcttctcctcaacagctttttaaagggtgaataataatgccaaatattctaactatttaagaacctaaaattttggctttgatgtgcctatccaatctatcttttccaatactcaagtttctctattctaaaaaaaaaaaaaaatcctttcctcagactcctccctcaagctaccttactactatacttctagagagaactgcttgcaattgcaagcaatctggcttttttactccaataatgctgaaattattcttgtagtttccaaactgcaaagcaaatacttaagctcctcattttgcttgaccacaccatgccatttataattcggtcttatctttcatcactccctactaaccatccctgtagactcagcaaaccactagacttcctctaacataccttgttctttcagtctgtgcttctacatatattattccaatgtctttcctgactctgctgtgcactacaaactgcttttgaagtatcatctcttatatggaatttccccccacttcaaacatctttgctgtcagtgtactcttacatcattccctaacaggactcagaacactgcacagtaattgtttcacatatcttgatatcctcagaatctaccatagtttgaggcacctggtggacaattaagggtgggtttttatagactttctggtatgatcttattttctatctactcgctgtcgctcaagcgtactgtatggagacgcaggatgtatcatggttaagaggtcagattctgaagccaggctgtctatgtatgacctttagatctaccacttagctgggcaaattaattaaccttcttgtgcctgggtttccctatgtgtaaaaagaggattttatcctattattattagacctacttcataatattatgaagattaaatgccttaatatgggcaaagtgctcaaaacagcaactggcacaacataagcactaaatatattgcctgttttaattaatagaccttagttactgctgatcctttccacaagctagtcctatattatgttctatattctccattctacattttgtcctccattcgctattattaatgggctgtcttcatttttccctttatccaaatcctacccaggtttcaaggccaacttctggtaaatcctttgctcattccaatccttaaatgctcactccaatccttaaacgatcattccctaattttaatatctacaggattttctgcatcactctgcatttaattaaaactgctttgcatccttgtagtttttttcgtataagtttgtcaatccaattattataaactctttgaaggtcctgattacatctcctgcacctttgtgagttcgtacagcaggtagtaattgcttagtatttgctgtgtaaaataataaagcacaataggaacctcaactctgatcattctgcctttgcaatcaaagaaacggagaagctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagttttcagcgagactcctgtttccttctctataaaggggacattttaacacctacttcacatgtatttaactttcgccctaacactgaactgaagtgcaaagccttggaaacaaatttaaataaattgaaaatactgcaattcacaaataagagtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtcctttttgacactttctccttcctgtaatttttttctttcactcaagattaaaaacaaacgttcaagattatccctaaagagaaatagttggaaagcacaatttaatagcaagttggttctataaatgtaatatttcagttcatagttcaaaaatacttccaaataggaattaacatgaatttaagaaattaacataatggcacacagctaaactgatgatctgagtccgtaatttcaaattaagagttgttccaacttgaagctggcagtcatacacagtttaaagggtttgtttacagcactgtcaaaagcaaataccacaatctttcagaaaattcaccctggcattctaataactagttattttaaggcagtataattgttgaaatacttcacaaactaagccaaaatgcgtttccttctgaaggcaaaaaaaaaaaaaaaaaaaaaaggtgacgtcttatttttaacctgtgattttttttttttttcagtttcggattatgaaataaaatgctgttcatccactgaagaacagacccttgcttcctgcactatcttcaaaagtttaggtcggaggaggtaaaattttaaaaactgatttgttctccttgggatacagtgagatgtggaattcgttaggaatgataattattaatagaaaagatcaaaagaaggaaagaaacgttaatagtgtttataagcattgtgaactttcaacaaagctgaaacgttacgatttcaagatgaaaaaacggctttggggaagggaaatccacctcgagaatgaagacaagtgcggagcgaatagaatttcaggggagatgaaaaggggattgggaaaaacgtgggatctggtaacaaaaaggggggtttgttcttgaagggcgttctgcggggcgggcgttaagaggggtgcgtgcgtgcgcctgggtgaagtttgtactcagggctgcgataatcgaggtgacaaagttgtggaagtagaattcggaggtccgggagcaggaaggggaaggaatgtggggatttccaggctgggctgacaagttccgggcgctgctctcagggggaagggaggtctcctcgagtgccagatagcccgtccgaaaccaccgacactctaactccagctacgcgacccagcacccggcccctcctcacctcaggccgcgccgcctcgaccctccgcgtctccacagcgcacgaaccccttggcgccaggctgggccagacccgtcggcctggcaggcgcggcccccggttcagctgcgccggggcggcccagcgcgactccgcgggccttttggctgctcgccccggctccggaacactgtcagatccttctccgcagaggtagcgcgccaccccagtcccgcggcggggcggggcgctccccaatcccgcccagctgcgcccccggccggccaacgctgcgccccgccccctaccgggacctaggcgctgattggcccctgagagaccctttgcgcccaggcattggtccagtggccgcctgtcgacgagggggcgggactccgaggggtagcgattcccgtaacgcggctcttcgcgtcccggattccggtggctgcgtccgcgtcgcctctcccagactagatcgaagggttccccccacctcccctctgtgggcggaaagagcggaatgttccatttttctgtggaataacggggtcatgaactggagcccgggtgctgcccgccgcccgctgcccccgccctcccttctcgccagggcgcctgcggcctctcttcgcggccttccccgagggactcagagccgcgagggaccgcctagctcccttggggatggggaaggcgtgggagcctcttggggaaagtgaagagctcggtggccgtgactccgcacgagactgcggcagattgtggcggcggcttctctccaagacttacgtaaacgagccttgccacagtacttttttaaattagtaaatgagtttgggtgcgattgatcagtgagccccagaggtggtggcccaccaagcgactagtgtttctttgcggtttgtacctccccgtttatgataaaaaataccgggtaaaaacctattcatcccgcctccgcccccccctttccctcagaaaatggacctcaaggctcatgatgtttgtttctccccaaaggaagatgagaatcttgagttaaaagataaggcatgtgcgtgcgtgcgtgtggggtgtgtgcgtgggtgtctgtaaaagtaaacacccaaaggtagaggtttttgtggaagaatgagaggatataggaaggaaataatggtttaatgaacttaaattatatccataaattaacaattataaagttcttcattatattgaggattcagatagagtaaaacatagatcgaattttaatctcttagttgttgatcagataatttataaaagggcaaagtgggcctgctaacggagtcgcaggcaaagtagatggtgctgcagctgatgtgttcagctcttgctcctccctgtcatcctatatctaacctatagattgtgaccagattctgttctagctttgccatttagaggggtgtttattttaaaacaaatttttataaaaatttgttaaattgaaaattttgtatagatccaggaaacttgatttttttgttgttgttcacagtctcactctgtcacccaggctggagtgcagtggctggatcatgctcaccgcacgttcaaattcctgggctctagcgatcctcccacctcaacctcccaagtatctcagactacaggtgcccctacaatacctggccaatttttaaaatttttggagagacaagattttggtatgctgacccggctggtcttgaactgctggcaacaaacgatcctccggccttagtggcctcccaaagtgctgagataacaggtgtgatgcaaagatgtatttaggggagatgtatagtggttaaatgtaccctctggttctagattgcctaggtttaaatgctgatgcctctatttctcatctctgtgaccttgggcaagtcttttcaaatttcttcatctgcaaaatgagaataacaataccaacctaacaggattgttgcaaggattaaatgagttaaaatacatacagtgtttggcacatagtaggtgctctgtaagtatcagctataatcattattgaatgtctactcggtcaacacttctgaaatattttagtatcacaacatatattaaaaatgatgatattttgctggacggggaagggcaggtacacagaagtggattgatatgtcacaacacaccagcctgccttggcaccattaggaaaacaaatgactgagttagtgcttttatgggtgtctttttattggctcagctcaggtcctgctcccaagaaactcacattttatgggagtagttaaagtctgaggccaaaaggatgaatcaatattggagaagtatttttcagagcaacaggacggaagacctctgctgtgctggaattacatgactttgcagatacctctgtagagtattggccttgaaattacgaatttcagattaaggatttgttactagaaagccttgtcaaaatgcaaaggtaagtaggggaaagtagtatattaatggagaactctccatttgtgtcctgtgaccatttgagattttagatatgtcaagagcaggccgggtgcagtggctcacacctgtaatcccagcattttgggaggctgaggcaggcggatcacttgaggccaggaattcaagaccagcctggtgaaaccccaactctattaaaaatacaaagattagccaggcatggtggtgggtgcctgtaatcccagttacttgggaggctgaggcacgagaatcacttgaacccaggaggcagaggttgcagtgagctgagatcctgccactgcactccagcctgggtgacagagcaaaactccttctcaaaaaaaaaaaaaaaaaaaaaaagagattgaggaaactgtacagtgagaaagtaacatgaaggcaccaaaattacaattacttgggagtaagtgagcaaagcttaggaaattgtgccatggaacaaaggtgataaatgtcaaagacaaactttgcctgcatttctaattccctaaatctggtgctgactaggatatccctttacttccttgtctgtgcccagttatgtttctgaaattctgtgtcagccctggaattatcctcatgttctgtatcaccttaatgatttcagcatccatgttcatgactcattagcactctgacctcacaatttctcatcgttttcttttccaatcatcttcaacttcactctgtatcagcaacccacagatggagccacaccttcaacctagtcatcaatgaaattacttcccctccaaaatgctggattgtgagtttccctctctgtacctacagccacctacccccatctatctctattctgtggtcattcccattgaatctgtaatttgtcctcaatgtgacagcctgacagccagtctttcttctcatagtttatcagctgtttcctatcattttttatcttacttaccagtaagaaccccctttttttttttgagacggagttttgctgttgttgtccaggctggggtgcaatggcacgatcttggctcaccgcaacctccgcctccctggttcaagtgattctcctgcctcagcctcccaagtagctgagattacaggtgctcaccaccatgcctggctaattttttgtacttttagtacagacggggtttcaccaagttggccaggctgatctcaactcctaaaagtgatgggattacaggggtgagccaccgccccccaagaacccttttatcaaccattttaactgcactattctcttcagttcccttgaccttcagctatgtttaccttatcaggctatttcctaactatttcctttttccttgagctatcagccccaccgtaacatttattcttagtacagaaccttgttttactcccttaaaatcaagaccatcatttgtgagcatccttgacttttctccaacttaggaagcaaatagatatttatcctctttctcttttccccactcagaggaagaaaggcccctttacttttaaaaggttaatttctcctcctctgttcttggtactactttaagtctagtcccctagttttatatttttcattattaacactaaatgactttgaaatgtttaaaaattagatattaactcagtggtgagttgaggacagcctctctgcctgtgttaaaacctttgtaacctgatagcacctaattcaccaaaattaaaaataattaaatgtctaaaaatgaagaatgttaagctacattgaaattcacttaacaaaatgaggtgagaatgaaaaatgaacttaaatttccaaactagaagacaagagaaattcatttcatagcaacaaaactcaaaaccattatgactgctatttcaaaaaatgttttgaagaatgtatattcagaaaaatcaacataccataagagtacagcctgaaaatttttgacaaaatgaacacattcatgtttatcatctatatcaagaaacagaaggcctggcacggtggctcacaccagtaatcccagcacttccggaggccaaggcgggcagatcacgaggtcaggagttcgagaccagcctggccaacgtggtgaaacctcatctctactaaaaatacaaaaattagctgggcttggtggtgcattcctgtaatcccagctactggggaggctgaggcaggagaatggcttgaacctaggaggcggaggttgtagtgagccaagattgtagtgagccaaggttgtatagtgagccactacactccagcctgggtgacagagcaagacttggtctcaaaaagaaaaaaaaaagaaagaaatagaaaatagtctgggtgcggtggctcatacctgtaatcccagcactttgggaggccagaggctaaagcgggtaggtcacaaggtcaaaagtttgagactatcctggccaacgtggtgaaacccagtctctactaaaaatacaaaaattagccaggcgtggtggcacacgcctgtagtctcagccactcgggaggttgagatatgagaatcgcttgaacccgggaggcagaggttgcagtgagctgagatcacgccactgcactccagcctggtgacaaagtgagactctgtcttaaaaaaaaaaagaaacagaaaatgaccagtaccccaaaagggccctcctcccatccagttattggaaggtcataactgaccactattctaatgtcatagcgttgtacccaagcgagttagagaaaacgacacactttgagacgaattaagagtcctttattagccagcgaccgagagatagctaacgctcacaattctctctgccccgaagaaggggctagattttcttttatactttggtttagaaaggggaggggggtctagttaaaacaattttacagaaataaagtaggcaaaaagttaaaaggataaatggttacaggaaagtaaacagttccaggtgcaggggctttaagactattacaagatgatagactcagggctttgggtgttatcaatcagacgaattcctgggaattgcggatatagcttgccacagtatcttatcagttaattgcattcttggatgtgctgggagtcagcttgcacaagttaagtccttgaggaaggggctgccagtgaaagagtcaagatggagtctgtctggctctcttagctaagggagagtcaattcaggtggaaacaagcctaaaaacagggttagtaaaaacaaggttgggcattacaatagttttatgctgtctttttaaacttgaaaagtgtacagaaaaattttttcacatcagatgggtaatgtgccaacgtcgtaacaaggtttgcgggaggcacatctcacacatgcacatgaaaacccaatcatcaggcttataaactacaaaagaatctgaaacttcttaggcttaatattaggttggtgcaaaagtaatttctgccattacttttaatggtgaaaaccacaattttacaccaacgtaatatatttacttattttattttaatgaatatactaaaccaagagagtttaaaatgaaataagtactgctctgtggccgggcgtagtggctcacgcctgtaatcccagcactttgggaggccgagacgggcggatcacaaggtcaggagatcgagaccatcctggctaacacggtgaaaccccatctctactaaaaaatacaaaaaattagctgggcgtggtggtgggcgcctgtagtcccagctacttgggaggctgaagcaggagaatggtgtgaacccgggaggtggagcttgcagtgagccgagattgcaccactgcactccagcctgggtgatagagcaagactctgtctcaaaaaaaaaaaagaaagaaataagcactgctctgtaaaggtaaacacagaggaagggatctagctcagagatctccatactgtggacttccagggataaccctggtcaaatagccatgggctggtcaatgattttgagttactctttgagagggaagcttggcttcagagaaggaaaggccagtgcaagacatgtgagcagcagttaggtgcatcctattcctagacacatacataggataaggaagtcaggtattgggactgtagctttggaatggactatacttgcttcagaatattatcagggggagtttgagaagcaagggctttccttcgttgattctcctttcaccagtcttcctggaaagaatattctgcagttacaaaataggttccttggctgccagtctgatacttgtgctaaaaccaaatagatgaaaaagtatcaacatgaattttaaaaaatatattgtgtgagcttgtatagctaagaattcccagccccctacataggatctgaagaaagatctagtactaattgtattaaataatggtttaggcaaatgtgtatctgtctccttaagagaggaaggcagtccctactgtaaagtaaaaatgaaatggatatacttcctgagagggctggaattttctgataattgtcccctctgatttttcacaggatttacggaatggccatcttccataattaacaaataaataaatgaaatttaatgtcagggtcaaatgaaactggaaacaaagcttatctggtgatatatcaaattatgagagtcattatttggatgtaaggatatatgacagatagactcttaggagaaatgctatgacctcctgcttcttggtattccttgtgtgatttcctcctcttgagtgtgaaggcatgtatgtcattgagttatataagatagtgcccatcttgctagtgtctctctctctcttgtggctctgaaaaatcaagctgcctgccatgtttgagctttgatatggaaagacccacatgttaaggaactgagggcagactctgccaacagctagctttgaaactgaatctcccggccaggcacagtggctcatgcctttaatcccagcactttgggaggccaaggtgggtggatcacaaggtcaggagttcaagaccagcctggccaagatggtgaaaccccatctctactaaaaatacaaaaattagctgggtgtggtggcaggcacctgtaatcccagctacccaggaggctgagggagagaatttcttgaacccaggaggcagaggttgcagtgagctgagatcacgccactgcactccagcctgggtggcagagcgagactccatctcaaaaaaaaaaaaaaaagagagaaagaaaccaaatctctcagtcctacaacctcaaggaactgaattttgccaacaaaagcagatccttccccagtcaagcctcagatgagacagcatcctcagctaacaacttgtttgcagcctcatgagaactgaagcagagaacccagctaaactgtgcctagactcctgaccacagaaactgagataataaatgtgtgttgttttaagctgccaagtatgtgataatttgttatgtagtggagaactaatacaacagggaaaagttaaaagctattcacataaatatttataatggatactatttctacacatttaaatca

SEQ ID NO: 29 - DNA, 180512 bp, Artificial Sequence
  Synthetic BAC sequence
gaattctgggagatacaattcaagttaagatttgggtgggggcacaaccaaaccatataaatattttaaggtacctgcagcaacgaaaatataatatgaaaatatttgtgatttataatggtgacaaagtcacaggcaatgatgctattactgtagtttgttgattacacttatgatggaaggaaatcctaaatttcaacagtaggttagtgaaaattaaagatgtaaattttccccatttaagttcatggacccctgaattctacccatggaccccttaaagatctaggtccctgttctagatggtagtatctggtttccctatgaaagtgtggatgctatggggtggggagctctcaggagcaagatttctaagatatgaagatacagttgaagatatttcataaatttctctattgtacaatcttctggaaaagaaaattgttgatacatatggttgaagtgtggcatggttgtattcttgcttatgcccacatcatctgttacccatgaattatccagagtgattctaccatttgatgctttactgagtatatcacaaatactttgtatgtatttcttggtgttttaaaaatgcttgctgctcaaatgttacatttaagtaagaatgtaaaaagggatttcttaaaaagtagaaatctagctcttgaaagggaataattaaagagatgaagttagattctttccattgaacctgattgctaggttacacctagcaactaaccaaaaaaatctagcttttgatcagcatattttccattaaaaatgttcaatgctggcaatatttattgtgtactgaaatttttgtgtttgtgtgtgtgtgtgtttaatttatttagctctgccagctaagcctgagaacatttcctgtgtctactactataggaaaaatttaacctgcacttggagtccaggaaaggaaaccagttatacccagtacacagttaagagaacttagtaagtacaggagcttgtgttttatcagtcagggcatgggggaggcagaggcttctgattcattcatgattcacatcccatatgaagcaaaaagtttcctcaatgacagcttctgggtgattactgtgtgcagccagtggcttgtggacgggatctggagctgcagagggaggggaggcatagccagtgttgacctcctcctggattccccattggctgagatgagtcaccagttataagcacagtggaaaaatctgtttatttactacactcaactataccctgcctctttccagaatgtgttatataaaactgttcattctttctggatccagatatagtaagtaaggttgtaaacccagaactaacaggcaattgaccatggtctgccactaatttgctgtgtgacctctgtcaaacactattccacaggacaatgattccccaattttttttactacctcaagcatccctctttattccaattctgtagaatgaaaattttataatttttaattattattctagccaaaagctagatgttttaagtaaatatttgcaggttaaaaaaaaacttttttttgagacagaatctcactctgtcccccaggctggagtgcagtggtgtgatctcagctcactacaacctccatctcccaggttcaagcgattctcctgcctcagcctcccaagtagctggaattatgggtgcacaccaccatacctggccaacttttgtatttttagtagagacagggtttcaccatgttggccaggctggtctcgaactccggacttcaagtgatccgcccacctcagctcccaaaagtgctgggattacaggcatgagccaccgtgcctgtcctttttaacaaaaatttttaacatagctcattacttccttcttgtgaataatgaataagggggcccatgttgggaagcattgtaagatgacctttagtctttttcatttcaaaacagtctgtgattccaaattctttatttttaagctaaatctcacattgcaagggaagtccactttatgttttcagtggaagaaatgaaaaaaacaagcagtattctcagcagcactgatatagctacgagaacctatgtcagagagatgctttaaaacaggagtcagcaaatttctcttctaaagggccagatggtaaatatagtaatattaagaaggagatcggtctctgtcagaacttttcaacactactgttatagcactcatacagctataggcaatatataaaccaatgggtgcggctgctttccaacgaaactttatccatggacactgaaatgtgaatattatataattttcacacgccccaaagtatttttgttcgttttatttatttttcaaccattaacagcatgtaaatagtcttaagcctacaggctgtgcaagatcaagagatgggctatatttgacctacaggctgtcgtttgcttatccctgttttagaaaataagcatgataaaggcccaataacccatgatccaaatgacttttcttccagatttgtcagttctagtcccagtgttgaatatcaattgctagtagaatgagaatctgggcacctttataggtttactgctatttttctgtcttatagagacatttcccctcttcctccatctttccctttgggttgttattattatcaccagttggacatggagaaatagaaaacacctgggaatccccaggcctatacccagctccccttgatggcctcaggccagctaggctgtctagaactcctaggccacttgcatttttgtgaatttatcaccaagaggatctcttccaagcaaagtggaagggtttccctgtggatggcctacctgggagcacttttcagtaggtcatggaataagccaaaaaccttctgatgtccagaaacaataggaaagaatttttcctggggagttggggatgccttcatggagataatgatttttgaactgaggctgaaaggaggtctagaggtgtggaaaaggagagaaagtttatttctcaaaggtcacagcatgaataaatgcagaaatattcaactacaattatagtaataacagctcacatttattgactctgtgctggacattttaaaagtgccttatgtgtattagctcatttcatcctcataaccctatgctacagatatattactgtcttcattttacagatgagaaaactaaggcacagagaggttaaagaacttgcccaagtcacacagttaataggggcaaagccacgattcaaacctggtctgattctagaacctgtgcttataaccacgacacattgccctggaggccatttttgtgctgtaaaataaccatcaaccactcttgaggtcctttctagtttcaaaattccatgattctatgtgtctatgtctccctgtatgtattccatgtgtatatgtcttcccacacaccagcaaacactggtaccttgcaaggtgggccttcttttctgttctcagcctgctttatctcctccacaacccccagaaccatgtggactatagctagaaccacccatctgattcccactaatatgtgtatttgttttcattaagttacagcttggtagtatatatctaatctatcatctatctatctgttttaaagatttttctgaaaacaatatataccaatgttcaaaaattcaacctgaaaaattataaagaatgtaaaaagttacccagaatcccactgccaagggtaacagcttgaacattttgatgatctctctagatatctccacaaagttatgtaaatatctttatgtttatgtaactgtgatcattctatacatgatatgcatcctactttttttcaccagcagtagatgcatctttccatatcaataaatacagtatgttaaaaaccatcacttacattctatttatgtatctaccataatgtatttaacaaatccttacatatatgaatatatttttacatatatatgtaaaagaataaatttttaaggctagaatctggagttttcagggacctactcatgatttcttgcaactatagcttttcatgctatataggacatgcattgcaactatagcttttcatgacttacagggatccaaagaggttttcatggctcctaaagcatctcaggcagcagaaagcaggtaacctttacctttccttggaggtgaggaaggaatttggaaagaggataaccaaatatcctggactatacagttctcaagaaaacccagagaaaaactaacaaattactgcttaatacattaaatatggttatgtttccaaaccattgtactaaactcatgttgaatcactttttctttcaaagcgcttttggagaaaaacatgataattgtacaaccaatagttctacaagtgaaaatcgtgcttcgtgctcttttttccttccaagaataacgatcccagataattataccattgaggtggaagctgaaaatggagatggtgtaattaaatctcatatgacatactggagattagagaacataggtaagtgttatttgatactcttatatactctttattaaatgtttacctccttctctgttcaagaggtatctgtggactcaaaagtaggctcatcaagttcaaggatatgtgttgtgggtatacagaaaattcatcttctaattaaagaagaaaggaagtgggggaaggagggaaggaaggaagggagggagggagggagggattcaccaaatgggaaaaaaggaatgagaaacaaaagctattttgtgggccactggtttcctcttgtagtttgtaattgcactcaaagaaacaaaaaggtctctccccaccaccccaccctgccaatgtcattgctcataaacgaaaagagcataaaattattattttttaaaatgcctcaccacttctgacttaaaaaaaaatctttttcaaagactaattttcaccatatacttttaaaattataactgtattgagatataattcacattatataaatttcacctttttaaaatgtacagttcagtgatttttattgtattcacaaagttgtacatatgttaccactgtctaatttcagaacatttttattgccctcaaaagaaaattcatacccattagcagtcagtcctcaatcctttgttttctctttcctccattctctggcaaccactaatctattttctgcctgtatggatttgcctatacattttataaaaatataatatgtggtctttttatctaatttctttcacttagcataatgttttcaaggttcatcaatgttgtagcatgtattagtgctttaattctttttatagctaaataatattccactggatgtatataccacattttgtttacccatacatcagtttatggacatttggcttgttgctaccttttgattattatgaataatgttgctgtgaatatttgtatacaattttttgtgtggacatgtttcaattctcttagatatatacctagtgaaattgctgagtcacatggtaactcaatgtttaacttttggtagaactgctaaactttatcaaagtgactgcaccatttaacattcccactggcaatttataaaggttacaatttctgcataccctcaccaacacttgttattgtccatctttttttaattatagccatcctagtgggtgtgaagtgataccttgttatggttctgatttgcatttatccaatgtctaatgatattgaacatttttcatgtgtttattggccatttgtatatcttctctggagaaatgcttattcaaatcctttgcctatttataattgagttgtctttattgttgagttttaagaattgtttatatattcttggcacaagttccttatcagatatgtaatttgcaaatatttcctccctgtttgtgggttttcttttactttttaaatggttaaggtagaaaaatatttatatgaagtcaaaaatgtatatattttttatttgattgtttgtactttaggtgtcatatctaagaaaccattgcctaacctgaggtcagaaagatttactgctgtagttttttctaagagttttgaagtcttagttcctacatttgaattattgatccattttgagttaatttttgtatatggtgttaaataggggtctaactttattcttttgcatgtggatatccagttatctcagaatcatttgttgaaaagatgatttctgaccccatggccccatcccacgttgttgaattgtcttggcacctttgtaaaaatcaattatttcaccataaatgtaaggtatttttcagggtcttcaattctattccattgaactatatttttgtaattaggccaataccacactgtcttgattactgtagccttataataagttttgaaattgggaaagtgagtcctccaactgtgttctttttcaagattgttttagctgttgggtcccttgcatttccatataatattttagtattagcttgtcaatttctgcagagaagtcagctgtgatttcaatacggatattgtcatcttcataataaacaatcttccaatccatgaacatggaatatctttccatttatttaggctgccttcagtttctttcattaatttgttacagtttccagtgcagaagttgtacatttctttggttcagtttattccaaagtattttattcttttaaatgctattgtaaatggaattgctttcttaattttattttcagattgttcattgttagtgtatataaatacaattgatttttgtatatcgatttggtaattggcaaccttgttgaacttgtttattggttctaataggttttttaggtggattccttaggattgtctgtatacaaggtcatgtcatctgcaaacataatcttatttcttcctttatgatctggatacgttttatttttcttgactagttgccttgtctagaacttttagtatagtgttgaatagaagtgttgaaagcagacatccttttcttgttcctgatcttagggggaaagcatctagtctttcaccatttaagtttgatgttagtttagctatgggtttggtagatacccattgcacattgagaaaatttccttccactcatagtttgttgagcatttccttattgtgaataggtgtgggatcttgtcacatgccttttctttatctggtgggatgatcatatggttttgtcttttattaaaatggtgtcttacattgactggttttcataagttaaacaaaccttgtatttctgtaataaattccacttggttgtggtgtataattctttttatatgtcgctgaatttggattcctggttttttattgaggatttttgctcctatattcaacatggatatggtctgtagctttcttgtgatatctttgtttttggtatcagggtaatattggcctcatagaatgagctggtaagtgtttcctcatcttctattttttggaaaagtctgtgaaagactagtgttaattatttttaaacctgtcaatagatttcctcagtgaagccatctgggcctgggctttctttgtgggaagtttttgacttggtttctttataaaactttttttttaagacctccctttggaagacttactccacactgtaaacattggtgttaattcatgatgatagacctggaaggggacaagattattcactttttctcaaaaaccttcattattactatttttactttcttaaaataaatgtattattactttagcaattaaaatattaaaaagcaaattcagttacaaagaaaactcaaaacaaaacaaagcaaactttctagtccttctttcaactagatttagtatctatttaaatattctgtaattgccactgcttaaaactttgaggaggaattttggcctaaattgatacaatactggaattataaaattaaactctgaagaaactctgtttttataatatgtttctaggacctggtaaagtgttgctaagtactaagattttttttaatcctttaatgaaagcatttaatatcagaataataagcataataattttataataattaggttagtacaaaagtaattgtggtttttgccattactttcaatagaacttttcttatttaaattcaagtggatagaactatgacagtgcttttaagagcaattaaaaatattttgggctggcgcggtggctcatgcctgtaatcccagcactttgggaggctgaggcgggcaaatcatgaggtcaagagattgagaccatcctggccaacatggtgaaaccccgtctctactaaaaatacaaaaattagctgggcatggtggtgcgcacctgtagtcccagctactcgggaggctgaggcaggaaaatcacttgcactcgggaagcagaggttgcagtgagccgagatcatgccactacactccagcctggtaacagagcaagattccatctcaaaaaatatatatattttgatctctaattgagatacgtccttcctacccccagtttacagtgataatttgcttaaacctttttcacagataatgccggagtttactttggtccagcctctgacataaattattacagttagtggtatctaaataaataaactttagctatgtttgatatgcatcagtttttgacttaaaatgtattctgtctgattttagtatgcccaccctgctctcttttgtttactatttgcatggaacatcttttttcatcctttcactttcaatctatttgtattttcagatctaaagttagtctttgtagatagcatatagttagatctttttttaatttaaattttttattttattttttatagagacttgctatgttactcaggctggtcttgaacttctggcctcaaatgaaccctctgctttggcctcccaaaatgttgagattaccagcataagcccttgtgcccagccagttggatttttttttctttaattatctgctgatctgtgtatttgggttggagagtttaacctatttacatttaaagtaattgttgataaggaaggacttacttttgacatttaaaattttttcttttatattttatagcttttttatccctctttttttcattattgtcttcttttgtgtttagttgatttctttgtggtgacgtgttttgatttcctttggtgtattttctatagatactttctttgagattaccatggggactacaaatagcatctaaagttataacaatctaatttgaaatgatatcaacttaacttcaattgcatataaaactctactcctacacagcttcattccccatccccattttatgtcattgatgtcacaaattacatctgtatccactgtataccataaagctataattgtttttcatacattagtcttttaaattctttggaaaataaaaagaggaattataaaccataattacaataatactagcttttatatttgcttgtgtatttatactagagatctttatatcttcatctggctccaagttaatgtctagtgtcctttcatttcaacctgaaggactccttttagcatttcttatagggcaggcctattggtaatgaactctctcaacttttatttattttggaatgtcttaatttctccctcatttttgaagaatagttttgccaggtatgtaattctcagttgacaattttttttctctttcagcactttaaatgtattatcccactgccttctgggctctaaggtttttgctgatcttagttgaagatccattgtatgtgatgagttgtatctctcttgctgcttccaagatactgtctttgtctttctggggtttggttgtaatgtgtcttagtgtgggtctctttgggtttatcctacttggtattcactgggattcttggatttgtagatttgtgtatttcatcacatttggggactttttagctactatttcttcaaataatctctccaccacttcctctctctcttctctttcagaaactcccaaaatgtgtttattggttggcttgatcctgttccacagctcccttagactctgtttatttttccttatattttttctttctgttcctcagactcaatactttcagttgttctatcttcacatttactgattgtttcttatgcctgcttaagtttactgctgaacccctgtagtgaatttgtatttcaggtactgtgattttcaacttcagagtttctgtttgcttcttttaaaaaaataatttatatatttttgttgatattctcattttgttcatgtattattttcctgatttcctttagttatttgtccatgtttaactttagctctttgaacatatttaaggtgatcattttagggtcttggtctagaaattctgatggctgggcttcctcaaggacagtttctgtggatttgttttgtttacttaaatgggccatgttttcctgtttctttgtatgccttgcaatttttgttgttgttgttaaaaattgggcattggaaaaaacagctacctctccacgtctttgcagactgactctgtgctggggctgttcttcatagattagctgggcttactctgagcctagggatcagcccaaggtgaaaacttaaagtcttctcagttcttttctgagtatacatcttgtgtaggcctggctggtgctttctcagttacactgtatatacacacagctgcttttttttcttctttttttgagacagggtctggctctgttgcccaggctggagttcagtgatgccatcatagctcatggcaacctccccttcctggtctcaagccattctcccacctcagcctcccaagtggctgggactacaggcacacaccacacctggctactttttatatttttttgtagaggtggcatttcaccatgctgcccaggccagtttcaaacttctgagctcaagtgatctgcttgcctcagcctttcaaagtgttgggattacaggtgtgagccactatgcccggccacagctgcttttgaatgtcttaatttcccaaagagtcttacccagtttctccttatgattttatataatttattgtatgtctgcatacataatctcttgccccaggcttccatgtgtctgtagtctccctgtagcttttatgagcagtgcctggctcttttcctgcctgagattaaagttaggcaaaacagagaccagtcgtttagtctgccctcagacaggctggaatataagtaagtgtgctctgttctctttagttggtagaagggaaataggacctgagatgccaccttcttcaaaccaagaccactgatgtttcagggagagggtggggcaagggcaagtaagacagccacaaaactattttcctgccactttgaaggtgactttgtcttgatttggtgtttataatggttataaaccttgggttgatttccagagctcctacaagtttagttcagccagtttctgtcctttttttttttttttttttttttttgagatggagtgttgctctatcacccaggctggagtgctgtggcgcgatcttggctcaatgcaacctccgcctcccaggttcaagcgattctcctgcctcagcctcccaggcagctgggactacaggcacgcaccaccatacccagctatttttgtatttttagtagagacagggtttcaccatgttggccaggatggtcttgatctcctcactttgtgatccacctgcctcagcctcccaaagtgctgggattacaggcatgagcctccaagcccagtccagtcttttttttttttttttcaatgttttcatgggagaacaagaacttagagctacctagtctgccattttgctgatgtcacttgatataaatcagttcttaatgagatattctgagagctatttttattcagaggaataactaatactttctatctccttggttatagagtattagagttaagtggaactacagtaggtatttgtgtttattctgactggaggtggttagtgtaatgaacaagggcagaaactttggtgtggatacaaatgagtcttagattggcttcttattagaaagttattttcccttttccaataccagttttatcttctgtagaatggatataataaatgttaggtggttgagaggattcaacaaaatgattcacctaaaaaaatacttatcaagtgctcaatacatataaataattttatggaaatacttaatatgtctattgtatacagctctacttactagtggccacacggattgatgaccaccctttagtccaggcatcagtacaaattattttttgagtagctaccaagagttttctgaatatttttacccagttaatgttttaaagtccatgtctctaagtagggattttgctttctaaaactcttcaagaattacaaagaccccattctccatgatgtgattattttacattgcatgcctgtatcaaaacagctcatatgtcccataaatatacacaccaactatgtactcaaaaaattaaaaattttaaaaattaaaaaaagaattacaaagactaaaaagataatactattcaattctagctagcaagagtctggtgagatgggtattcatacaatgttgatggaaactgaaattggtataacctttctggaaagctaaatggcactgtgtgacagcagccctaaacatggtcatgcccttttacccagtcagcctctgctaaggggtctagggaaaccaccagagatgtaaaggaaaattcaaccatcatccatttactcattcacttaacaaatatttgatacctgctaaatgtcaggtgttaattctagactctgtgatcaagaccagcctttgtcctcaaggagttttaaatgaaaaattagaaacactattgttagcggtggaagttatctgagttaccagcagcaaatccgtatgggtctgcagcaacctcagttcttgcctcctcggaagaaagaattcaactgaggggcatacgacagaagaagaaactgaggcacgttttagagcaggagtggaagtttattaaaaagctttagaggccgggcgcggtggctcatgcctgtaatctcagcactttgggagcctgaggcgggcggatcacgaggtcaggagcttgagaccgtcttggctaacatggtgaaaccttgtctctactaaaaatacaaaaaattagctgggcgtggtggcagatgcctgtagtcccagctactaggggggctgaggcaggagaatggcgtgaacccggaaggcggagcttgcagtgagccgagatcgcgccactgcactccagcgtgggtgacagagcaaggctccatctcaaaaaaaaaaagaaaaagataaagaaaaagaaaaaaaagctttagagcaggaatggaaagaaggaagaaggtaaagaacacttggaagagggccaagtgggcatcctggaggtcaagtgccccgtttgaccttggacttttctgcgccttgggttttctacgccggcctacttccggcaccttgcgtcccatttcccttgattcttcccttacggtgagctgcccacttgcacggcggcctgctagaacttaggaggtgagcatgcgcagtgtatttactggagtcgtacgcatgctcaactgaggcgttcttcccttttccattggaatgcccccagaagctcatataccagttaaactctgccattttgcctcttaatggccatgcttgagcccactcgcccagttcctgagatttttttttttttttttttttttttttttgagacagagtctcactgtgtcgcccaggctggagtgtggtggtgcaatctgccacctctgcctactgggttcaagtgattttcctgcctcctgagtagctgggattattggcgcccgccaccatgcccggctaatttttgtatttttagtagagatggggtttcactatgttggccaggctggtcttgaacccctgacctcctgatctgcctgcctcagcctcccaaagtgctgggattacagatgtgagccactgcgtccagcccaattcctgagatcttactggggagctgccaatcaccagttacaggtgtttttatatattgggaaactgcctttccctggtgctggctacagccaattattaggtttgcaaggcagcgtgacaatggtctgagcatcacctgatggtcacctgactttcctggtggggtgtagggggagccctctcctgtccttctcatgcctgattagctacctactgtaataccatgaatgtgcgataatagaacataagtcaaaaaattatgttcattcataaagtagaatattatgaaccttaaaaatcatgttttgaagaattattaatacaaagggatatatgctgattgcataatgttatttttaaaaaacaaaagctttatttagcgtaataccaattttgttagaagataatgcaaataattatacggaaaacggctgaaaggaaatataacaaaatggtaataagggttatctctggttgatgggataatggatgatttttagtttttctttgtatttttctacacttaaaaaatgttgtataataagcatatgctacatttataactagaaaaatgcatattttcaaagagagaaatttaaggctaaaatgtttgcagtgtgcaaggaaaatgagagttattttctagtgtttatagtgggtattccatcatcctaggggtcaaggaaggagaggcctaggggaggtgagagtaaataagagagacagcctattttctggttgtgtggtctctttttacctcccttctgcttggcatagcatatgaccaatcaataagaggctgatttgctgaaaaatcacaggaatgcatccttctctcactgggtattcctttttcagaggtgttggggttgggggggtgacattccttttgtactgccttgcaaatgccatcttcgttccatatagcagaccacaatgcacgtatcattttttttcaattttgggtggatgctattagcaaattcttatctttttgcagatatgagagttgtatgatttttattttcagcgaaaactgaaccacctaagattttccgtgtgaaaccagttttgggcatcaaacgaatgattcaaattgaatggataaagcctgagttggcgcctgtttcatctgatttaaaatacacacttcgattcaggacagtcaacagtaccagctgggtaagttatgccattataataatattccaattagaggcccagaggaaaagaatcattgacaactattgttgacctggaatcattatttcactttttacattaaaaatagaagagagacattgctaagtacttctccttccagttttccatttttccatctggaccttttagattggaagggtgttctacaataggcatttttgccttctgagcacagggacataataaagagtgagaaatttacttctgcattatatccaagtttgtgtctggctatgttggctaccagagagtctatggtttggccattttattttttatttttctgaccttttataaaatcatgaggtataacatacatttggaaaggtgaacaaaacgtaatattacatttaacaaattattattaagtcagtgctcatgtagaaaccactgcggccaagaatagaacttctccaggatgccagagccccctgcttaccctttgctcatgacctctgttagagctgttaccctgattttcatggtaatcttctttgctttcattttttaccatttaaggctgcatcactgaagaacatagtttaagagactatgccctgtttccttgagtcccaggatgaagaagcgcccagtagaaatagaggaggagcatataaagggaatccatatattttgtattttctaatgtttggcttctatctctcaatattgtgcttttaagacttattcatgctatataatgctgtagtttatacattttcattgctgtgtagtatctcatagtatgaacatgatggaatggtggctttaatttgcatttacctgacctttaatgaagttacacaccttttcacatgtttattggccctttggattccttcttctggaagcgctgatttaagccttttgcatgttttttctattggctggtctgcctgatttttcaattgatttgtaggcattccttacatattctatttatgagtcttttatttgttacgtgtattgcaaacatctttcactatgtggcatgacgtttcactctcttaatggtgacttttgaggaatagtcacttaattttaatatggttagagttttatcagtctttacctttatgcttaatgccttttgtgtcttaggaaatgttttcttacctcaaagtcaagaaaatattctgcagtttccatcaatgcagcctgaaattgtatcacctttttgtaatcatctcatatttattgcctttttataaattttagacagggtctcactctgttacccaggctggagtgcagtggtgtgattgcagctcattgcagccttgaactcttgggctcaaacgatcctcctgcctcagcctctcgagcagctaggactacaggcatatgccaccatgcctggctgatttttaaattttttttgtagtgttgcccaggttggtctggaactcctggtcttaagtgatcctcctctctcagcctcccaaagttctgagattacaggtgtgagccatcatgagcagacacattattgacttttaatcaactattagccaattaaatctttaagactttttacctcctgaagacttgccagtaaaacatacctctactatcttatcatttgttggtttttaacctaagttcaggtgttttatttattcttattgaatgtcttcatgttggtcttatctatcattccagcctatttagaatcctgtttggtcacccaaaacttatgattaactttttactttttaacttttcagtatccccagatttgataacacttccttctatacctttatctaattattaataaaaatggtgactacatcagagccctgtggtaaaccagtagaaaccatccagaggatcaacccctcctttggatatggtcatttattcaggtttctatgaatatacctaattaccactatcatcattcagcctacttttttttatcttgtccaggaggctatcatgcgaccctttcccttgtggaaacccatagacaccctgtttactgcagcatgctctccttgtctggaactctttcagaaaagcattatttgtcctattgttgcagaatttttgctccttagttcagctaaatccgggttcttgtgtcaacaggaaaaattaggcacgtggacacattgaagggtgaggagagaggaatttattgggcgaaaaggaaaaaagagaaaaaaattctcagcaaagcgagatgggctcctgctaacaggctaccacctcacagactgaataccaggccaccacacaggagctaaagaggccaggctccttccccctgcacaaagcgtgaacttcccgtggctccaccccattctcccagtgcacaggcgggtccccagtctgttgtcgacatgcgcggacaagaccctgggcaggtttcctcatctacacaaaagcatctgatgtaaacacttgggcgggtcagagattctctgggaaccccccttatctgccttctgcctctatcactgtgttcagagagatgataatggccacttctccccccagcttcctttctaagccagctctggaaccattctctttgaacctgcctacatggaacattagattcattaattgtagtttggggaacccctaagcagagcagtccccggtatagcacaagctcctcttcataccacatgtcatggtctccgtgaacctgagaaacttctgggatagtctactggctataaacccttaattccttctatttggctgagtgcagagttactacagctgctgggggataggattcaacaagaaaaataaaccaggaccagagtccctctggaaaattactataccgcatataacactaagtgagggcaacgggtataaactacccaacccttggcatcctgtaccccgtatctttaacaaactcacccacatctgtactcatctttgcttcctgccagtcccagaggtaaaatgtcctgcctcctgttttcctggaggatgcaggaaggaaggtggaagtctgtactactctttctctctccttagctagcttgcttgcttgcttgcttgctttttttttttttttttttttttgaggtggagtttcactcttgttgcccaggctggagtgaatggcatgatcttggctcactgcaacctccacctccggggttcaagtgattctcctgcctcagcctcccaagtagctgcgattacaggcttgtgccaccacacctggctaattttttgtatttttagtagagatggggtttcacatgttggtcaggctggtctcgaacccctgacctcaggtgatccacctgcctcagcctcccaaagtgttgggattatgggcataagccaccatgcctggccttctccttagctttcaaatacaagcagttatcctcagttgcaatcccagctaaacccaactctgctcttcccaaccttctatcaaagatttccattgttgatggaaaagggtccaaattattaactctgtgagacctggcatctaccgatcccttcacgctcttgctcttgcctctctggtcattctgaattgcttgtttcccttgcatcatgttctctcactctttctgtgcctttcctagaacaccctctgcttttgcacctctcctgccccaatctccacctttcagaactcaggcctgacatatttccttctgagggcctgggcctggtccctcctctgcatgcttctgtcattgcacttaacagcaatgcatttcaactttctcttccagttacactgtaaattcttcaaatgcagggaccttagttttcatctgttttccctttgcctggtgcatgcctgtgctcaataaatatttgtttaaatgtagccatgtaaaactaatgctaaaattccaacatgtccgtttaacaagacccatatttgtatgatattatgagtaacaaagagcttccttatactccaaattatttaatccttgcaaatatcctgtaattgaggccttgctatccccatttttgcagattaggaaatcaagatgttgaaagcttaaatcatctattcaagatcacagggcttgtcagttgcaaacctaagctcaggttttctgtctcccaggtttgccatccatgtgaccttacctcaacaccctccagattcttttgtggccctagtctaaagggtttgcacctttgtataataaagccatgtgagcctcttagaaagggatctcaaaagtattttaagaatttgatttatggactgggtgcagtggctcacgcctgtaatcccagcactttgggaggccgaggtgggtggatcacctgagatcaggagttagggaccagcctggccaacatagtgaaaccctgtctctacgaaaaatacaaaaaaattagccgggaatggccgggcacggtggctcacgcctgtaatctcagcactttgggaggctgaggcgggtggatcacaaggttaggagatcgagaccatcctggccaacacggtgaaaccccgtccctctaaaaatacaaaaaattagccgggcgtgttggcaggcacctgtagtcccagctactcgggaggctgaggcaggagaatggcatgaacccaggaggtggagcttgcagtgagccgagatcgccaccgtactccagcctgggtgacagagcaagactctgtctcaaaaaaaaaaagaaaaaattagcccggcgtggtggtgcggacctgtagccccagctactggggaggctgaggcaggagaatcgcttgaacccgggaggcagaggttgcagtgagccaagatcgtgccactgcactccagcctgggcaacagagtcagggaaaaaaaaaaaaacaaaaaaccacacacacagaatttgatttaggttttgtatcagaacttctgactcatctattaagacaaacactttgggtgagttaggatttggcacaaagcatagattgttaacagtgaacatgatgaagctaattaatgttttagtagggttccattgcctgtgcagagttggggaagttttggatctaagcctgtatataaaggatcaattgatcctggatcctgtcggagccagaggcaccttggctggacaaaataacaaagtaaaggagccttacaggcaccttgattaaaagactgagcagccgtttcatcttctctgaggccggggctgggaggaagaggcttccgtggctacattaggcagaactttctgtgtaatgtacgtgatgagaaccactacacaggctgagcatgtgctaagggtacaacaaagcaggaggaaaaattgaaaggttaaaaagaagaatattatatattttttaaagcatgacaagtaaaatagaggtttattagacttccttacacttgctgtatggattagtatttttattttaaatcacatatggagggcaccatgtggttgggcctttcctggcagtcttaatcctgttctagttggatccctaactaacaacaggctgtctcaagttactctctccacaaccctagtctgccatcacagcatctccggggcctgtttgaagaggatgctcagggaacctgggatttagcccccaaagtgtcattgcctcttcttgttccacctccatctcaccaggctgggagttccaaagtccatctgcggctgtcagctttctgccatagacacatatcctccttctgcccaatttccttaaagcacaggagctgcaattaggtactaattttcacagctgggacatagatgcaagtagtatcaggacttccttctcttgcaggatccatgggacgatgctgtgtgcatactagttaaatagacatgcctattagtgcagtttatttttttattaatcagctcaaaataagctttataaacctttaggctttgggttttataaactttaggtttataaagctaatattgagctaaatgtttatattgaactaaaggtttatattgcagcaacaatgactgtgctcagaaaaggaatagctaaatgtttagtttctcttggagagctgagtcccagaaattatataaagcaacaccttcactttaccaatgagaagctgacatctagagaaaataactgattttatttacctctttcctccccaagagagtatcaaaattaatttatacattcaggccattgagactttcagcagcttgactggtcacccaaagaccagtgctttgaagtgaaagatttgggtaaaacgaaaaagccgaggagtgaagaaatctgtgttctgatcctattctgtagatcttctaactttcatttaaatggttatttaactttcctgggtctcgtggatgacgtgaggattgcatttgatgcagctaaggtctctgtttctgctgttccatgaggcagtatctctaggtgttggagtcacctcctaggcccaggttgccctgggtcatgaggcttgcgtcttctagaacagcaagcagcagagctctgctcacccagaccaggccagaggcaggaatctctgccccataagcttagatacaggaaatgggaagggagttggtggttcatggggatgttcatatctgtgtaggtaccaattgttcccaggcacatatggaagtctgttaataaaaatgatatattttaaaatttgatttagagtgttactagttctaaaaatgtaaaagtacactaggtagtgaagaggaaaatgggaggataacgtgtggtctccatttcagtttaggattgtctctgtcttgtagatggaagtcaacttcgctaagaaccgtaaggataaaaaccaaacgtacaacctcacggggctgcagccttttacagaatatgtcatagctctgcgatgtgcggtcaaggagtcaaagttctggagtgactggagccaagaaaaaatgggaatgactgaggaagaaggcaagctactccctgcgattcccgtcctgtctgctctggtgtagggctgctttgggctagacttggtggggtttgtcaccacctggttgggaatcatggaatctcatgaccccaggggccccctgtaccatcgagagtgagcctgcacaactttgtgccccaaaggcaaaggatcacattttaatactcatgaggttcttatactatacatgaaagggtatcatatcatttgttttgttttgttttgtttttgagatggagtcttactctgtcacccaggatggagtgcagtgatgtgatctcggctcactgccaccaccacctcccgagttcaagcaattcttgtgcctcagcctcccaagtagctgggattacaggggcccacgaccatgcccggttgatttttgtatttttagtagagaagggatatcaccatgttggctaggctagtcttgaactcctgacctcaggtaatctgcccaccttgacctcccaaagtgttgggattacaggcgtgagccactgtgccccgccagtatcatatcatctgaaggtatcctgtgataaattaaagatacatattgtgaatcctggagctactactcaaaaaataaataaaggtgtaactaatacaatttaaaaaatcacatttttaatgacagtgaggaaaggaaagaggcatggattgcaggttgatggagtgcttactaagtgtcagtatggtcattaagagcaacgcttccagtcagtggccttggcttaaatcccaagccaggtgtctttgggcaagatacctaaactctcagttcattctcagcagtttcctcgcatttattccccttttctatattgaaatagaatatgtaagttgagtttatagtagtacctattttttagtattattttaaagattaaatgaaataatgtgtttagcccatagtagatattcactaactgctagacttcctattcttattatttatcctcctactattatttttaatcctccttaaagcactataaaatatgtagagtcactcccattttggaaatgaggaaactgagtttcagagatgctaataaacagctcagggtcactcagcatgtgttacttttctcaagagccttgcccagagtctgaccctcagtggacgatcaataaatgtgtgatgaatgtatcagttttctattgctgctgtaacaatacaaatttagtggcttaatgcaacactaatgtattctttcatagctctggaagtcagatgtccaaaatcagtttcactgggctaaagtcaagatgtcagcagggccatttccttctgagactctgagtggagaatctgtttccttgccttctccagcttctagtggctgcctgcattctttggcttgtggtccttcttccatctacaatacttatccccccatcatcacatcacctttccccactcttgtgtgtcaaacctctctgcctccctcttataaggacttttgtgatcacagttaggacccacctggctaatccaagataatgttcccatctcaagatcattaacttaatcacatctgcaaagtcccttttaccatataaggaaacatttacaggttccagggatttggacaagattttttttttttttttttttttttttttttttgagatggagtctcgctttgtcgcccaggctggagtgcattggtgtgatctccgctcaccgcaagctccgcctcccaggttcacaccattctcctgcctcagcctcccgagttgctgggactacaggtgcccaccaccacgcctggctaattttttgtatttttactagagatggagtttcaccgtgttagccaggatagtcttgatctcctgacctcatgatctgcccgcctcagcctcccaaagtgctgggattacaggcatgagccactgtgcccggcctggacaagatattttgagggccatttttcagcctaacagtaaatgaatgactaattggatgaatacttggtgatggccacacatcttcttctgaatgatggacaagaaattttaaaatgcccacccttctaaccttcctctgaggctttaaccttatttatttataagggatgtgagttttagaatatgaactccccccatggccatgatttcaggcctcatgatttcaggtggtttagggatacccatattgtaatagaaaattagatttcagtctcatacccaagttgcagactggtctcagataacatctggggtcaacttctgtgctacctcatccacacaataatgatttattcctttggatcctggttgagtttccagtattaacactagtattaacagatgtttggtgcattcaccactatggtcagatgcctggaaccaatttgatgccttctgaattttgtgttccccactggagatgttcatgcagtatcatttagcaaatagttctcttcctttgcctcacttttcagcaggcaagctgatgattaagtgctcccttgggtgccattgtgttttgcctagctcttcccctgccatggctgtcactcttctttctagtgacctcctggtgccatcgtggctcagagtctcaagcttatcacagaccagccagtccctcgtgtcagttttctcagcttgttttgctgccagaaaaaagatttgctatttcatctgatttattagttcagctagcttgatttaattagcaaacacttatttatcaaagtcaccactagagaacttttgcttttgtccttcttcattttttcaggatcccagaagaaactgattaaaatgcaccccccagccaatcctcatttcttgttttcaaatttataaagcgtgtgttttcctatttcaatgaaatgccatttgtttaatgcgtaccacttcaaacctctctaattgtttcaaaacatgtattctaagttgaatgtgaagcactgcctattttattttggatttcaatatattgattattagagttacttacctatatttaggcatttaaatatctactcactacatgatacagaaataatttgattcaaatcctggctttatttcttaaacgcttatgatattgaatacctgcttaatttctctgtgcttcagaaatgatgattagtaacattattgctgtatctgattacagggctgtgggcattaaatgagaaaattcagagaaactgacacttgctaagagctagcttgtattattgttggtctctagcaggggcacctgcacatgtctaactgctgctggttgtggggatgcccatactgtcatagaaatggtatagcatcaattgttgctgcatcagtccagacaattgatgcctttgaatatgtagacattttggttgatttggaaaattttaatttttttttcagagtccttacatttccccctttgattaaactgaaaatccatgatcaatttacggttaatggaaagctggctataataactatagaagacttacatggtagtgaggcagcagtttcactaacagctgcatctgtgggaagtctatactgagaagactgtctctctttggaccatatttgcaggaaatagtggcctcaatgaaagaagaaaatatcaatttaaactcatttattattaccatctacaaaaacaaaatggctgcctatgagataattttttttttttttttttttgagacggggtctcactctgtcacccagactgaaatgtagtggtgagatctcagctcactgcagcctccgcctcccaggctcaagtgatcctcccacctcagcctcccgaatagctgggactacaggtgtgtgccaccatgcctggctgcctatgggctaaatccaagaagaatttcactcatatttctagtcaagtgcctggaatgattatttaataatcagtttagctttgcctgtatctatccttgagatgaatatttaggactgggtagtaatgaacaccttgtctttagatttttttttttttcttactctcaatattactggccttaagtttgactctccacatgattggaacagagagattctgcacgtgagagatggagtaaaggtccctctaatcctgcgggtttccttggaaggtctaatgactttgtagtcctgtacaaaggctgtcttctgggaggaacttggccactgcttacatctcactggcttgtagacagggtgaaaccagcctgttgcttcctgtctgagaaatttgagtaccggctgtcctgtcttatgattcaataaaagcctttgagaaatcagaaaactcatggcagagcttttgagacaacacctcagtgggattcagatgaaataatatgtaaagtcaacacagttcaatatccttataagcaattctaatggaattgcatttatctcattgggagatcctgggcctaacagctagactgtgttaactagactttggcttctgcaagagtagttgtagaagtgtgactctccattaaaggcaaaacaagttattaactcaattgtacttggtacattttcctcattataaggttgtctttagctggagttcagttattttacttttttaaaaacaattcttttgagacacgactcgctctgtttcccaggctggaatgcaatggcgcgatctcagctcaccacaatctccgcttcccgggttcaagcgattctcctgcctcagcctcccgtgtagctgggattacaggcacacaccaccacacccagctaattttttatatgttttggtagagacagggtttcaccattggccaggctggtctcgaactcctgacctcaagtgatccacctgcctcggcctcccaaagtgctgggattacaggcatgagccaccgtgcccagccagtaattttactttaagatatccaatcacctacagtttaaaagatccctgaagacaatctcttacttctaaaaaatagtttagatattggtctgagtggtagactcattctttgtggacctaattacattatctccagccatgctacttcctcaagaaaaaattcagagtgcaactactgcagctttgactagggacatttactctcttctccaaatcgtgggccgctagccgtctcgacatttgtttagaactctctgctttcctctcatggctaaggtgggtgggtcgttctctaatcagtagctcagcattttgatatttcaggtgcatgtcagggcattcaactataaattgccagtgagccatctcctgacaaaacttgcttgagacaggatatttgagagatacagtccagaaatcaagtgaaatgtaaattccttgttttttgtttcatccctatatggttagatcatcagaagcctgtacacttggactattgtctcagactgtgttgtttactggaaaaaggcatgtgtcaggatttatgccctggctatttatagaaaacagctatgaaaaatgcacatatatgatatttctgtgcttttgctctattgggattacagatattggcttttacgttactctctgtcctttttgaaaagatccacgtgataaattccatttatgatttcagtgttcgtaaccagaaaatagtttcccttcatatgaatttctaggtttcctttttattgggccatgggaaataggcacctcaatgtgattcttttttattttgggaaaaccagcgttaaatttagagctcaaggagggacctagtgaagcttattgtcttattcctttgtcatttaattttttcttttattttataacatctcaagtatgtggttttatttttttggaagtagacttggtataaattgtatatacatatatctccttgtgagttatctgtgtcattcccagctataatatatatgttagatctagaggacattagatagtcacattttgatctagatttgggtgacaaattatattacaatggggcctattatacttttcctttatcttacattaaatcatcagactcaagagcagttttatttttttatctttggttgattccagttccttgaccacaaaatgaagacatctttggtcattgcaaagctgccatccctccactcctcaccttattcccaatggctccctcaagcaaatccttcccaactgcccagctaacctttcctgtctcctctgcaactcccttatctctgggttgagtacctcattcttgttccttacagctccatgtggcctggaactgtggagagtcctgaaaccagctgaggcggatggaagaaggccagtgcggttgttatggaaggtgacctccctctggattctttttctctctctttcttccccttccctcctttccctcccttccctcccttccctcccttccatcccttccatcctccttcccttcccttcccttcccttccctcccctcccctcccctcccctcccttccccccaccttccccctcccctcccttcccccaccttccccctgcccactccctccctcccctccccgcctcacctttcccctccccactccctcccctcccctctccactccccttccccctccccagtccctcccctcccctccccttccctctccttcccttcccttgccttgccttgccttcccttcccttcccttcctttctctatctctctctctctttccctccctccccaccgccgcctttctttctttttggcagagtcttgctcaatcacccaggctggagtgcagtagtgaaatcataactcactgcagcctttaactcctgggctcaagtgatcctcccacttcaccttcccaagtagctgggactacagaagtgtgccagtacacccagctaattaaaaaaaaaaaaaaaatatatatatatatattttttttttttttggttgaggctgggtcttgctgtgttgtccaggctggtcttgaactcctgggctcgagagatcctcccaccttagcctcccaaagcattgggattataagcatgagccaccatgcccagcctgtttctttatactgtttaaaagcccttgatctcttacccttctaaaaactgtgattcttgaaattttacccccagaatttccttccctagagggctttatgatgccccaaatctcacattggttggccagctcaaaaaagccctataggtcatcttgcagatggcccaaacatgcatgacagacgctggtccccctcctctttggtctgaaacattaacattcggggtgggtagaaagtgaaagtgcaggaggcaccatgaccttctggaggaaacgatcactgaccagcctctgctggaaggcagcgtaagtctccggaacccccctccccacccagctgtctcagaagagctctgatcagggtcagcttgctggtgtgtcctcgagtcattggcaacatatatggcacatgtgtgttgaaatagtggggcacaaaaacagaagagggaccacatggtccttcctagggcggaggcctgggagtgaggaacaggagaagtcaggtggggaatgcagagaagaagaagagggaagaggacctgagagagggaagtgagagaaggagtagaaaatggggggacaagggaataaacagaaaaggaaaagggcagatggagaaaaaaagagtgaaaagatggggaagaagaaggaagagaggagtgagatgccagaattccttcgtgtgcctccagaattcccaggaaatgctcatgatgttagctcatatttgctgaagtccaggcaagttcaaaatcctgttgaaaatggagcaagtgtcctgctttgccagatgacattccaattacctcagggttggaggctcccgcaccatcgcccactccctccacacccgcagggctatgggactccctgggttgcggaggcggtgctgccgccgcatgggacaacagccagagatggcggggaatcctagagaatcaatcccagatgctgtgctgtctttctcagccatcaagtatgaaaacaaatgattgtggcaacacatttttgggggaggaaagccaacaacctcacacgcccacatgtggtcttagctacatagcagtggcgaagggccaagtagggcagcttgcgaagtagagaagatggatttcagtgcccgcctcctccccgtcgcctgttgggtctggtctttttctccacaccacccccccgcccccccgcaccttcaaaaggaaagagctctctaagaatttgagttggttaaaaaagaatgtactaaaatgctctaaaattaaataatagtgatagttgcatgactgaacatactattaataaaagccattgaactcacattaaaacagtgaattttatggaatgtgaattgtatctcaatttttattattttaaaaagaatgttatttaaaaaagttatttaaaatgttaatatgttattttaaaaagattttaaataacatattaatatgttattttaaaaagattttaaataacatattaatgttattttaaaaagattttaaataacatattaatatgttttttaaaaagattttaaataacatattaatatgttatttaaaaagaatatgtgttatttaaaaaagaaaatggggctgggcgtggactgggccggtaatcccagcactttgggaggccaaggcatggggatcacttgaggtcagaagttcaagaccagcttggacaacacagcaaaaccctgtctctactaaaaatacaaaaattagtcgggcatggtggtgcacacctgtaatcccagctactcgggaggctgaggcaggagaattgctggaatccaagaggcggaggttgcagtgagccaagatcaggccactgcactccagcctgggcgacagagagagactctgtctcaaaataaataaataaatacaataaaatagaaaatgggtcgtcttgagagataaaaggctcctggtcattaggaagattctagctgaccttttatgcctagacataaaagtaaaggaaattcctgaactgggaaggcagtgggacgaagtgcctgctaaagtcccacttataagtcctggacttatattcaggcattacgctccatctatgtgtataatcagtaacagaaggggaagccctataaattctgggaaatactgtctcctaggcaaatgtctggtgagtgggcccaagttcaaggctgaaaataagagtttagcttaaagtcctcaggattccaccttaaacttctcgccaagggtttgggactggcagtgcggccctcttagctaggacgcctggctggggcgcctggtccagggaagctggctcccttctcagagggagaggcatggaaataaaagactagggcatagggtactctccaacctttggatactccaggcaagagatgactcagagccagaccagactttggatgggctgagagggaatgtgtcagctttttagcccttactcctttacacgagtgggatggagcgaaagatacaggcagaaggaaataagggtggcttgtttacattgttttgggcattcttctagtttagcctcatggaattagatgaaatttagtaaatcccctcttctggcacttgaagtgttactatcacagcccaggatcttattcatccctggagggtaattacctgattgtagtttagtatctaatagttagccttattccccaccctcacccccaccgcttctcactgtctcaatgcctttctttttctttgttattggcaataaattttgttttctttgggttcagaaggcaagaggagccccagtcctagagaaaacacttggctacaacatatggtactatccagaaagcaacactaacctcacagaaacaatgaacactactaaccagcagcttgaactgcatctgggaggcgagagcttttgggtgtctatgatttcttataattctcttgggaagtctccagtggccaccctgaggattccagctattcaagaaaaatgtaagtagagcatcaacttcttccttaggtgcctggtcccatcaattggccaaggagcagtccctgtgctctcaagggtggctgtttctcttgagtcaaaatgaaaatggagtgggaaccttttaggttgtggtgaagcaatgagaatttgctggtaattaatgaatcacttgaagtcatgttcctttggaacaaagcctgcgttaaaaatcagagactttataaattacagaatacaaagccatacacctagaagttctgtgtgcagctttgatttgttctggtctgggtgaatgtaagctgggtcaagtcctatgaaactgtcctatttctcacatttgtcctccgtgaccgaagctgcccttgaactcttctccccacaaatgggtactcaccacatccccatccttggtttaatgcttgctgtcctgttttcttccttttccccttccatttgtcactatggaaaaattctagtgtttatacttgccaataaattgttcattacacttttggttaagtagtttttgacatattactgctcccaggcaaactcatatttatcctgttttggaataaaaaactttcattcaaagaattgcagacaatagatttcctcttttctctcttatttttctctttcaaacttagtactatcccttattctataaattatcttatttattttactacctttttcttcctcaataggatgtaaatgccatgaaggcagtgattttttgtctgttttcctttcttttttttaacctaattcccaacacttaaaatagcatagagcagttggcatagagcaggtgtgcagtaactatttgtggaaacatatcatagtcaggaatgttctctccaattcaccacctttctctatttgcttacacctagactggttcagacatttacacaaccagttctagaattctctgcctgtgctgccttccatctcttctccttaaaccctcattttataattcctagatatttatatttttgtattttgagctacacttgatattattttagttagcatttaatagtactccctgtagtcctcatttcctgacatcctagttcccgcctgtccaacaccctagtgatgaagttcctgacaaatgcacgtgtcattggggcacacattctttattaatagaggtgctgttaaatagtaacctcagtttcccagtgtggccccaggatgggaggtggtaaagaatagggtataaaagcatgggctttggagtccagcagccccgggttcaaatctttgctcttccacaagataccattaaccttgggcaagttacctaacttctctgaagattagctactcgtaaaatggagctattatataataatacctacctcacagagctgtagtgaagattaaatgagatcatgtatgtaaaatgctttgtctggtgctaattattactattgtcattattattattattattattattattattattattattaatttttgagatggagtttcgctcttgttgcccaggctggagtgcaatggtgtgatctcagctcaccacaacctccacctcctaggttcaagcaattatcctgcctcagcctcctgagtagctgggattacaggcatgtgccaccacaccaggctcattttgtatttttagtagcgacggggtttctccatgttggtcaggctggtctcgaactcctgacctcaggtgatccacctgcctcagcctccctaagtgctgggattacaggcgtgagccactgctcctggcttattgtcattcttaataaaatttctgattgatcaaatttctgttagacacagattatcgactttaaaaatattataaaatacactttaaagttatgctaaattcacttaggttttttttggctttgtgtcagatacgactgtgtgatcatcaattataagggtcctagatcaggtattggcacactgcagcttgcaggttaaatctggttggacacttgttattgtaaatgaagtttcactctaacacaaccacacatatttgctcacatattatttatggcttcttttgtgcaacggtggctaagttgaatagttatgacagagacgacctagcccacaaaacctaaaatctaaaatatttgctatctggctctttacagagaaactttacagatgctagtcccagacataaaagaaaataatgttctggatgtgcacgatggctcacgcctgtaatcccagcactttgaggccaagacgggtggatcgctgagttcaggagttcaagacaagtccaggcaacatagtgaaaccttgtttctacaaaaaaaaaaaaaaaaaaaatacaaaaattagccaggcctggtggcatgtgcctgtagtcccagctacttgagaggctgagggggaagaatcgcttgagccaaagaggttgaggctgcagtgagccgagattgtaccactgcactccagcctgagtgacagagcgagaccctgtctcaaaaacaaacaaaagaaagtaatattctacagaattttgcttactaaagtggaggcaactggagaatgagaataataactagagaataataagataatttttgtaagtataactatcattaagtaatagttatcatacattgtctactagtatgtgtcaggaattgtgctaagataacataggttttcccattttagccttgacatgactcatgatgtagatgctgtgagatctattttatagacggcaaagggattcaggcaagcttagtaatgtgcccaaggtctctggagtgggatgattccagctcggatctgcaggattcccaacttgtaccatatcccacaaccttagatgtgttattcataaagtgacttgaattccggtcacagatgctgtgtgacactgaactggttattgacctgtgcgggcctccacgttcccctcttggaataagggcttggaatgaggttccttctgctcagcacgccctgggttttgtgagacccgagacagcaggcagcggtggcgtggtcccaggcagggcatcggaaagcccggccactgtgtcataaggccagaggaggaagatgggcccaagttggggcagagctcaggatgggccaggacggttggcaaaggagaagcagcaccagcacgtgagccccgggtgactgtcttcatgcagatcacaagaaatcaatggctttcacagtcaaagcccctccctgcttcttcaaggaaggatctgtgtttcccaccacacctggggatgtttggagtaattgctcagaaagctcttgttgaatgatggaaggacccggcgattcgtttatattgagtagagtgatgacttggaaattccccttttggcgccccttggtgtggccaggctttcccctttcaaggttgactcatggtttcctggggccggcgccacgcccctgtggtctccgcagtctctgcagtgcacttggcgctttagacccggatctccctgctcctcagagctccagtgttggtgagaaggagtgtgggtttagacaccaacactggcttcttcaggccaggatttgtgggcaatcattttttaaaaaagtgcctccagggagatgaggaagctgcagaagcaggccaggacagggcagaggctgagatgaaggtgggctttcagggctgccaaaacgaagcactgcagactggggggcttcaaacaacagaactttattgtctcatggtcctggaggccagaagtcccacatcaaggtgctggttggccatgctccctaaagtctctaggggagaatccttccttaccccttccagcttgtagtggccccaggtattccttggcttgtggtagctccagtaactcccataaatccaatctctgcttcagtcttcacatggctagcttcttgtgtgtctctgtttccatgcccagattcctcttttcttataaagggcccactgtcttaactaattacatctgcaatggcctatttccaaatacagtcacattgtgtggcactgggtatatactttggggggatacaattcaacctgtaacaggtacaatctgagataaaagccccagggaggggggttcccactggatcttgcaggggactctatctagagtgtgagtgacatctcatagtcatcccagccaagcaaaacacaagcacacagtaagaaggaagctgagtgggtctgggtggagcgccaacattggctgctagaagagtctagttacatctccaaggctccagcagggactttcagccaggactggctgggtatgcttccaggcggtgagcaggggaaggctggaaggagaaactcagagccctagggttaggtggggtcaatctccaggctctgtgcttcttgccccggcctctgctccttctgtggcttcacatttcctccatgcctcagttgtccttctcagagttaccttttcaggttgacaacttacctggccttgctgctaggactagcccctggagtgtctcataaggaccctgtttgggaaaaggatccgtcaactgtggcttacaagaacaagactcctaaatatacacacagcctgctggggtttgttgccaaggaatagcaggatgcaggacccctggtccccaccccagattcctacatgtggcctaggcttccagcttcaaaagacttttgggtttctttttttttttttttttgcaggacacttttgtgcctgtatccaggatcatctctgacattcattgaaacactcttcctggctgggcgtggtggctcgtgcctgtaatcccagcactttgggagaccgactgagctgggcagatcacttgaggtcagaagtttgagaccagcctggccaacatggtgaaaccccatctctactaaaaatacaaaaaattagccaggtgtgttagcatgtacctatagtcccagctactcgggaggctgaggcacaagaatcacttgaacccaggaggtggaggttgcagtgagccaagatcatgccactgcactccagcctgggtgacagggcgagactctgcctcaaaaaaaaaaaaaaaagaaagaaagaaagaaaaagaaaaagaaacgcttttcccatggattcgagttttgcaggttgaggagtgcaacgctggtgaggattgggtgaggggagagcatgccctggaatttctgagccccgcccagtttgtaccttccacctctgccttgctgcacctccaagagttctcttctgtgtgttcgaatattttcagtaagatctctgtctgattctgattaagttccagatgttggattgcaagccacacactcaacttttctattaaataaatccttgtgacctgtttccagattattttggccagtcctgcagaaaatgttgccatttatgtattgatccatactaggtaatttggatggcaatgtctttatctttctggtagaaatgcaatatttgctgccttgaggataggaattcatatccagtttgtgcagagccagactatatagtgaaagcgtaaagccatctccctggtatgattttaaggtcaccatctcccagcttcccagccacacaattccccagagcctgaaattctacctttggagattctctgtttcaggtttcctttccatttcacttgcagagacacctgtggaaggtaagtctttttagtcatcaactgtctagtgagatccttttctggaaacaggtcaatttggggttaggtaaaggaagattaagaagccacttactcctcaaggtgttgtgtaaggaaaaaggatgcaataaggggagtgaaaagagccccatccggggaggctgcagtggagatcctgaactttggccttgttttacagctgaggcaatgaggatgccagtgtggttgttgcatttggggaatgagttgggtagctgtgaagcagtccttttctctcctttcagcatttcagtgcattgaggtcatgcaggcctgcgttgctgaggaccagctagtggtgaagtggcaaagctctgctctagacgtgaacacttggatgattgaatggtttccggatgtggactcagagcccaccaccctttcctgggaatctgtgtctcaggccacgaactggacgatccagcaaggtagccagggcggaactcacaggttccctcagtgcagggtttggtttcattttcatccatttttagatctttaactttggcttcaaagctgttagtgtggttaatagcatttgtcaagcttgtgcaagcttaatgaagtgacacgcttcttggtatttccaaggcaaggctggcacagaaagctgtgggtgtcaagcagaccaggtatctgatcgatctccaggtggaaaacaccatcttaacacccaccatcagagagtccttcccggatagctgggtcatcccatggataactccagaatgtggatcccagctggcctacctaggatattttcttcagttctgattgcctgtttaagagttaggcccccttcccaggtgattgttataggaatagccttcttttcaggaaagtccctgccctacgtaagatatgcgagtgaggctttactctttatttttaattttgtttaaatttttattttctagagacagggtcttgcttgattgccaaggatggagtgcagtggcacgatcatagctcactgtaacctcaaactcctgggctcaagtgatcctcctgcctcagcctccctaatgaggctttacccttttaatcctgtcaccacaatcatttcttaatgcttcaaacatccatattaagaataatacacaggcagggatgcaggcaagtagaggagatagaagtcacagtgtttgagatccacagggtgatgatatgttgttctagaacttaattaggcagcgtgttcagcgatcctatggatctctctgctgcaatagtatttggtcagaacagacctggggattccctgcctccaaaaaataaaaagctaaaaagctaaatttaaaaataagaattagttagaaaatctgagaaaagcaatagatattagagaccattcaacctaacctgtttattttccagaggtggaaactgtagagaaatggaatatcttctataagtgtttggccataactcttagtctagtattccccccactctgccgtgctctgcacttacacttttttttctttctttttcacagataaattaaaacctttctggtgctataacatctctgtgtatccaatgttgcatgacaaagttggcgagccatattccatccaggcttatgccaaagaaggcggtatgaatggacaagaccctgtggggaaaaggaaacagtgtgacctgtcccacatgccgataaggctgcaagtgcctgtagctcattcccagccatcttagggctcatttgtgcttcatcttgtagtgagctctgtatgttatgaatttgctgaattctgaagctggggtagacattagagatcattgagtccaatcccctcatttcacaaatggaaaattaaaactcagagaggtgaaataacttgcccaaagtcacaaataaacagtgcaaatagagctgctaccagcaataacactgaattaagaccacatcagggagcctagagttcatcctaagctagggatgttaaaaaattatttttaattatgtagcaataagcaaaggctttactggtgaattgctcaagctttacttttatctttttggaagttcatgtcttccagattcaacactggaaaacatcttctgccactcaaaggtagcctatggagccatattcttcaactatttgataataactacactttacagatatgaatgaaaaagctgggtaccaaattggagacatctatgagaaaggactttttcaagtggtcttgttgccacttctcttcttgcttaagagagatggttctagaaaacaattttcccaaacaagctgattcatcaattccctactcaaccctcacccgtcgcctccagcactatggtttggtctgagtactggccagggcctttgtgggggaacgatctcctggagtgcggttcagtgattatcatttatccctctgtcctttccagttccatcagaaggtcctgagaccaaggtggagaacattggcgtgaagacggtcacgatcacatggaaagagattcccaagagtgagagaaagggtatcatctgcaactacaccatcttttaccaagctgaaggtggaaaaggattctgtaagcacgcccatagcgaagtggaaaaaaaccccaagccccagatagatgctatggatagacctgttgtaggcatggctcccccatctcattgtgacttgcaacctggcatgaatcacttagcttctttaaatctctctgaaaatggggccaagagcacccaccttttggggttttgggggttaaatgagagtgaagtgacagtacctgagaggagagtcctgaggaaatggaaggagttgttataatttgtcctggttaggccctgaattgacctcccgggagctccccgaccatcattcccaggaatggcgtgcctggcttaaagagtgaggaggaacagaccctgtcaccatgacttctactgcccctgccaaatcatgcttttgtttttcagtccaccttatctcctgacatcttaaatactgggcaaggcttggattcttgcttaggctaaataattttttcttatggtaaaatacacgtaaaatatttttccagtttaaacatttgaaagtgtacaatttagtggcattagaagcattcacaatattgtgcaaccatcaccactatttccagaactcttctatttctgcccaaatagaagccctatacccattcattagtcactccccattcctctcctcccacagcccctggcaactaccaaactgctttgtgtctctatggattgcctattttggatatttcatatacatagaatcataaaatatgtggtctttgtgtctggcttctttcatgtagcatgttttcaaagttcacccatgttatagcatgattttgtacttattcatttttatggctgaataatattccattgtgtggatattccatattttgtttatccattcatcagttgatgaacatttagggtgtttcaacctttaggctattgtgaatagggctgctatgaacagatgtctgctacgaacatatgctgctgtgtacaaatatgtgtttgagtttgtgtttttcgttctttggggcatatacctagaagttgaattgctggatcatactgtaactctagtttaacttattgaggagccaccaaacagttttccacagtgactactccacactatacattttttactagcaatgtatgagagttttcatttccctgcatccttgtcaatacgtgttatttttcattaaaaaaaattattatggctgtcctggtaggtatgtagtggttatctcattgacttgcatttccctactgactaataatgttgggcatcttttcatgtagtttttgcccatttgtatatcttttttttttttttgagacggagttttgctgttgttgcccagactggagtgcaatggcacgatcttggctcgctgcaacctccacctcccaggttcaagcgattctcctgcctcagcctcccaagtagctgggattgcaggtgtgcaccaccacgtccagctaattttgtatttttagtagagatggagtttctccatgttggtcaggctggtctcgaactcccgacctcgggtgatctgcctgccccagcttcccaaagtgctgggatgacaggcatgagccactgcgcccggccagcccgtttgtatatcttctttggagaagtgtatttttcatcttttttcttatgtttaaattgggttatcttttcgttattgaatttataagagttctttatatattctggatataagttatttatcagatatatgatttgtaaatattttctcccattctttggattatcttttcattcttgatattatcttttgatgcacaaaaactttgaattttagtgaagtccagcttgatctatttttttcttttgatgtttgtgtttttagtgtcatatcaaagaaaccattgtgaaattcaaggttgtgaagatttatcctatgctgtcttctaagaatttttatagttctagttcttatattgaggtccttaatccatcttgatatttaagcaggacatgaataggggtcagaatatgagacagctgagcttggaagcacaggttccaatgctcttattttggtgctactgggacacaattttcagtctggtttggctgtggtgtttgacctttgtatttttcctttagccaagacagtcaattccagcatcttgcagtacggcctggagtccctgaaacgaaagacctcttacattgttcaggtcatggccagcaccagtgctgggggaaccaacgggaccagcataaatttcaagacattgtcattcagtgagtatttccttcaagccttaggtacctctccctcacgtttaccttacatcagagagaaatgacatctgccaaaagctggaggaagccaaatgaaagggcagtgcctagtgccctgccatcctgctctctgttcaccaaccttcctggaaagcatataggtgaggagatgggagggaagagcaggcaagttgagagccgaatttggaaatgctggtcattttggtcgttcctcatgggcagccacaaatcatctggaggaggaggtgtcaaattaatgccaacttcagtcttagcaccaaaccagctcccatctcaaggctgtctccccgttcatagtcaccagtttctgcatgttataggttacggtatgtattagtctgttttcacgctgctgataaagacatacccgggactgggtaatttataaagaaaaagaggtttaatggactcacagttccacgtggctggggaagcctcacagtcatggtggaaggtgaaatgcacatcttacatggtggcagtcaagagagaatgaggaccaagtgaaagtgatttccccctataaaaccatcagatctcatgagatttattcactactatgagaacagtatgggggaaattgcccccatgattcaattatctccccctgggtccctcccacaacatgtaggaattatgggagctacaattcaagatgtgatttgggtggggacacagccaaaccatatcactgtacaacagggccttcaagggaaaaccttggttaactcaggactactgacccataggaaggggcttaacctcatcatttgtggaggttttttttgagcaaaaagacatatgatatatttaacttacccacttttacattaaaaaatagcaagaaaaatttactagagacaacaaataatgtaaaataaaatgtagcttcatatgatggctggttaagggagatatttagaggcaggcagatggaatgaggagggggatgaagcagaaagaaggaaggagaatgggagaaacagatatatattaattttgctaagtccttgagtgacagagatttgatttttaagtacgtactaaaactgtcttaaagaatgaacaacgctttttagattaaaaatgaaggaacactgccaagtttttgcaataactgaggcaagctaaaaattgcttgaaatattcttgaaagcctcttatgcatcacatttttcaagaataaaatgctttatcactctggaaaatgtgagtatgacatgttttttttacagagaaaacatattctgttttgatggactaacattgccctctaggaactctttttgatatgctgtttaaatttttttaaagctgtattgaatttttgcaacactgggcacaaatttcatcagctcaaggagttttctccaagggttaaatgaaggcaagatccagccctggaacctagaagtttcctaccctggtctatagattataaatcaccctgcttccatttttgatcctctataatccattttccacacagcagccagagtttcaaaccctgaattctctgcttaaaagccacagtgacttttattatattttaaagaaaatccaaactccttcctataactttcaaggtctttcatcatctgtcccttactgaccacatttttcctactgctttctgcctctatttatcttccttaccttgttgctgcttcaaagcttttgcatccactgtttcttctgcctggaatgcttttctccatggttttgcatggctggatccttctcactattaagatcagcttgaatttcactccttccttggacaccttagctaaagttgctgtctggacgcagtggctcatgcctgtaactccagcactttgggaggccaaggcaggaggatcactcaaggccaggagttcaagaccagcctggccaacatggtgaaacccagtctctgcctaaaatacaaaaattagccgggcttggtggcacgtgcctgtaatcccagctaccagggtggctggggcaggagaatcacttgaacccaggaggcggaggttgcagtgagccaagatgcaccactgcactccagcctgggcaacagagcgagactccatctcaaaaagaaaaaaagtctaaaaattagctgggcatgatggcttgcacctgtaagtcctaggtacttgggaggctgaggcaggaggttgcttgagcccaggagttcgaggctacagtgagctatgatcatgccagtgcactccagcctgggcgacagagcaagacccatctcaaaaaaaatttataaaaattaaaaagtaagtgctcaataagtattcactgaatgaatgctgttggaatgaatgctgccaggaagacacctagatggggaggcacaaaattctgttttttgtttttgtttttgtttttgtttttgagatgaagtttagccctgtcgcctaggctggagtgcaacagcatgatcagcgctcactgcaacctccgcctcccaggttcaagcgattcttctgcctcagcctcctgagtagctgggattataggtgcacactatcacacccggctaattttttgtatctttagtagagacggggtttcactatgttggccaggcaggtctcaaactcctgacctggggtttttttagtggaaagaaattgaatttaactgaaagaaaactaataagacattgtgttgctgaagctactagaagaaaaagttaatcattgatttttgtcaagaaggtgaggaactcactactgacttttgttctttgtttttcaaaggtgtctttgagattatcctcataacttctctgattggtggaggccttcttattctcattatcctgacagtggcatatggtctcaaaaaacccaagtgagtctgcagacaacagtgggtgccttaaaaatcagggacaaaaaggggttgaagtcatcataggtgcttcgtaggagagggcactctaccattaaggggtgttcattcatttattaacttggtgcgtatttattgaggttattaaaggccacgctcagtggctcaccggaattctgaccaagcaagagcactttcgtttcccagagctccatgcccaggtctaggcctttttgaggccaggagagtgccagctgccccacaggctctgtctgctccatttgccatctgagactggagttggagagcagaccctttctctcagtgtctagcagggcccctggctgcagcaagaggccttcttgcgagctctgtctcaggcagagcggggagcagtgtctccacggtgttggagtgctggccagtcgtctgtgggtgcaagcttattgcttgcttgtggtgcagtgttgagggtctggctgcaggggcctttaacctgcttgccctggccactgtggggaagaaagcatgtcttcagggtcttagactttctctctgcagtgagccttatggcaccctaatggtcctcccctggttgagctgtctctccaaattagacagttgtgagtcatctctgtcaagcagctgcacttagttaatggtcaagctaatatcaacctccgttaccaactgtaggtaataaccaagccaccagcatagattcttgtacattatgcacttaagtaatcattttgatcttagcatgcatcagaatcaggcctcacccccaaagtttctgattcagtggttctagggtaaagccccaaaatgttcatttctaacaagttcccaggtgatcccaatgctgctggttgggaccacacttggagaaccattgcaggaaagtatgggtagcttataaggtttataaaatgttgtctttcccagaggataagcctcaaaggaatgactctgtgatggtgcaatttacagcattgggaccaggtatggagatgctgggatgggagagaggggaagataggctttgtatggggagagtctcctttgatcacatcccacagagaacttgcaatgtcaccccccaacacacaccgcaaaacaactccactttcccaggttctattaggcagacatgcccttatttaggagggaaacttacaattccctttagcacagcctcactcttttgactcagccatatggtgctaatgcttcttggattcaattcccatcttaaaatcttctctctcattagcaaattgactcatctgtgttggcccaccgttcccaaccctgctgaaagtagtatagccacatggcatggagatgatttcaaggtaaactctcctgtttttattaaggaaatcattgccgtgggaggtagacgaggtgaatggagatggggaaagagtcctaggctgagcttttttcaaggttcacatcaagagaactggagttgaaaagtctcagggaatggcaggcagggcagatggactcagccttcctggaatgactttgacttcatgctttgacaaggggaaagggcttcaccaggctcatgaggacccagtgcgttcccaggtggaactggtcccataaaggatgctgcagaataaagacactggccctacccttcctgacctgatgggctaattagagagagaggagccttggctataggatttgaagccatttacaaagcagccaagagcacattaatctaaagactgtctaaatatcaccagggaatgttgatgggcatggcagtctgaggctgcctcaggttgtttttctcaggctggggacgtcagagtcaggctttatttaactggcattggggttttctagtgagtattccttaactagaaaccctccatttgcataaatttttaagtggaaaaccgttagggaaattttaaggtttaatttcttgcttacgtagaaacaagcccaatcaaatataacctttaaatccttgttactgaaaggctgtttccagtttttccttgatgcacaaattttaaatattagtcctcgttcccactcagaagtcttttttgagcatgggccttttgttataatgggctttctttctgtttcctcctcttatcagtccggtatactggactgatttatacccccatttactttcctgcttattaaatgtcatttagagagtaaatggattcataggcagtgctctctgataactaacatgctttttgaataatccgtaggttggacctctagagccggcacttattaatcactcactacatgccaggtgctgggctaggccctagggatacaaatgacaaagtcactgtccctgccatgaggccacttctgattttctggtgaggttgaacaagtctgtctctatgatgtggtttttccatccctaagagttctaattttagttcttccatcttaactggggttttgtgaacatgggattgtgtggaaaatagccttgcacactctagcagaagaaattgtttgaattggctgggtacagcggctcatgcctataatcccagcattttgggaggccaaggcaggggggattgcttgagctcaggagtttaagaccagcctgggtaacatgacaaaaccccatctctacaaaaaattaaaaagtagccaggtatggtggtgtgcatctgtagcccctgctactcaggaagctgagggggaagaattacctgaggctgagaagttgaggctgcagtgagtggtgatcatgctactgtactccagcctgggcaacgggagtgagaccctgtctcaaaaaaaaaaaaattatatacatataaataaataaattttaaaaattgtttgaatccagggcactgtttctcaggaaatgtgccactccttccaagctctgtggaagggcatgcagagagggttggctaccacttctgggcctgggaggaaggtgggggctgttccagagatgggcatttgctgtcccaagcctaacgagtttttggctatgtcatatgtgactcctaaatgaccacttgggatgtccctttttcttttccaggataagctaaacctgaaggagtctgatgactctgtgaacacagaagacaggatcttaaaaccatgttccacccccagtgacaagttggtgattgacaagttggtggtgaactttgggaatgttctgcaagaaattttcacagatgaagccagaacgggtcaggaaaacaatttaggaggggaaaagaatgggtatgtgacctgccccttcaggcctgattgtcccctggggaaaagttttgaggagctcccagtttcacctgagattccgcccagaaaatcccaatacctacgttcgaggatgccagaggggacccgcccagaagccaaagagcagcttctcttttctggtcaaagtttagtaccagatcatctgtgtgaggaaggagccccaaatccatatttgaaaaattcagtgacagccagggaatttcttgtgtctgaaaaacttccagagcacaccaagggagaagtctaaatgcgaccatagcatgagaccctcggggcctcagtgtggatggcccttgccagagaagatgtcaagactcggcacgcagcgcttgcttggccctgccacatcctgcctaggttaaagtttcccctgccccttgagctgccagttgaacttggtcggcaaagatgcgaccttgtactgggaagaagggatggtgataagcccgagttttgtaaaggaacagcagtctcttttcgtttgttcagataccaagctctcaccgaggcctcctgacagattgactttgaaggaagggcccaggttctgagcccaaaggacccccagggtggacatatctggcctcccaggaattgggtcatggtcccagcctttgctggggctgagcctcagagttccagaaggcctttccctgctgccagaggacagttgttttgttggctcttgggtggtctggtgggagcctgggctctggtcttcccctacaaggtagccctgaagccttcctctctccccatagttggggctggaggtggagtggaccttcctaaggggttgtctgaggctcctcacatcctcttagatctcaagtgcctgtagcaacaccgcacctgagaatcctcacccccaatttagactgcattgactactaaaaaatcaaggaatggggagggccctggggaatgtatgctgccgggcgcagctctgtccagtctccagggggccacttcccagctgctgctgcccttctattcagcacccagcctgggagcagaaaggcacctgacattgcagtggttgtcatatagggacgctggcccctcacactggttcagagcccaggaatgcttacttaaaaggcctcttcccggaagcagcagggcagggcctgggaacatgcaatgcctagcaaatttgcagccccaacaggaggacttctgctccttttctctagctgagcacagagcttgtgacagttagtggagcctttcacgaaagtgtggattgctggcttcagcactgagatagtactgggctcctcctgtaactatagtgacagagtcagctgtgactcccttgacctttgtgggaggccactaggaggctggtgagatcagggcaggcgaggcaatgagtgagtggcccaaggtgcagtgaacccagcacttgccagccaggaaggctgatggtattttttctaggagagtttgaggaatcagtactaggattgcaggcatgaacttcgcaagccacccactcaggtgtgcaaaacatcactttactttcctaaaactaaaattaattgccagcctgagacctgacacttcaaagtaacctcagcccagtatgatgatttctgagttgccgtaggtttgtgactcagtcacatttggggttttgccctcccctgtcctgcctgggactggctctgagtgccgaggatgttcaatggcgcagcgtgcatggggcagagttggtcactcagtggcatcctctgggtcatgtatttgtccggccgtgtttttgtctctggcctcgtgtgtttactatggtccctcctgtccctgttgggtcacctaccacttaccttagccaattgctgcctcgttactgtgggcacaggaaggtgtggctgctctctcaaagctctgtcctcctaacatctccagcggctgcagccacccccccaccacccacccaggactcagtactcctggtttacggaacagtgacttctggtacaccaaggaatgagggaggcccgaggcagggcactggggaataagactctagggcaatgcccctgtcccgttgtcctgcactcaagtccaggtgtaggaagggaccaaacaaaagagatgcgtccaattctcatgccgcccctgatgtctgctctccctgctctccctgttctccaccccttctatggtgtgggctcttctgtgagcccactgtccccagagttccagatggggcctttggcaaccccaccttcagattcatgaacatatggggagattctagccttgcctcctgtcttggcccgaggatgggggagggcacgggtacccccacagctgttctttcaaccctcctgcccacctgtagttgggggaattttctcaaattctgtgggaggtgggtgagaggagagcctggaacaagttctcccaaacttgtctgtctcacacctggatgtagatgaagcttctgaacctaaaatctaagaatttgatgggagagaaaatggatccccaatggctcctgtgagtggattccagagataaggatgttgccctctggcccctgctccttcatcatcaaagctggaagcgtcttttgctggacaatttgcaaatccccacccagcccttcctgtttcatttcttctttcctttctctcctcttgcccctatcttgtgctttgttttcccccactgccagagcttctcatcttttaacacttgctattgttttcttgtttcttttcattcctttctccccttccatcagcctcctttgatcattttccatggttttattacctttgaggggtgggaagatggtggctctgtttctttctaggtgagaggagctgtttctatgagtccccaaaaggcactggtgggccacaccttagctctcctgagcaggttcacaggatgtgagcctcagagttcagggcgcaggtgacttcctctcctggatcgagtcaccaactgtccccgctctgggcaccagggactgcctctgtggctggagaaggccatctgtgttttccctgtttactgtcagagacattgtgaggacacaaacaggaagacttgtgttttagcaaggttattaaaaatggataaaccagttttctgagaccctgggatccatgcagacagctaggttagtggcctttctttaacagtaagagcagaaaatttttaaagaatgacagagaaaccagtctgtggcttaaataaaaagaccacaagttccttctggtgtcttgggaggcagcggtgtgaaaacaccacgcaagggtctggaggaggcaggagatggggagagatgaaaaaggagaggcccacagtatggatgcctccggctgctctgctgatgctctgtgtgcgaggaaagcctgtgctggcctgtccaccccagtctgattctgtccccatttccagcacgcccctagttactcctgctgcagcaggcaccctgccacccagggcagtggcccacgggccaaatccaggccctgtttttgtaggttcatgaactaaaagctataatgacctatttaatggttgaaaacaaaaagaataacattttgtgacaagaaaagtccaagaaattcacgtagtgttgacaaagtgtaattggaacacagccatgcccatcgttgacctattccctatggcggcttgcccctacaaaggcagagttgagtagtttcaacacagagtttttcccacaaagcagaaaacgtttactctctgaccctttgcagaaaaaatttgtggacgcctaccataacccacagacatgaaactcagactgccactatgtttcaactttgaattagctgcaaattaaaaagaaatcaggatatgtcattctgaatttctgaccaaataaggactgccctctttgaagggtgcacacacacttactggttccccaccagccctcctaaattcctgtccccttcccatagctaaggtcgagagttggtggcttacaccagtggtctttcaacaggagtgattttgacccccagcctccaaacctcagacatttggtgatgcctggagatatttttgattgtcacgactgggaaggtgctactggcatctagtgggtagaggccggcaatgctggaaattatcttataatgcgcagaacagccctcacaacaaagaattatctggcagaaaatgtcagcagtgctgaggctgagaagtcgtggcctgaactaccctctgccttctagatccacacacagtgttcacatgggtgagactcccctctaggtgtcccctcttttttctaatttaaaatttgttttaaattcaactttacagcagtaatcccaagagttttaaatagcaattatttgtcatgcttaattaactcctaacatgatctgtgtgcacctgtacacatttttcagctaattgcaaatcatactgaatacattatgttctcccatatataaaaattcatgcatgagcaaagcattttgaacatccatgaaaaaccccatggcgggcctgcatggtgtggtttgctaaggcatcccttggttgataggattcgtttaaaggtcctcctagtatagagtgcaatgcgataaacatttatcttttcttacctttgtcctgtctctttggggctgttttcaaaagtggaattgctggtcagaattttatggttgtcacattttgcgtgactgtgtcccatcaaaggttatgctgatttacagtatcaccagacatgtctgacggatcctttgtccttttccactgagaatcagctgtctaccactgtgagcttgattttgtcaatttatcgggaatagttaatgaaactttatagttatttgtgttgctttaatccttgtgaagccaaacttttctttttttattgttgccatgtccctgtgttgacattacagaatgttctctgcctccgtgctcctggggacattgacagaccagctgagttgctagaaataagagggactcagtaggcccttagcacagcgggtggactttgccatttggttgactatttaaaatacttgtttttgtagggcatctgaaaaagaaatttcacactggtgtattttgttaattgtttctacgtaaatgttgattattgacaagcctacttgtaatcaaaatgtgtagtgtggtcagtgtcttgcactcttatgttgtggcggggggggggggcggttcctgaagagtggagtgtgactaaggataacagcagtcctcatttcctttggacactggggtcagtggggagagagtttgctccgaagcacaaacagctccaatccatgctggaagagaccccaggccacaatagcccttgacacagagctctatgcagggctgtgctgcccaagacgcttgtcgtgtgctgatgaaaagggctggggagaagcaaggggcaggggaggggcagaactccacaagagggcaaaacctgctgtcagcaatgctctcgtggctgttcaagggaagtgagatacttgtactatgcatttcatttttaggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactcagccaggtgcagtgactcacacctttaatcccagcaccttgggaggctgaggtgggcagatcacttgaggtcaggagtttgagaccagcctgggcaacatgctgaaaccctgtctctacaaaaaatacaaaaattagccaggcgtggtggtgcgcacctgtaatctcagctacacgggagtctgaggcaggagaatcacttgaacccgcgaggcagagattgcagtgagccaagatcgtgcctctgctctccagcctgggcaacagagcaagaccctgtcttaaagttttacctactcagctatctaaactgaggctccacaatgtaaatacgtgagagatcagggaagcctggtggctgtgggaaagggctccagttgaccaggactcggcagctcattacactctttgctgcaggaaatgactcctgcctgcatttcctgtggaggatccgagacccacgcccgggctctcattgtcttcctattccaggctccttcccgctcctggagctgccgctgggtctcagctctctgctctgaggctacgccgcagctacagctccctgacctgttcctgttcaggctcccaggaaacctcagagtggcaggtgcctgctgtttcctctgtctcccgcccatcccaccacggcctctcctgtactttcaatttgtttttctttagccattccttcccttcagcttctaaacacagttgggtcacttccattaaagaaagaaagagcccctggatcttcctctccctctggctgcccacagactcttgtcacaacgcaggccgtggtttaaagggaacgtggtctacagcccgtctggcagcttctccaggcagctgaacttgtttccgtttttggtagtgagaaaattgcaccgctagaactttctagaggtgtagaaagcagggagtcactcaacccattctggttcgggggactgccagattttttttaaaaaaaagggggtgtagaaagcaagtgagaccaaacaattttgggacaaggaatacggacacagaacagactggtaagtacccaagtgtatgacaaacatccaccatggatctaggagaagccctggggcagggtgatattcacccgcagagacccctgttcatcactaagcttatgaagaaccattgactggcatttaacaccaggtgctgtgctcaaggtgtggcacgcagtacccagtaagcctcacaactgcattgtgagtaggtagctctggccagtggcagatgaggaggctgtgctcagagaggctagatgacttggcggaggctctctgaggctctaagcgggaagtggggggttggagcccagccctttgactttccttgtgcttttctacctcgggtgagtaagatgaccaagggactggggagatcaagaggagtggagactccaaggggacccctttttggtgagacgtgtagaccattcccctctcccctgggtgcctgcagagagctcttgagactggttttagagccagtgaggtctaagagaaatgctgacggcaggtgtggggatggagaggggaaccatgtccatgttcacagccctggtgacaagaagacagaagcccccagggacccagagcttcagaagggtttacgatggctacagaagcaggtagtcccatgacggtgtagaatctgtaagcacccccaggagctgggcagggcaaaagcaggtctgctggaagagtggatgtcccatgactgttggaataaggtaccacgtgggtgcctcctcccacccctccttccccctcccccacccccacgcgcccttggggcaaagcgagactcgtatcaaaataaaaataagttattggctcacgagttacactttcagagtccacagacttagcaaggattcgtgtcctcttgccgctgtaacacatttccataagctcaatgccttaaacaacaggaattgatgatttcacagttctgcaggttggaagtcacactgggctacagtccaggtgctggcagggctgtgttcctctctggaggccatagggaagagtcttccttgcctcctccagctcctaggcgatgcctttattccttggcttgcggctccttcctccgtctgcggagccagcggtgttgcgtctctcagttctgcagtcacactcgctctgtgtgcaggacctgggctgcacagcatgaaggccccaactaaagcctccgtctccatgtagggactttctcccgagatgccaggtttgtccttttaggagttcctggcccatagaagactgtggctatatagtcttatgtgagatcagaacccaatgggagcttgatgggaactgagcccagaaacccatcaaaatctcatcttattgttgtcaaagctatagggccaaaggatctagggcctagaaaacctagccctagatccatggcccagggggctcactaacagtgcccctagaattagacatcccaggtccctggcccagctggattcccacaggccttgctctgcagggacaagatcctgagagagcaggaggggcagactctgggggtagaaccaggggctgtcttggcctcggcccatcagaaccacaagcgcaggcccatggaagggcgaataaggggaagtccaataacaataaggtccaaatgaacttccatctgaattcagaattcttaaggattagcaagtgctggagtttgtgcagggctcaggggtccaggaaggtgcaccccagttagtgaaaagcctagggtgctggttcagtcaaaaccacgactgcatatgtgcacctcacacatctcccaggggcttgatttcaaaccttccttcataggaaacaagccacaggacacaaaacacatccagttggccttttgaaagaaataatatgtatttacttagaaacaaaattgcacttttccctataagtcaacaaatgctaaggattctggacgtcaaatacctcccaagacgttttatcagccagactttgttgtccttcaggaaaaaatatgagttccaggaaaaatgacaggcatgcaggatgctgatttccttcctgatggtaagacagcagcctcctagactgacgatttcgtgacttctcaggggctgggtccggagaacaccttactttaaacaaagggagaatgctctgtccaaaggcatcttctcttgaacccaaagcaatgttttcccatcatatatcagaattttcactcttttctagatccttatcccctcactaccccttccccatcaaaaatataaaacaagaaattttaaaaaaatcttttttttcttagaaacacagtctaactttgttgcccaggtcagagtgcagtggtgtgatcatggctcactgtagcctccatctcctgggctcaaggaatcctcccacttcagtctcccacatggctgggattgtgccactacacccggctgattgttttgtttttttgtagagatgggggtcttgctttgttactcagaccagactggtcttgaactcctggcctcaagcaatcctgctgcttcagcctcccaaagtgctgaaattacaggcatgagccactgtgcccggcacaaaatcttccaaaaaacaaaacaaaatgaaaaccccaggagtcctgaatatcatcctttgagtcctcctgacctccttgtctgagagagccttgagtgaaggagctcaggacggtacccctgaggcctgcactccagcctaggtgactgagcatgggtgacccgtcactgtgctgccgacagcagaatggactgacagggcttccagatggacaccgtccctgtaagagcatcttaatgcctcaggctaagtcccatgtcagagtcagggcttagctaacttaacaggtgggaagctaacttaactcacggcatgtttacaagtgtgataacatttataaattctaaaataataaagctaattgtattagtctgttctcacacttctaataaagacatacttgagactgggtaattaataaaggaaagaggtttaatggactcacaattccacatggctggggaagcttcacaatcatggtggaaggcaaaaggcacgtcttacttggcagcaggcaagagagaaggagaaccaagtgaaaggggaaaccccttataaaaccatcagatcggccaggtatggtggctcctgcctgtaatcccagcactttgggaggccgaggcaggcggatcacctgaggtcaggagttcgagaccaacctgaccaacatggagaaaccctgtctctactaaaaatacaaaattagcctggcgtggtggcacgtgcctgtaatcccacctactcaggaggctgaggcaggagaatcacttgaacctggaaggtggaggttgcggtgagctgagatcgcgccattgcactccagcctgggtaacaagagtgaaactccatcgcaaaaaacaaacaaacaaaaaacaaaaaaacaccatcagattgcgtgagacttattcattaccacgagaacagtttgggggaattgcccccatgattcaattatctcccactaagtccttcccacaacacgtgggaattatgagaatataattcaagatgaggtttgggtggggacacagccaaatcatatcactaatgaacccacttaattaaatattcttcaattttgtgattttcttttcttggttatttgccatcaattgttttcttcaggtcaagcatatttttgtaggtccccaaaaaaactcactggcctgggagcctgcctctctgttgccaggtggatagaatatctctggctaagtgttgtaatgaaaatgccctgctggcgtctaattggagaccattgccgggtggtcccaggtggagggcatagggttggggtcagcttgggctgtgggtggagaggcaggaggtcacctgcaggctgacaggacccagccatcgtttcccctcgtcccagactaggtgttaaacgtgaagcattaacaggtagtcctgatgggcctttctggagtttgctaaactgaggtctggtgagtgagtctgacgctttgggtggttctgtgtgcaactatcacctggaccctcctgtgaacactgtcaccgcagataaggaccacgcccaaagtgtcccaattctgaatgctgtatttgtacagggatggggttaggaatggaaccttaggttaagtccccccaaagcaaatcctgagacaaacatccaggtgtaactaattcatccagggcacattcccaagagaaactggtgagcgagtgagggaggcttgagaggaggggaagacgccagggcagggtgggatttcaggcagagccctgcaggtcagcgccagtctcatccccagatgatgctggaggtaagtgactcagtccttggcgcgtgtcctccccaggcaaggggcctgggctatcacactcctaagctcctcagtctactagtaaacagctgtccccacagggtatgaaacctccaggcacatttgactgtgtgcttggaggccaggagtcaggctccggtagcctgagggaagctgtggaaagataactgcaggtgcccgcagtggaaagcaaagcccagggaagctggtggagatgggggcagatcctgttgccagatttggcaatacaaaatgcagagcacgtatttacataacacacaccaggtactgtcctgtgtgtttttcaaagactatctcgtttaatcccagcctggccagctctggagtgggtgctcccctagttgtttttttttgtttgtttgttttttgggtttttttttttttttttttgagatggagttttgctcttgttgcccaggctggagtgcagtggcgcaatctcggctcaccacaacgtccgcctcccaggttcaagtgattctcctgcttcagcctcccgagtagctgggattacaggcatgcgccaccacacctggctcattttgtatttttagtagagacggggtttttccatgttggtcaggctggtctcgaactcctgacctcaggtgatccgcccgcctcagcctcccaaagtgctgggattacaggcgtgagccaccgtgcccagcccagtgcgcccctattttgaaggtagaatgtagtcgtttgaagcaggagcactggggtcagactgaattttaagccccagcgttgctccctgctcctctgttgccttccacgagttcctcaacctctctaagcttcagttgctttatctgtaaaatgggtgaaatagtatcaccacaacaattggggcagtgaaacgaagcagtgattctaccacttcattctaccactgtttgctgcacatagtgcttggcacatagtaagcgcggggtgagtaacagtggggcttgttgtcatcattacagatgaggtaactgaggtgaggaaagcccatgctgtttctaaagggtggctttgcattggttttcatttctgtgtggggccaggggaggggtggactctggggaggtgtgaacctggctgtgagtgcatagggcaagagtcccctattttccagccccctctcagggtctccttcctgatactgtccacaaacaagaaggggtccgcccagtctgaaggaccccagaacctcacggcaggcctggggaggctaggcggcgatgctgaaataaaggaggaggcaaggaggagaagccgggcaggggattgtctagaattgtccaaaaagaggaaacgagctatttctcagctctttgcctttagtgcttgcctggagatgccattgttagggtcccaggccagtcccacaatctagaaaccctccctccccacatttcatagacacagccatagtcgtggcatggacactgcatgagcccctgcaagcaatgcacaggcctcctcaggaggggaggtgccacctggtttctggagcctcaggcctccctcaccctccgcaggatgcttctccttggacatgatgttcccaggcttggaagcagctacccttccttcacctcacaggctcattgcccctctctttccctggagcctccagctaaccagtcgccacgtctggccgcgctgctcctgagctggctttgctttcctatttttctcctggcctcagcccccttcagacttcaccctgatgagaaaagtgctcctgagtagtgtcctgtctcaggcttaccctctcttgtccattcctcaagtaggtgttacaataatctcaaagacaagaaagaactagaatagtccccatctcatgggatgaatgacggaaagcccagctccccagctggtgacatcatcaccaagcagggcctggactggggcaagtctagggctcccaacagaaggaggtgctcactttcggggtcacgcaagggcaccaagtacctcccatgactgtgtgccctgggtacctctcttatctcacccactgtgtttcttactcttctctctgctacgggaggccctttgacatcaccagattgtgacctttcatttagcatggaatcagtagaaaatctgacacctgcagaattatctgcacgaagaaagcctccttgtttggaaatggggctggcttacattcacacatgactctattggagaagacagaaacctgtttgatgttgccttaaatgtagtaaaaatgttgtggttggactggcacagtggctcacaactgtaatctcagcactttgggaggccaaggcaggagcatcacttgaggccaggatgttgaggctagcctgggcaacatagtgacactccatccctacaaaactttttttaaaaaattagccaggtctggtggcacacgtctgtcatcccagttgctttgggggctgaggcaggaggattgctccagcccatgaattcgaggttgcagttacctaagagcgcataactgcactccagcctgggccacagcatgagattgtgtttcaaaaacacggtggtgattagacgtctcttttgaacctgcctcaaggtcagaggtgtatgattaggtgccaccttgggcattcctttctgtcctgggagtagaaaaagtgtaagattacctccccacgagcacttgagcatgggttgtagataaatccatctgtgtccctgctggggctgatggagatatgaggactgaggggtcctccttgcttgaagtcacatctttggcaaagggctggaaagagggcagggaatatctagatgttgctcagaggggtcaacaaaaattcttccggccagtcctgaaatacaagtctcattgtaacaataagaattatagtttagtctgacccagagaactgaggcaacattgatttgaaaacagtttgtgcacactgctggctctcctggtcaccagctcatgcctgcacgacaaaattctacagaagatgcttttcctccaggaaggcatcccgatgagcacagctttttgcccgaacataaaatgttttctgaaaaatctttccccaaaaaagagggagtgctttagtaaagtacttacaaagtttctcatatcacagtttctctcttcttatttatttatttattatttttctgagacagattctcgccctgtcacccaggctggagtgcagtggcatgaccttggctcactgcagcctccgcctcccgggttcaagtgattctcctgcctcaggcacccaagtagctgggattacaggtgccgcaccaccacgccaggctaattcttgtatttttagtagagacggggtttcaccatgttggccaggctggtctcaaattcctgacctcaagtgatctgcccactttggcctccgaaagtgctgggattacaggcgtgagcctctgtgcttggcctctcttcgttatttaaacacaaaagttctgtttgcgaaagacccattcactaaaatgacctcatccaatgttaatttttaattttgagaatcacacggagatcaccagaaggaactggcataaaaggagacaagggatttagtcattattcctgggatatgatctcaatattaactaggttagatttcagtgtaaagttttttaaagaccattttaaaaagcaaaatggtaacaggttacattactgggatggggggaaagtctcttaagataaaagtggatacttaaggcttgaatactgttttccacgacagcattgtctgctgtctctcacacaactagatggaaatgttaggaacgagctcccaaaacctgtgcctatgattcacaaaggggatctggtaatgacgaggaaggacctcagtgtccaattgcaagtgaagagttgcatggaactatcttcataaagtacgagtgaacaaaatcaattctatatttctgcattgttccacatcatcttatttaaaatatggatcataggcagacatctgactatttaatcaacatctgtaaagctcacacagttaagctgtccaaaaacttttcttgggatcttctcgttgaggaattgggggattgttttatactgggagctgcctggtgtttggccaggggttggtcgtagcctggtttgtagggcctgagcctacttgcactttctgatgtgttcttaaggcggagcctgatcctggttcactccgtcttcctcactagacagtaacttcccaaagggcagggccgtccttttataacccacaaacccagcgttttctcctgtgctgttggaaagtttgctggcccctcttctctggacctcattttcctcgtccaggatgaggagtttggataaaatgatttaataaggatccatctgactttaattttctctaaatttttgcttttggattgagtatatattttgcttcaaatgaaagctcttgccaaggcacggtggttcagagatgtaatcacagcactttggaaggccaaggatggaagatagcttgaagccaggcatttgagaccagcctggccaacaaagtgagcccgtgtctacaaaaaagaaaaaagaaaaattagccgggcatggcagtgctgcctgtagtctgagctacttgagaggctgaggtgggaggattgcttgagcctgggcaacagagcaagactctctctctcttggttgggggaagctcttgcctgtagccagggtgggatgggaatcaggaaatgatcccaggtttgagatgcgaaggaggcagattcctgactgcctatggcactgtgcaactctggattagaagaaacctgagacacattttaaacattttttaaaattaaaaataacttgtttattcacccacttacctgttcatataagcaagctctgccaaacaccgagcactatgctgggccaggagaggactgagctggggccctctctccagaggcccagcagtaggtgccaggatatagaaggcccttaactcagggggaaggagagagaagaatggaagatttccctcaagagggtatctatttgagttgatttttggtgaaccagtaagaatttcccagcttaacagggactggggactggagaacattctaggggaggaaatcatgtgcatgggctaggttagaagaaactcagtatgttctggaaactataaagtgtgcagctggggggttggaaaggtccagcgaggccccaaaaggacagaaagcaaatgtggggaatgaggtcagcacagcggggcagcagcaggcagcccctctgggagtggcaggagatggagaggagtggctggcggcaccgtgaaggtgaggcaggctggaacgggtgctcgcgctaggcagcgggcccggggaagtctgtggacagaaccacctggggtaggaccgtggtctgagcacccaggaaaagcccctgccggagatcctcctgtcactagttgccatgggctagattccaccattagaggagtctttctttggccaaaagaatgagactccaggggtcgtgtgagggtgcattctcaggaaagtgggacacattgacctcttttgcaggggttgctctatagggtcagagcaaatgtatgtgctagtaggggtggggagccagcctcggagtaaaccttgagggcataaggagaagtactgctctgggctcgaggctcagttaggacacttcaaggtaggcaattgcagggggctgcttgagggcacaaggtgccccatattcacaaataagggtggtggggagggagatgaggggaagagaaactcagaagagtttgaagggcctgggaagcaggtgtgcattctccttaagctagcctgggcatgacgtcatcaagaattttgcttaagtggttgggtacaattggtgtacacatcaaagaatgcggactttggatcaggttggagttggaactccactgtttgtcaaccacatgaccccgggcaagttattcaacctcttggaggctgcatttgtaaatggtgctggtatttacctcataagtttctaggatttcataacccacagtaaacacttcatagatggcatatatttgctcacctttggacaccctgctccggcatgtggcccccagcaggtgatcagaaaggtctgccggttcatttgaagaggagcggcccctcacccccagcagcaatgtctagtctcgattctgaccgtggcagttaaaagtttcttggaggtcctttcctaggcactgatgctggctgggtagccctggtgttcgtatgtctagattgaacaactggcaaaatccacactgactttgacctgaagagtggctgacttttcattctcagaacgcttatgcagaattatggtttctattgtcagaatctcagtgcctttttatttaaatattccccttcatgccattcctttaaaagcattatccctctcataaagcttatagagcctatttccaagaattttctataaattcatttaaaagctatcattagtcaacaggctgcttctgactacaggcaagactgcagggaaaaccttttcctacggggaagggacccagatgtatacttaatagttgtgtcttggacctgttactaagtgaagattgttctaggaaagtaggcctggactgaggtattagatttctaatcaacaggctggtctcattcagagtttgaaccagcactctgggggagaaaccacttgtggccgttgaattactctggctagcctgtctcagaaagaccatccacagccagggctaatgagacagttgaagaaagagaaatactttacctgagggttttggtttttttttggcttttatttttgtgtgtgtggattaccaccatatagctcaccatgttatcccagaaagactacaatttcatacagaatgcacagatgtttaaataaaaagccatttaagtgaggggataattctcactaaaaaaagctcaaaaataagaaatgacaattctagatacacttttttgacatgtaaaatgacataaccatagtcacagggaataaagaatcaggtttgaatgtccacaggtttctaaaactaagctctggcttcgtatctgttgaaaatctttagcggttggggaaaatagctatatttaaaaacaaatattgaattttgagttgaaaggtacattttcctcccttgatggagacagaacttttctatggagaacccaagcagcctttccatgatcttactaagttgtccaagagccaaccccgatcagcagcaacaggactcaagctgttcaccctgctttcgagttggctgagcttcctgctgctttcacacattcttctttttctacctcagttcctctttgcttgtagtctttcactccattaacttgcccaagcactggacttaagtatggaagagcctatacgcagttgtaatatatttcgtattttgaaagtgtagaagtttgtattaatttaaaaagaaaaagcttaaatggaaagttaagcaatcctgaacaagaaaactctctcactgcctttgggctagagaaagagtatgctctcaaggagttacataatcttttccaaagcaggatggactgtatctatcatacacattaggataagatgagccaccacaccttaaagaaatcaggcttgagcctatacaagccataaccaaatagaagattttaaacaaaggagcacatagcccaaagctgacatgttatttctataaactctggtatatatgtgaaggagttactgttggctggcttgtgggttttttgactcactacatttttttagacaaaatcacaatgtgaaggcacattaatagttgagattttcttttccttccaggtggacttgctgactgattagtttcatatactacttagtaacctcaagaagtagcaggaggatgccatgtatcaatcttgaacttcaagtctcactgcaacaaggatggagactccagcagagtgcagggtgggcacagacaggccacaagatggcgcagcacctccatacttgggctcttgacaaccaagtaggtttttttttttttttttttttttaatgtccactaggagggaggatgctacgatttcagacctcagctattaaatagtaaatctggaaaactagtggataaatttgccatctccattctatgttattaagaccaagatagtgtactggttttcttttaaatcacattccattatgtcatttaaaatgtcacaaaacccacacgaagcatctcatttacactaagatgcttatttagctaacaccactaatgataaatgctgttacaaatatgcatagtcagatgatagtaaccacatacagaaaaaaaatttgaacaagtatttatttcttaaaatttacttaagggattagagctaatatataatagaacatttaatataacatttggagttatgtcaacataaaaatagctgtggttacaattagcacatgcaattcactgcaaaggtaaaaatacatgctatactctagacaagccttccaaatgaagttagagtagatggggtaaaacagcaagtgaacatgaaaggattgcacttagaagaaagtgggacatagctaggatataaaagaaacatacctaatgctagtcagtcactgcattgtcctactagcaaattgcacatttatttttagagtatattcaatacacatacatattgagactagagaattttcaaatatctacctttgaaatatccctttgtttctaacacatcacattatggtattaatgtaacagcacttaaaacctgtagttatcattcaaagcttgtgttcaagagataaaagaacatcattcagacaaagcctgtgttcaagaaataaaaaaaacatctatcactatcggccttaaatgcatctcatcacacgacccatcaactttaatgaaatgggtaatgaagttaaactaaccagtttgtacaaactattgactgagaaaaagcccttaaaaatttaggaacaaatgagcaacagaagagctcaccctgagctgccaccttttaatttttaatgcaatgtatatgagaatatcatgctaatgcacatactagtagcatgtatgatggaaaaaaataggttaatgcaaaagataatacgcttggctttgtaaagttttgttttgacttacatcatctgaattctgtttatcgagtctgaaaaggaactgctgccaaggaccagtccaaagaagaattaggctgtaagactgctagttcataccttctttgaaatcaatgacaatgtccaattttaggctaatcctaaaacacttgccattttatgactccatattcttttaatttacagaaaagtacaaattttttagaaagtaatcttatcagcacaatataatctaacaatacctgtaatagaaagctatcccagtaaattttttttgaacaattgaacttttgtcttatgcagcttataactttgttattttattcatctcaacaaaataaaactttattgaaacaaaagtgtatggtttaggaatatgctcttaataacaactgagcaaaattagaatgatgtggactataacagaatgaaggaagatctctcctgcttgatgtacttggtcaatatatgttagtaaacagaaatattttagggaattctatgattattctacttctacatttacatgtcatggttttaactagttaaatgggtagaaaaaagacatctttaataattgatttctatttctcaaactagatgctctactttaaatatgagctttaatgaatgttttgtaacattttaaagttgtaacatttctaagtatactccactaacttcacaataagagctagggtcactggatgacttcatgtggtaaaatcccttatcaaggaataaggctgaaatttaaatgaacaattaggtagagaagaggtatgaacacagaacatgtgaatgaaatttgctttttttccttgctgctgttcccgagtgccgactgatccatagtaaaaaaggacaagattaaaattttaggttttaatggtacaaagtgtgaagttttatagttttctaataattattcagtattatccctttcagagatgagggtaggataccacagacatcagtaactgacaagttataatatcaacacatgtaacatttgggtcattattttataaccctaaagggagcaactgcaggtgcagaagcagtgagtgaactagttttgtccagacaaggttttctgatgtgctattactttaaacaccacttttggacactaaagatttaaagtgataaagccactaactaactttattagactagtttttacataaataaccagatttctttgcctacctaaagtacaatttacatgcatcaacacatagattattctaagacatgcttgggaaagtaattttgaatgtaaaaagttttataatttattttctccttagggcaggtgtacattacatattagtgctcaaatatatgttcatttccagaatgaatttttgcacagtaatcatatatccatttaatatgtataaagtgttcttggggatgggggtatattcactcactgtaccatgttttatacaggcttcaacatgcaaatttgtttatatcatggccttcaatgatcctccattctcattcctgtagattaagagttcatattgtatatctgaccctgaaatgtacaaacttcacactacaacattcttcatgacactatttgttatgaggaaagttgcagctaaatattagtcatgtgacttaaattttgagaaaatggaaaatgtaataggtataaatttcctgacacatacagcaagacaaatccagcccagcctttgatgatcaacttaaaagctggagatgtcattatcttgttgtgtaaatttgggtctatccctacctttacttctctgtgcctgattttcctcatctactttgaattcgtcattctattaatctacttttgcctaaagtgggaaactgaatatatcagaatgaaacatctatttttttcataaagaagatcatataatatgtgaaagaactttgaaaggatgaggcattatataaatgcaagaatataaaagataaacaggaagtctaatgtgaacaatattctgagagtaaaaagtgtaattatatttccattgtaaatgtataccaagttttcttagctttctattctccaataacctctagaaactattctaagcatgcctggtttctgtaacttaaatatggcataaaaacctgtttcctttgaattcacttgatagcagtagtcaatcactaataacgcttgctaatttcctcttactttctaagaaaacccctatatttagcatctgcttccatatcgcacgtggtggttaggggacagcataagtacactagcggctttagcactaaactcgaggcctgggtcacttctcccttgaagaaaaaaggttttaaaaattcctaaatcacaatgtagaactaagttccaccctacctcagaactgcagacattaaaataccatctctttattaagtgtctctacaataatgatatttgctaagaacaagatgtacattttttggggttctgttttgttttggcaaatattgcccaagttgtcttagtgtgcctcaaacatttactaaaaataaaaaaatttaaatctttgcctacttatttaaaaataaaaaaaatactcaaaacaaatttaagctgaagatatatactgtataaagtgttcatctacccagtactctgaagtcttaagaaaagtcaatgatatgtgtgtgtatatatatatatatatatacacacattagcaatttaagccttttaacatgccaattttttagatgctttattggttttttttcccctttactactacttcctgttttcccctttactactacaatttaagcctttaaaaatggcaattttttagatgcttgagatagtttgggggatccctagctcttatcatggcactctgttgagtttgtgaaatgcatcttcaaagaggttgtcaataatatgcaaatttttgaaaactagtgagattactaattattgatgaataaaaaatgagtacttttaatctgccaagttaaagctctagaattccttttctccagtaataactcgcagcatcactaccaatggaagggacctaaggaataccgtgtacactgatatacacgaagctgctcctcatttttttgtcagattacaaaagctgggctcatgtagttatggcctatggacctctttttaagttattttagcagaagtagatgatggtctacaccttgctcctcttttatattaactgtccctaagccactctgatgactattctaatcaaaatcagtatagctgtgctcactaagcatatcactgcttattattcaaataccttctgttttctatgtagcaaaacaaaaagttttataaatttcagataagctttctgtttttcttcagtgcaaacatcctgaaacagcacaaaatcattcagctagtctgaggataaagtcagtttatgtagtgcttaaagtagaatcccagatattctggaatggaaatagctcatgtgaaacttcagttcatttttgtccttaagggcaaatgatcatcttcagagagtgaagactttttaaaatctgaattcacagataaaatcattttagctttactttataggtactgctgaagttgtagcaggaactactagtccttcactgaggcatgtagccgccttgccgtacagtctgtggtaagtaacttttaggcatgccttcatcagtcgcagcctccatgccaactgtttcaaatctttctacttgtccctcagtacctggaccaaaagcatctgctgcagaaacttcctgaaacattttcatttgcccagatccacaggattgtgaaatatgatctgaaatctgctgtttaagtctaacaaaatcttcctcattgactgatgaaacttgctttgacctttcaaaatgtgaaatatctggactggattcatgctgactgcagttctgtttgaagtactgttgcctgggcaaaataccatcaccgccatctacatgatctactaattgtagatcttctggccgctcctctgaatctaacaagggctgggtagactcggatcttgagaagacttggactgacggaacttggtgtctgtagccactgtgtaccacggtagaatactggacagtgctcgaagtgttttgtgaagattcattttcatcactgctagaaatgcttggcctagaagatgacatgcatgaagaccccccaataccactgctgtgtccttcagtattaattttttcctttttgaacaggtccaatgatttcagatcttctggaaaaggctttttgtcatttgcttctatttccacaacacttacatcagtgaaattgccatctgaatacatttgatcttttgaattaaaattgtgctaaggaagagaaaaaattgtatatggcaagtattagttaaagccacagagctaatgcatctctgaaacttcccagtaactctcagtggtacagaaataacctgtattatgtcactaagtcactgtcaactacccaaaatgcagatactataaaatgagtctaagtagtctaaatcaatattgttggtgttacattttgataagctaatggtctacaagtagtatttaatatttcatgcctagactaggcagcctaggattaactggacagaaaactagaaaacattaaggaaaatcaaacctgaatgacagagattttgtagaatataaaaatacataatacattttaatctgttaatataaaatttaaggactaccggaggataataaatataaatgagttcccctttggggcatatttaaaattcagagtttagagtaggttcccagagatcatttcatcagtgctaaaatgataaactgttgaacttggttttaatactcaacccaaaatgcttgaggtagttaccatcacatagcagtttcagcacctcaagttttcagtttgcaagttcaaccaaacatctgtaatgtgtactaaacaatttaaaatatcagaacaaatatactatgatggtgataaaacccctaaaatatgtcatacatattaaattttgattaaaattttcagttatgtactgttttatcttcatttactttttgattcagcttgaatatcttatcttttggtacatttgtagatactcaatatacctactaactgtagatactcaatatacctactaacatgtctgtatattataaacaactcagaagcattttctcttacccttggaggagtgtgaggtgaccactgggcaatatgactctttgaaggatctggaacattaggccagatgtgttttttaattctgaagagaaaagaaaaatggcctatgtaaaaccacacataataaacaataaatagtccctatttctaaacatgttcatcaaagactcttacaaaccaaaccaattacctaaatgaacaaaaaatacctactctaccccaaacaaaaattatttttcttataaccaatagaaaaatactgttgaaaatgcataaggattataatgtattcataatgaattaacaaagctaaatctaatcagtgttcaaatttttttttaaactctcaaaattctgcaattaaaaccacttaaaatctttacccaggccacatgttgtggtattccaattaaaagaatccagataacaaattaatgttcccactgataccaaaaaagttcaaatataaaaatcaaatttaaaaaagtgactgagaatggtgcttcaaagagtgagagcctaccagactgactctcctgtaggaaatacctataacatttggaagtaatataaaaagtagtaaagctgacaacctagacaaaccaatgaatgaatccttgaaagacacaaattaccaaaacagattgaagaaaaagaaagctatatttataaagaaattgaatttttaattaaaaaccttcccacaaaactctgggcaaaaggaaacaattgtattaatactatacaaactctttcagaaaacagaggaggtaacatgttcccattcattttatgaggccagtattatcctgattttaaaaccagacagataaggcacataaagacagactaacttcactcatgaacacagatgcaaacagtattaaactgaatgcagcaaaatccaaggaatgcaaagatgttatatgaaaaatcaataaaatgcaccatattcatggaaggaaggagaaaaaccatatgatcatctcaatagattcagaaaaagcatttgaccaaattgtgacacccattcatgataaaaattgctagcaaggcaaaacagaaataagaacttcccccctgcaagtagtagtaaaggggaaaaaaaaacacaaagcggctgggcgcggtggctcacacctgtaatcccaacactttgggaggctgaggtgggtggattacctgaggtcaggagttcaagaccagcctggccaacatggtgaaacccccatctctactaaactaaaaatacaaaaaaattagccaggcatggtggtgcatgcctgtaatcccagctactcgggtggctgaggcaggagaattgcttgaacccagaaggtgggggttgcagtgagccaagattgtgccactgcactccagcctgggcaacaagagtagaactcagtctcaaaacaaaaaaaccccacaaagcaaaaacttcaacctacagctaacatcacatgtgatggtgaaagactaaatactttcacctctaaaattaggaacaaagcaatgctcttatatggtctagatgtactatatgtactagaggtcttagccagtgcattaagacaataaaaagaactaaaagcataaagattagaacaactataattactcccaagaagcatgattgtgtatctagaaaatcctaaggatccaaaaagctactaataaatgaatttatcaaagtctcagtatacatgatgaatatattttaaaaaatcaattgcatttctatatactaagaattagaaaatatttttaaacatttcatttataataacaaaaaatacttttgtcatgaattcaaaaaaagttatgcaaggcctgtctactgaaaactacaaaacactgcaaaagtaaattaaacaaaacccaaataaataaagaaataaaccaggttcacggattgaaagactcagtagcgttaagactgcagttctctctcggccttagcgccatttttttggaaacctcggcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcaaaaacaaaatgcccatgttggtcctctgccctggacctgtgacattctggactatttctgtgtttatttgtggccgagtgtaacaaccatataataaatcacctcttccgctgttttagctgaggaattaaatcaaaaaaaaaaaaaaaaaaagactgcagttctctcctatagattcaattaaatctgacctatagattcaataaaatcccaatcaaaactatagttttaaaaaagttgacaagctgaattaaaatgtatatgaaaaggcaaagaacctagccaaaataacttctttaaaaaaagaacacactggaagaattctacctattttcaaaatttactatagagctatactcatcaaggcaatgtggtattggcataagaacggacatatatacatttatgaaacagaagtgagagtatggaaatagatacagacttataaagacaattgcttttggcaaaggtaccaaagcaattcaatggggaaaagacactcttttcaaaataaatgacaatggaattagacatctgaaggaacaaaatgaaccttgaccctgacctcacaccatgcacaaaaataacctgaaatggatcatagactaagagctgaaactattgaacttatggaagaaaacatgagaaaatattttgatactgtgtttggcaggacacaaaactcaggaaccacagaaaaaaaactgataaaatgaacttcatcaaaataaaaaacttatgcttttttttttttttttttttttttttttcagacactctgtcacccaggttggagtgcagtgatgtgatcttggctcactgcaacccatgcctcctgggttcaagcaattctcctgcctcagcctcccgagtagctgggattactgacgtgtgccaccatgcccggctaagtttttgtatttttagtagagatgttagccactgtgttagccaggatggcctcaatctcctgaccttgtgagccgcccgccttgacctcccaaagtggtgggattacaggcgtaaaacttctgcttttctaaagccacagttaagacaaaaaaacaaagcacagactgggacaaaagtttgcaaaacgtatttaacaatgttgtaaccagaacatataaagcactcttatagctcaattataaacaaaataacccaatttgaaaatgggtaaaagatttcaatagacacatcacaaaagaaaatatgtaagtgacacatgaaaagatccattactagtcatcggagaaatgaaaattaaaacgatatagtactacacacccactagaatgaaagaagtctgacagcactaagtgttggtgataatatggaacactgctggaggcaatccaagatggtgtagccactctgaaaaagtttggcagtttcttataaagttgaacatatacttaccatatgacccagcactctcactcctattatttgttcaagataaaggaaaacatatgctcgcacagttttgtatgtgaatattcatagcaacattatttataatagctaaaaattagaaacaacctaaacttccataacagatcagtctaagttttgatatatccatactacagaatactgttcagcaataaaaaggaaaaaggtaggccaggtgtggtgactcatgcctgtaatcccagcacttttgggaagccaaggtgggtggatcacttgaggtccggagttcgagaccagcctggccaacatgatgaaactccgtctcaactgtaaatacaaaaattagctgggcatggtggcaagtgcctgtaatcccagttactcaagaggctgaggcaggagaatcacctgaactcaggaggtagaggttgcagtgagccaagatcatgccactgtactccagtaagggaacagagtgagactccatctcaaaaaaaaaaaaagggagaagtatatgcaacatcatggatgaatctcaaaaatattatgtaaaagacatacgcaaaagactacacgctatgtgattctatttatataaaattcttggccgtggctcacacctgtaatcccagcactttgggaggctgagggtggatcccctgaggtcaggagttcgagaccagcctggccaacatggtgataccccatctctactaaaaatacaaaaaattagctgggtgtggtggtgggcgcctgtaatcctagctactttgaaggctgaggcaggagtctgaaccagggaggcagaggttgtagtgaactgagatcgcaccactgcactccatcctgggcaacaagagtgaaactctgtctcaaaatagatagataaataaaaattctagaaaaggcaaaactacagttacagaaaagcagatcaatgactgcctggggttgggctgagaagaagacagattacaaaggagaacaaggaagctttataaaagtgatgaaaatgttctatattgtgattatggtggtagttatacatctgtatgtaattacaaaaattcatcaaactgtacacttaaaatggataaattttattgcatgtaaattcagctcaataaagctgggggaaaatgcaaaaatatgaataaagttacttacaggtctcgcttattaaagcagaacagcactcccagaagagttgtcaataggaatgctaagcaaacaggcacgactatggcttcaatttctccttgagcttaaaaaaaaaaaaaaaaaaaaaaaaagaggtgtgatgggaaataatgttgacatatgaactaagaagacataatacaacttcccaaccagacttactgttgaaaagataaaatacaatcctaattatttttcaaggtctcttcagacttgatgatttttaccctcttctctctttggtaaatcacatcccaaccatttatgtcttatacattaacctggccgcatagcataaaatatatgttggttgggggataaaaatgatcagtgtatcgggtaatctactgggttagagctttcaaacataaccatttgtaacatttatgatctgcatttggtagaatcttagtaaaagtttatctctgagttctaatactgtataacagagaaattatgtcagaacaaatataaatactgggtaaaatggaaaagctataaaaacataattgaactacacatttaaccttctaaaaaataaaaatgcaactctcagaagttttaagagttatttaccatttttcaaaaggaggatatagctggtacagggctaagaactttaggagctgctcaatgggcatgaggagtggcacgagtaggaataaactaaaaagtaaacaagcctaagatccctaaataccacacaaatcctcatctgcatttaaaagaggacttgttcatcaaattaatcactaattgggataattaacattggagattttttaaatgactgtcctgattaattttgaattttacttagtcttttacagtaaaaaatgtatgaaagtaatattgcagccatatactattcacttaattttatccttccaccacacatatccctttgtaagtaactaacatcctatgaagctcagtagaaatcaagaaatcagttaaatgcttgagaataaactatgggttggcaaatattaactcttaaatgctaagcatcatatatatatatatatgggtgtatgtatatatatttatgtgtgtatatattgatatatgtgtgtatatatatattgatatgggtatgtatgtgtgtatatatatataaaatgccaaatctaatttaggcagaaactttgctttattaaacatctgcttttatgttttcaagcctgtgcctttgctcatgctgctctctaagatgccaccttcttcctatttgtccacatactaactcaaggctcaagtattttcttcttcataaaacctttgaaggtaaaattatccactactggtatatttaaattcctactctatttactgtctacatagtccacaggttctcctttttctgatttacttatgcaaaatttcttcaactaagctgtaaggtcctcgttggcaagactcaagccatgtgaagaagccataatggatccatgagactacagatagagaattgaaaaaaggtaggttataaaataatactaagtataatttaattttaggaaaaaaatatatacaaagaagacactaaaaggatacacaaatatgttattttggggtaagggactaggactaatttttcttcctctctacattttactgtacagtctaaattccctataatgaacacctatgtaataaaaaaattttaggctgagcatggtggctcatacctgtaatccggcactctgggaggctaaggcaggaggactgaggccaggagttcaaaaccagcctgggcaacacagcgagatcccatctctaccaaaaaaattgttttaactagccaggcatggtggtgcctaccagcagtcttagttacttgggaggctgaggcaggaggattgcttgagcccaggaatttgaggttgcagtgagctatgactgcaccactgcactccagcctgggagacagagcaagactctgtctcaaaaacaaacaaacaaaaaatatacatatgggcttttatgtgtgtgtgtacacacacacatacatatatacaaagctctgtagagatggctggtctccacagaaatacataaaatatacatttttaagtttattttttaatttttctcaagattatggtataaagttttattttaaataacatacctattaacataccaccacatgggaccaaccttatcccagaaactatattcattactgaccctaacagcaaagctcaggaacttttatcatttattttatgtagtcactcattcatttattccctcattcagcaagcattcaaccaacaaggcacatggaatttactacttatcattaactaggctggcacttgggggtgggggttacaattatggtaaaataaggtaattttctataatgattcaaaatgtagggggagcaagaaagaatgttggttaagtttgctttagggaagatacagaagagccagatgatgaggtgaagacctcactgggggcaatgcactaagaaaagagaagttagcatgaggagcttgcagttgaagaaaatgatgatgaaagggtacgcacaatcaacaggacttgacactcagcttatgtgagagaaaaatatacaaatacatttattgtaatcacatttaaatttatggctttggcatagaacgagggagggaaaatgtatttgggaaggaaagagaagatggctaaagccatggacagagtttgaataggcaagtaagaaaacagggtcaagaggccgggtgcggtggctcatgcctgtaatcccagcactttgggaggccgaggcaggtggatcacctgaggtcaggaggtcgagaccatcccagccaacatggtgaaaccccgtctctacaaaaatacaaaaaattagccaggcatggtagtgggcacctctaccccagctacgtgggaggctgaggtaggagaatcacttgaacctgggaggtggaggttgcagtgagctgagatcgcaccactgcactccagcctgggtgacagagcgagactctgtctcaaaaaaaaaaaaaaaaaaaaaaaaagcaaaaaaaggagaagaagaagaaaacaccaaagaacaaggagactcaggagactgtgctagcagaaaaagtatggttagaaaacccaagggaggagggagtttcaaggatggaaggccaacagagtcaaatgcagaaaaggctggaggcagtggcttatgtctataatcccagcactttaggaggccaaggcagaaggatcacttgagcccaggagtttgagaccagccatctctataaaaaaaattagctggatgtggtggcactggtcccagctacttgagaaactgaggtaggaggatcacttgagcccaggaggtcaaggctgcagtgtgccatgttcatgccattgcactccactgtagcctgggcaacagagtaagaccctgcctccaaaaaaaaaaagtagaaaaaagatgaaaactaaaaagcatgcagtacatatgatgatcaagaggtcttctgagtgacaccagagaggtttcagtgcaggggtggggtaggacccctaatttcagtatgttaaatactgagtgggaggtacggaagtgaagactgtaaagtggactagtccttcaagtaatctctcaataaaagaaagaaatgaggatagagaaggaaagaacacacccaaaccagtgaaaaaaatgaacccacatggaaagatacacaaattcttttaggatttttagtacagctgaatatagtcagaagcagttaataaaataccaaaaaggtgaggaataacactttctataaagaaaccaccaaccaaagccagataatataaaaatcatcatgaatccaaagatgtactttttaacacaattttagcacataaactaagttcatttctaacctaagtttgagaaagaaaaaaaaccaaacttcattatttcttaccaaactttggggtagtaaaagtgaattctggaccatccttcccaccttcatctgtgtatgctgccattcgtaccatgtacaatgtgtcactagtcaaagaggacaatgtatattctgtgtgggaagaatccacattcacagctggaagaaataagaactgtgcttcattcaactattcaatgcttttgcttatttggcctatatttggcattgtgaaagtgttaaaaaagaagcgaagtatttttgttggaaaacaacttttataatgttctgacataattttatgttctaaagcacaacacaatactttttcaataaatccatgaaagtaaccataaggcaaattctcaggtgtctcctgaggccaatatactataagatgtataagaagaacagacttaaattagtacttaaaagcttaaggaaaaaataactgattcttaataactgatacagttttattaccagtttcatttccaatgatggttctataaaatatagtataatttctgataaatccattctgaacatcaacaggaagttggtcccactctaagacagcttcgtttttccctactttttttgtccgaacagtaggtcctttggaaggtgctgtaacagagtgaacacatttgctaactgaaaatcatttacaatctagtaaaatttccttgtcataaaatcatttgaacataatgagatacatctttatttaaaagcgataaaatgtttctgttaatacaaagccctaaactttttttttcaaagaagtgagtttggacttacgagcttgtttaaggtatgcctttatggattcagggcttcctggtccatcagcatatactggagtaactgttatcaaatagcatttgctctctgctaagttccctaaagcaagaatagcagattaagcatgtttttccataatgaaaaagtcaagttaataccgtaatttatttttacattataatttcatgaccacttaattttcttttaaaactgcagttttctaagtaagcattgtcttttgtgtactggattcaagcttaatcaggtaaaactgtctgtaaaagtattgccaatgcagtggataaaaaatacattgttaagaacaatgatggtatttacatttagaatttataaaacaatgatctcaaattactctggattttatagagtctgacaatttttgtatgtcttacctacaagagagaacagcctaaggagcaagacgactaaagcagtaagacctaggggaaagcactaacggtcctagtttgcgagttggaaaaaagggtatcttaaaaaatttcctcggccaggcgctgtggctcacgtctgtaatcccagcactttgggaggttaaggtgggaggatcacttgaggttaggagtttgagaccagcatggccaacatggtgaaacccccctttactgaaaatacaaaaattagctgggcatggtggtgggcacctgtagtcccagatgcttgggaggctgtggcaggagaatcacttgaacccaggaggcggagcttgcagtgagccgagatcgcaccactgcactccagcctgggcgacagagtgagactctgtctcaaaaaaacaaaaaccaaaacaaacttcctttatttttatcttttttagcatgcaccactaaaatttttcttatttatacagtatattatctgtacatattagaaaatgttttattgaaatttataccttcaataagaatgtatattccttaactattactcatgaagttacatgctcctttaccttcttaaacagattttaccttttcttaatgattcaatattaccaaaaaatgaacaatttttatattctactctaatgtgatgctttcagggttactgagcaacatacgactacctacccaaacttaatgtctccacaacttatgctagcttctattttttttgagatggagtttcgttcttgttgttcaggctggagtgcaatggcatgatcttggctcactgcaacctccgcctcccgggttcaagagattctccagcctcagcctcccaaatggctgggattacaggcatgtgccaccacgcctagctgattttgttttagtagagacggagtttatccacattggtcaggctggtctcgaactcccgacctcaggtgatttgcccgcctcagcctcccaaagtgctggaattacaggcgtgagccaccgcatcggctgctgctttaaaaagtttctattggctctgagcagtggttcacgcctgtaataccagcactttgggagtttgaggtaaaagaatcgcttgaggccaggtgttggagatcagcctttgcaacacagtgagattccctctctacaaaaaaataaaattagctgagtgtggcagcatgtgcctgtagtcccagatactccagaggatgaggcagaagggtcacttcagcctgggagttgaaggctgcagtcagccatgatcatgccaccatactctagcctaggcaacagagtgagaccctgtatttatttttttttaagaagtttctatagttatttccagcctgtttcaggacttcctaagctccaccatgtttttaatttgataaagtcagtaaactagataaccaagcttattaaaactgtacactaataacatgtaagtccaaacagcctgtattatgactaaagctcaaaaactttatggcaggaatctctctgcttagggcttttctctaattaaccatattattcacagctgaattctaattattaattatcaacaaaagactataaactgagtttttttctcttcaaagttgttgtatcactttataaccacttaagcagcaccataacacacagactggagcgctacgattcattacttctgtcctttgttactacttccaattgaaagacataaggaaatctgagttctagttctgcttcctctatctgatggttctaagacattacacaagtcatccagatgctctaggaaactattttctcatgtgaaggatgaggtacagagaacatataactaatcagcagcaaaggttggactcttatatttctctatactctatagttttaggagttttcccttgacgataaaatcatattggggtacaaaaagaagaaagtattaaccccactctgttcataaagagactgtaattcagagaggttaagtatgacttgctgaaagtcacacatctagtaagtagtgaggctatgataaattggaagtcgtttcaacggaccaaaacactataagcaaaagaaaaagctgcctaaagagttagaaaaaggatatcaatttagatgtttctagccaggtatacctcttaaataggtgcgatgcacggtaccatcttcttgttgccagtctgtgatacagggtgctttatctgataacacacaccactcaagtatatatttctttacagattcccttggagtagtccattccacccaaagcatgttatctttggggaatgctttaagatccattacagggtgagtagctttaaaacaaagtttgaatattgaaataataaatattaacaaatttgaaatttccatattttacagtcatttccaaaacatgtgatttatcaatttttgtagcatatacttccttgcctaaaagcactttattataacttacaggtaaagtagtcaatttttaaacttagattttgcttccccgctgggcactgtggctcattcctgtaattccaacattttacgaggccaaggcaggtggatcacttgacatcaggagttcgaaaccagcctggccaacacggtgaaaccccgtctctactaaaaatacaaaattagccaggcattgtggtgcgtgcctttaattccagctacttgggaggctggtgcacaagaatcgcttgaagccaggaggcagaggctgagatcgtgccattgcactccagcctaggcgacagagcaagactgtctcaaaaagaaaaaaaaaaatttgctttccctaaattcttcaaatgctttcggtttgtaattgcaatttttcttctttgaaagctacgaataaagctacagataaacgtttcagtcatatgtatacaaagttctcaaaatcttgaaataatattttaaaaaccaggtaagtaatcagaatatgcttaaatgaatgaagtagcttactgtgaagtttaagtgagcatgtagtgatggaaatgttcttgcatcctgatgaaatttgtctgctgactgattcctaaaaatgcgatcactagctgggtttggtggcatatgcctgttaatcccagcactttgggaggccaggggagatcgcttgagctcaggagttcgagaccagcctgagcaacctggcgagacccagtctctgaaaaaaagaaaatcattatttataaaatttaaaaaattaaaaaataaacaagtgattatccctgatactgaggagacagtcttagataacttgtgttttttatgggagccctgtccatacctaaccaccatttttccacccaagagtcaggctccatctcacagatacaaaccttgaaagtcacaggcagggatagttaaaacagctgcatctgatttgccaacaagatttcttactgttagggttgctagatagcgatcatttgtgagatttactgtcagttttgtggcattaactgtgtaattttgtaaatgtgatttccatcttgtgagagtcacttcataatccaagatttttccattggcttcaaaaggaggcaatgtctgtaataaaatagtttatttttaaaaataatctcataaatcttgaataaaaaatcagtttttcttcatattcacaaatcatgccattatgtcaaatctctaaatatttaactggaaaggattcacaatctccattttaaatttggttctaaaataaaactagtacatactaaatgaagagtaaaagcatgacctcaactaaaaaagggtaagtagcatcattccgttagcttttggttctgtatcaattctgcactgtggctatgtaggtctaaattatttattttatgcttgagtatttttctaccttcttttttagtatgatctactcatgcacttaccagcatacattttgattatcacaaacttttattattttctgagttactctggaaaattccaaagtacaaaaacaacattcctcttcttatagaacttatactttcacagaactgtacttaaatacctataaggtattatttgtagtttatgaacctgacttctatataatattaatacatataaagcattacctttctatttagtaaaaatagtaatcaaatgctttgctattaaaatgaataaaaatttatctatttaaaagacctccattcataataccatacaaaatgtatttataagggctgggcgcggtggctcatgcctgtaatcccagtactttgggaggccgaggcaggcagaacatgaggtcaagagatcaagatcatcctggccaccgtggtgaaaccctgtctctgctaaaaatacaaaaattagcggggcgtggtggcgcacacctgtagtcccagctactcaggaggctgaggcaggagaatcacttgaacctgggaggcagaggttgcagtgagccaagatcacgccactacactcctgcctggcaatggagcgagactcggtttcaaaaaaaaaaaaaaagatttataagagataaaatataaatgtgattttttaccttccacacgagttgtacagttctgtagccttgagtatgggatggatctattttataccagaaacttggtgctttagatggtcctaaagaaaagacataaactccttaaaataaaaaggttttaacagtaaaataaaattctgcaaattattcttttactttgttcttaatactcttgccctccaattgcatggtgtctctacctctttataccagcattttcccaacccagcacaaaacacctggctcttcctttagtcagggtgatagcctgatcaattatactggaactcttttctaacctcaaaattgtaaaggtaaaaatgtattctgagcaacaactaaagaggcatcactctttcttataacttcatgttctttattctgtttgtgtgctggcactgtatttatctacttgaatctcctgtaccagcagccttttcccagccttcctggtctgcctgtcctcacttctgttttgtcatctgtaattgcctcttcatgatcaacacatcactgcttagattttattcaactcctctcttattctattaaataccaggtcttctaattatatttataaaaattttgaaaaattagttaatatgattttttaaagaaaaaaactttttaaaataaagtttttaacagtaaaaaataaaaatgaaataaacataagttgatactacttatcgctgaaaatcaaactggaaaatctatttaaacacattgcttactcctaaatattcacaagaataataaaacaaattaagataaatgtactaaaataagtttattactttatataaggatgattgagagtgatgggatgtaataaaaacaaattcacagtattgttgtgataatcactaaccatctgaaaaagcaatccataaaacatagtggtttttttccagagacagtgtctcgctctgttgcccaggctggagtgcagtggatgactatagtgcactataaccttcagctcctaggctcaggtgatcctcccacctcagcaacccaagtagctggggtttggccaccatacccagccaaaacataaattgttaaataccagtaattaaattcggttttaaaaatacctgtagtattaatttttcaaaacttataatagccattaaatgtagcatataatttttaattttttagcaataagtaatatcaactgacatttcatttttacttatcattgttaagctttttgtaaaaagtttgtcttaaaaaaatcaatggcattaactgatttctcaaaatttttatgaatataataacaagatatggtagtcagtagaataagacaggagttgaataaaatctaagcagtaaggctgggtgtggtggctcgtgcctgcgatcccagcactttgggaggccgagggatgtggttcacttcagttcagtagttcaagaccagcctgggcaccatgacaaaaccttgtctccacaaaaaaatacaaaaatttgctgggcatggtgacacgtgcctatagtcccagctatgttgggggctgaggcatgaggatcgcttcagccttggaggtagaggctgcagcgagccgtgttcatgccactgcactccagcctgggcaatagagtgaggcactatttccaaaaaaaaaaaaaaaaaaatttaagtactgatatgttaatcatgaagaggcaattacagacagcaaaacagaaaggataggacaggcagaccaggaaggctgggaaaaaggctgctggtacagaagttaaaatagataaattcacatgagtacagtgcagcactcaaacagaataaagaacatgaaattattaaaaaaaaattatgagctggaaatatttcctaacataaagggaacccagagacttcattcacgcattgatttgacaaagattatgtacacttgtccattaaaaatgcacacaggcactaaccacaatattttacctacattttaaactatttcatgaactcctccccatgtatctcattttaagaattcctggtcaagacaaagcaatctggctgaggactcccacagcagcaatagcaaaattgatttctttctcagcatttatgagagaaatcttagggcagaagggtacttttctgcctttgatgttctcaagtcacatgacctaaacctctagaagagctggaagtaaagggatataggtggtaggggattttttcagccacagctactgccattgataactaagagatgagtctgtgataggaaggtctcaaaatgaaaaatctatgccacgggattatttcttgaacttagtaacatcagatgctttgcagtgaggatcttactttagactgtacactctttttgtgccttttttattctatatcatatatattatctataggagaaaaaaggaaaataaaaactaaccaaccaaaattccaggatcaaccgcttcccaggggcttatcaagtgctattagaaaaaaaatgaataaaaggtataatacaagtatatttttgatagtggggatctaaggtgtagtttgctagacagtgtggttttaatgattcaggatatgattctctagttaggagtatctctggacaagtctccttgaataaaatgttctagacttatcaacagttaacggttttctgatagatgtatctaagtcaccattccatgatgaattttttttttttttgagacggagtctcgttctgtcacccaggctgaagtgcagtggcgtgaccttggctcactgcaacctccacctcctgggttcaagcgattctcctgcctcagcctcccgagtagctgggactacaggcgcccaccaccacgcccggctaatttttgtatttttaatagagaaggggtttcaccatattggccaggctggtctcaaactcctgaccttgtgatccgcccacctcggcctcccaaagtactgggattacaggtgtgagccaccgcatctggcctccatgataatttaattaggtatcaaatagacttatactatcaatgatccatattcaattttacatcttaatgtccttaaaaattaaaacgttaaaatactgcagtttgaataaaatgatcacaaactaagaagcaatgaggctatattattaaaaccagaaccagttcacatctggaattccaatagctttacttcttcatatacttatgtacttactatcttcataggtgatcccacttgcttcttcactccagtcactccagtatcccttaccatcttccttcatacagcgaatcctaaacacatattctgtaaaaggtttaaggtcttggacagtgaatgaagatcgggtggatgctgtgtcttcaggaggaatctgaaacaaagcaaaccaaacaacagaaaacctcaattagtaaggtcttctaaattgtgttaaaattcagaaacttttttttttgaggcacagccttgctctgttgcccaggttggagtgcagtggtgcgatcttggctcaacacaacctctacctctcccaggttcaagcgattctcctgcctcagcctcctgagtggctgggattacaggtgcccgccaccactctcagctaatttctgtacttttttagtatcaacaagattcaccatgttggccgggctggtctgtaactcctgacctcaagcaatccacttgcctcggcctcccaaagtgccaggattacagatgtgagccactgcgctcagcctagaaactatttatttttgagacagagtctccctctgtcgcccaggctggagctcaatggtgcaatggcgcgatctcagctcactgcaacctccgcctcccaggttcaagtgattctattgcctcagcctcttgaaactattttattgacacaagactaatacattaaactcaacctctggagagaaataagtgtaagttaaaaagcagtccaaatcagtaaagttatttggttttagaagtatggaaacatctattatctttccttttttccctttatttcttccacagggcctgtaatataacttaggatttctgcaggaaacagatggcacactccatttagaataattcaaggagggcttcataaagggactacatgcagagtatatggaatccttagacagtgcagttagtactctggggcttagagctgtttctacctctaggcccaaagggatgaggggaagtaccagaacctgaaagaagccggtcagctagagagggctgtcttgacaggtagtgaccctaagttgaaagacagccggctgggtgcggtggctcacgcttgtaatcccagcactttgggagactgaagtaggtggatcacctgaggtctggagttcgagaccaacctggccaacatggtgaaaccccatctctactaaaaacacaaaaattagctgggcatggtggcacacacctgtaatcccagctactcgggagtctgaggcagaagaatcgcttgaactagggaggtggaagttgcagtaagccaagatcatgccattacactccagcctgggcaacaagagctaaactccatctcaaaaaaaaaaaaaaagacagccagttcctggaaggaagcagggaaaatcaacatgccaatttcacttttcttctgtcttctctcctgcctagtcccttccttccattaaccacagtcacaaggaagctagaaagaatggaaacccacagatgaaatctatacaggtcagcatgacacaacaaagagaagggtagagcgtagatgtggacaggcaaaaggaagatatccagcccaatcaagaaaaacaaaagttttcctggcttttaaacttggctttcagaaaaaaagaggagattaaatacagataaataactggtcatattactctgataatttagtattagatacaaaataaacatcagtcttttttgtagcactgaattaagattctatacttaataccacattttgaagaacttcaggtatgtatattctctgtacaacatgaagcattaatccaattttgttttattgctttttctgattgtattctgagcactttagataagtggggtaaggagagaagtagtaaagtcattagcccaattccctaacaagctcactgtgaccagagcaacaaaagcaaagacatactgtttgtgataaatggaatcaaaacagagaagagtatggatagctgaatgctatggtgatagcctttttaaaagctccaagtatttcttttgctggtagcatcatctttgggtatactatcattttcagtcttacaagctccctatcaatcccttcctctacctcagtggttggcaaactttctataaaaaggtagataaaatatttactaatattttaggcttgtgggccagagactctttttgcaactactcaactcttccactgtagaatagagacaatatgtaaagaaatgagtgtggctgtgttccagtaaaactttatttacaaaaacaagtcacaggctgattttggtggactgcagcacaccaatccctacactagctaccttatccttataatctctttatttttgctcctctacttaatttgctttattacttgtattctttgtaacacccatcaaaaatgccatttctaggctggtagtggtagctcacatctgtaatcccagcattttgggaggccaaggtaggagaatcgcttaaggccaggagtttgagaccatcctgggcaacacggcgagactccatctccacaaaaaataataataattttaaaaagccaggtgtggtggtgcacacctgtagtgagactaaggcaggaggatcacttaagctcgagttcaaaattgcagtgagccagcggcctgggcaaatggagaccctgtctctagaagaaaaaaaaaaaaaagccatttcctatcaccctatatcattttcatgttttacttaaaggctactgtatttagcaaagctgtattttctatctggatatcttcctgattccccttgtttgaaataacaacccagaagaggttatcaagcaaaatatttcacataaccagaaacttaaagacatttagaaaatgactgaaactttttaagattagagggttgaaagaaggactatttgaataaacggtaactttcaatttacctggctccaagttgaggcatctttggtcctatattgaatgttatattttagtattataacactcttaatacttgggttggtccatgtcaattttaagatactagacagttcctctgagttgatcactgataaattatgtggcggattgggcttcactgaaaaataaaataaatcctaaggtttattatgttttccaatttcatatacaaactcaaatatactctttatattgtccttcctttattttacaataatttatccttaccaaatgaactaatttctctgaaaattatgctatgctatataccttataatggaaaaaaaaagatttctaaagaatcttcagttctccttgttaatttacatttgttaatctcttcaggttcatatgtcaaaagacaaatatttatgatatcaaatttttaaaaaagaataaaaatggaacatacatactgtaattacaatggtgtaagatgtttgagaacagaaaacattcaaagtgaaaacagctgttaagtgtggttggattatggatatttttctttttccaaattctatttgatattattgataaaatgacttcataaaaatcactaagataaatgcttgtttctacattaattaaaatctaaaatctacattaattaaaatctaaaaaagtaaaatctaaaaactacattaattaaaatctaaaaatctacattaaaatcttaaaaaatctaaatataaaaactactttaatttgtaaacgactacagtgtcaaataaactctcaaattcaggtttataactacctttatatacaggatcaaaattgatatgatctgatgtaaccttcccaagggcattctctgcttctacccagacttcaatgttgacaaaatacacagtagaataatcaacagtgcatgaggtgggggtgtcacgttttgctttgcaatcagcaaacttgtgtgttgccctaaatacaaaaaattgaagaatcagtcattaaaaacacatctgaaaaaattagagtgaaaaaaattacttgcaaagagtttgatgagacctagattgttgtagcaaactttgcaatataactgctggtcactaacaaaatttcttaaaaataaacctttctttaaaattaactttgatctatatcttaaaacataaaattattttcaaatttgtagtctaaaaatattgtgctttaaaattttatgctccatccccacttactcctctccaaaaattatctatttccttgtgatcccagtgctgttttttctttttcctaaaacagaacccttactgtaccacaaatttctttaagcacaatatgctagaaggtgacaggaggttaggggtaagaatttctattaccccttagcctttagtcttagggctaaaatctcttagcctctttctagtcaaacttaggcaactactttctgatttctatcaccatggaaagtttcaagtaatattactatatttatttacaattatataaattatgcctcaattaaaaatattcatatacaacactgtttttaaaaataggataaaccaaaccccaaattgaaccaaaacaaaaatggttagcctctaaggagaaggaaataaggtagaggattcaggaatagaatatagacttttctgaacaagccttaatactattaatagatttgactttttggattgttttatataattattaagaaaaattcctaaaaattaaaagcaaaatgaaacatatgaacttgtgtactgagtatgtagtataaccacatagaaaagaactattccaagtaacattaaaacacagtaatctgactattacacatccttcacagagaaaaacaatcttaaaatcattcttggtaatcattttgttggtgctaatactgttgttattattctgcagctgctgtattaaccgtaggataaagcaaatgaataattatgttagtgttgttgtcaactatgtttttcagttcataagaaagaagatgtagacgtcaggtaaatataattatgtaaaaacctatagccctaattttaaactgaaaatatcagtatgaatttgtatttttaaaagatagtattatatctcaaaccacaaaacatgtcctagctctttcgactgaaaaaatctaaaaaatctaaaaactatgacaaaccagtagtgatgaattcctgtagcacccagattgtagtctgtaaatattatttcacactaaatgaaaccagagagttttgggaaaaggttgattccaggtctgggtgaggaaatacatgatgaccctgtaaaagcatgttatatcagagagctatcaaaggctaaggaagttgtgtcaagacgatgaatgagccgggcggggtggtgggtgcctataatcccagccactcgggaggcagtgagccgagatcacgccacttcactacagcctggtcaaaagagcaaaactctgtctcaaaaaaaaaaaaaaaaaaggatgaatgagccaatttgagtaaactgccactgatcaaagatgggacaatccataatgagttaaaacatatcaaatatgtttaaatataaatttataatgagaaagaaaagccctcattattctacctttggaggatactagggaatcaactaattataaaactggtaattaaggaaaaatattaaacctatcttgcttctcctatctgaactgtacttcagggtaaaccacagttgataaaggcaagtttttctttaagtatttcagctaaaacaaaacacagaataccatagttttgtaatttatatacaaattataatcactgatgactgctcaaagctgtaagggaaatactagtgggaaaacaacatgattaaatttcggaaacattctgttgagttataaaacttttcacagaagagtatatactatataatcccatttatatgagacattctgtaacaggaaaaaataatctatggtgaagaatatcagacaggtagttgctcatggggtggggcacttgctgggattgactgaaggagcaggaaggaactttttaggtgtgttagtcatgttctatgtcttgatactgattgagttacacaggtgtctgtacttgtcaaaactcactgaatgatacactaagatttgtgttttcactatatgtaaattttatttaaaaacataatactgaactctagttcatgtaaatactgaagtgattaagaatgaggtatattaatgactgtaactcactatgaaatactgaagtgattaagggtgaggtatattaatgactgcaactcactatgaaatacataaaaaagagatagattgagagatggagagaaggatgcatagataaataggtgataaagcaaagatagtaaaatgttaattgtagaatctagggtatgcaagagtgttcactgtaaaactctttcaacttttctgtttggaaaaaacaaatgggaaacttagtaaataaaggaataaggctgacaacacccgaaaccactgctcaatcttagtatcagaaaaaagaaaaacagtgaaacattatctggtctttcctgacagaagtacacatcactcctacaaaatatttttttggggaaaaaaaaaaaatcaaacccaaatctgatgaaatctgtagatctaaaagcaattttttggaaagaaaaagacaagggggccaggcgcggtggccacgtctatcatctaagcactctgggaggcagaggcagccagatcacgaggtcaggagttcaagaccagcctgaccaacatggtgaaaccctctctattaaaaatagaaaaaaattagctgggcatggtggcacatgcctgtaatcccagctactcaggaggctgaggcaggagaattgcttgaacctgggaagcggaggttgcagtgagcagagatcatgccactgtactccagcctaggtgacagagcaagactccatctcaaaaaaaaaaaaaaaaaaaaaaaaaaaaaaaaaaagacaagggaatatgttaaacaatgtacaatgtataacagtttaacaactgaaatgtaagaaaaaagaacaaatagaacctataatttaagagacaagacataaattcacaaagtatggagcttattcgaatcttgactgaaacaaatgtaaaaaaaattatacatataggcatattcatgagacataggggaaatcaacactaactgaaaatgtaatattttatatctgagtgtaacagtggtatgttgttatgcttttttttaaaatgtcctcatcttttagagacgcatactgaaatatctttggatgaaatatgatgcccgcgattctctcttcaagacaatataggcaaagagtacctttgaaataagactggtcatgagctgaccagtgttgaagctgagtgatgggtatgtatgggtattctactattctttctacttttattttttatttatttattttttttgagatggagtctcactctgttacccaggctggagtgtagtggtgcaatccgggctcactgcaacctccgcctcctggatttaagtgattctcctgcctcaacctccgagtcactgggattacaggcacccgccaccatgcctggctaatttttgtagttttggtagagacagggttttgctctggttggccaggctggtctcgaactcctgacctcaagttatctgcccacctcagcctccgtaagtgctggagttacaggcatgggccgccgcgcctgggggattacaggcatgagccaccgcgcctggcctctacttttacatatatttgaaatgttacagaataaaaaattaaatgttttaaaatagcatttaatattattacttggtaaaataaaaattccagcaaaaatgactaactttaataaatctaacatgaaacaaatttaaaataacgtaccattcagattttaaagtgaagtttgtctccaagtgtgtttcccttccaccatcccactcacacctcattttcttcccctcgttcacaatgcaactcaaatttttaggtttttctggaggcactaaaagggattaattagcatctttcagaaagctttatatccacaaatattatgcaatttatatactacccaaggcatttgcgatctaaattagatgaaaaaaatcaaacccaagcaaaaagtatggacacaatgaaaggctgatgacaatttcttttctatcccaactcttacacttcttttcaggaagtaatatatatacatccatcctaactgtcatcaactggtttgtttcacattaattttctatgtaaaatcaactttcatttataactggaaaaaaatatcaactgatttctccattaagtatatttttaaaagtaatatatacatatgtttgtaagaggcaactaagtagaagccaaaatgattcatttatatttctcttcttattgctttcccaaactcgttggaagaaaagcaaatgccaaaacagtaaagtctgggtgatccacaaattagataacccacttttggatcatagtaagtttattttgtttactttgttactccaaggccaggcacagtggctcacgcctgtaatcccagcagtttgggagcccgaggcaagtggatcacctgaggtcaggagtttgagaccagcctggccaacatggcgaaaccccatttctactaaaaatatgaaaaattagccgggcgtggtggctcatgcctgtagtcccagctacttgggaggctgaggcaggaggattgcttgaacccgggagggcagtgagctgagatgatgccactgcactccagcctgggtgacagagcgagactctgtcaccaaaaaaaaaaaaaggatttactccagtatttgttcgctttcttcaggtagctgctttacacgtgcattttctcagcaattaagggatactgagaattaccatcattatgtcaattcaacaatactttcctgtggtggggggggtctcatgtcaaatatttctctagtaaagtgaaactgcttgactttcaggaaagacaggagacttgtggttcctacttctaagcttattttttaaaaaccaaacatgtccaagtcactaagtccacaagttactacattttataaagatgaaaggacaacattaaaaatgcagttcaatagtcatgacaaagtctgaaataagacaaaaacaaaacttacagcctgaaattattgtgattccataaacattctgttcaagctgtccgaatgtaagaatgttgcaagtgagctgaatatttaatgaagctatatctgtaaaggtgacactggatgctgttctgtttatgatagtatattgctccttaggaatagtaaaatggtttgttttccagacaatgtaattagcatttacatgaaaataatccatacatttttcctttagcacacaaactgcagtgaaattagaatgaagttgtacaactggagattcaggactgatataaccacatggatctagaagttcacctaaaaaggaacaatagaaaatatataaatggactgaatttttctggtacaaaatgatatctagctggtagcactcaatgtagagtccctcaaccgtcactaaaatatccctaaagacacagaaaaagacaatacacaactgaaaattaatatggttagaatttaatgcctgaatttgtaaagaaatatacaaattataaagataatagagctgaattaagaaaaacccattcatgctttatagcccatggtataaactatttctttaagaaacacagactgcctgcagcatgattcatacttgccccacaacgtatcctgtccctccatttagatcccaggtctaaactaaactctccagaaaacaggcagtggtggtctcctctacagtcctgaatgctgttgtggagtacagttggggtcacagacagtatacattgtccacacatcaaaactcagacaacaaaggaaacagcaagggaccaatacaaaacaggaagaatagaacaagatggccaaatagtttagttttaagaataaatgcatggccctgggtatgatggtttgcgtctataatctcagcacttttgggaggccgaggcaagaggatcgctcgagctcaggagtttgaaaccagcttgggcaacatagggagatgccatctgtactaaaaacaaaaaaaattagccgagcatggtggtgcacgcctatagtcccagctattcgggaggctgaagtgggatgatggcttgagcccaaggggtcaaggatgtagtaagccactgcactccaccctggacaacagagtgaaaataaatgcatgggataggatcccctatttaaaaacaaagaatcagcctaaccaacatgctaaaacccagtctctactaaaaatacaaaaattagctgggtgtcatggtgggcacctgtaatcccagctgcttgggaggctgaggcatgagaatcacctgaacccaggaagtggaggttgcagtgagatcacgccactgcactccagcttgggagacagagtgagacagagtctcaaaaaacaaaacaaaacaaaacaaacaaaacaaaacacaaagaatcagattgggtaaaagagaattaaacacaactacatgctttacctatcacctactccacattgatgacatctcaatccctatctctagcactaaacccccatgctttcaatagcccattagacatatatctacctgagatatcccatagctatttttaaatgagcatgtccaaaactattatgtatcataatcttttcaaacttattattttttattcttatttctctgcctctgctaacagcaccactcccatccagacatccaggacagatactctgtagtcatcttccaacatctccaattagcctcctctaacctccaacttaacaatagtgcactgtattggttctatatgcttaataagcatatcaacatcttctttccaatgctactttgactgctgaagcacaggatactatatcagtctgacctccttccagtttatcttacatactactgtcagttactgttctaaaataattaggacatttgtctactttaaattatttagtggctacctactaccaagataaaagtcccaactatttgacatgattttattctttttctctagcttcaatgtccacaattttaaggtggctttcctcaatgaatcctatttgctgtggggttcctgggtagttacccatgaagtgtttttgagattaaaaattactagcctgggcaacatggcaaaaccccatctctacaaaaaaaatataaatattagccaggcatggtggcacacgcctgtagtcccagctacttgggggtgagggtcgtgtgctgaggcaggaggattgcttgagcccaagaggtcaaggctgcagtgagcccagaaaaaattaaaaacagtttttgcagtcaaaattgtatccccaaatggaatcccaggacctctcacaaagcctgtaaaacccagagctggaatgtgtatttctttgtttcaaacttataatgtggtctgtttatatcatcttgctgttatttataaatgcctactgtaaatcttagtgcatatattactctcaatttccaatagcatggtccttcatccagtggagaatctctactaagttactctctgatactgggtcagaccttacaattccctagacatcactttattctttggcaaaatcacttgttatactttctctaaagtaatcatagggatgttaaatatgaaatatactctagagttctaaaaagatataattagagactcagtatgaataatttttaatcacacagaataagagaaatattaaaaatgggcaaatgggctgggcgcagtggctcacacctgtaatcccagcactttgggaggccgaggtgggtggatcacgaggtcaggagatcaaggccatcgtggctaacatagtgaaaccctgtctctactaaaaatacaaaaaattagccgggcgtggtggcgggcgcctgtagtcccagctacttgggaggctgaggcaggagaatggtgtgaacccaggaggcggagcttgcagtgagccaagatcacaccactgcactccagcctgagcgacagagtgagattcagtctcgaaaaaaaaggggcaaatgttccgtttttcaaagtgagacacagcttcaataataccatcccatgtcaaattaatcccattttacagggctaccaggctgagattaaattgtaaaaagaaagtattttaattaagaaaggtatctgataaagttattttgaatgtttatagggcaagatgaagaaatgtgaattagaatacactataactgggttggacgcagtgactcacgtctgtaatcccagcactttgggaggccgaggtggatggatcacctgagatgaggagttctagaccagcctgaccaacatggtgaaatcccgtctctactaaaaatacaaaaattacccgggcgtggtgacctgcacctgtaattccagctactcaggaggctgaggcaggagaattgcttgaacctggggggcagaggttgcagtgagctgagattgtgccactgcactccagcctaggcaacgaaacgagattccatctcaaaaaaaaagaaaaaaagcaaaaaaaaaaagaatatactataaccgatattacaatgaacattatgaaattgctgatattttgctacttttataggttcatactcaaatttatatttgattacccatatataaaaaaactgacttaagaaaaaagtcaattagaggatagtcttaagtagaatatgctgaagtgcatgccctcaatccttggagaagactgtattttaagaatggccacacctacatatttatcccatcccacgtttttcttacgatgtcacgcatactcttttcatgaagaggtggggactgcatttcccccaaccacatcagatctgtatgggtgccttgtgtccactccagccaatggagtgtgctatgagacttcagaggctagatcattaaaagaatacagactccaattagctttctttctctctcccgggatatctgcccttagaacccagccacacattgtaagaaagccagggccataaaaagaggccacgtatggtgttttggacaatggccccagcaaagccctcagcctgcagataccattaacaacagacatataagcgaaggagtctgaagatgactccagcccccagtctgaatattgcagctgaggccccagacattgtacagcaaagatgaatacgtctgattgtgcctgcctatctatagtcttgtcctatacaaatcatgagaggtattattatcattttaagccttgaagatttggagtatttgtgaggcagcaacaggtagctaatgcagtcctgttattttcaacattttaatcaacaacttgggaaaagacagacacacatgcttatcaaattagcagaggacaggactacaaacaactgccaacacttcggatgaaaatgttgggatttaaaattatgctgaaagagtagaacaccaggctaaaactgataaaatgaaattagcaacagaggaaatatatcctatttaggtaataagaaatatacattgggtgagggagaactagtttaagagtaactcatgtaaaaaccacctgagaattttcactgatcactagctcaacatgaaacaagggtatatctcagctaccacatagttacgtaactttataaaaatgatgttcagatcaaagtaagtatgagtgccactgtagtcagattggttttggtatattacgtttatttttttcataaagaaacttttattcaaagacaacaataacctttataataaatatgcagtaactatcatttttataatgcttactgtaggccaaacactgtccaaatatttcctctatattaacttatttttggttgttttttgagatagggtctcagtctgccaccctaggctggagtgcagtggcacaatctccacacaccgcaacctttgcctcccgggttcaagtgactctcccacctcagcctcccaagtagctgagactttcaggcatgtgctaccaagctcagatttttttttttggaaacagggtttcactctgtcacccagactggagtgcagtggtgcaatcttggctcactgcaacctccgcctcccaggctcaagcgattctcctgcctcagcctcctgagtagtggggattacaggcgtgcggcactaccgcctggctaatttttgtatttttagtagatacggggttttaccatgttggccaggctagtcttgaactcctaacctcaaatgatccacccatctcggcctcccaaagtgcttggattactggcatgagccaccatgcctggcctctatattaacttctttaatcctcactaataaccctaggaggtagtggcctttattatcaccatttcatagatcaggaaattgaggtacagaaaatgactgaccaaggtcctacagctagtaagggggacagctgggatagtattattcatacacacacacacacacacatacacacacacacacacacacacacacgtacacataaatatttttacgagacagggtcttgctctgttacccaggatagagtgcaatggcgtgaccatggctcactgtgacctcgaggtccagggctcatgattctcctggctcagcctcctgagtagttgggactagaggcatgatatggtttgaatctgtgtccccacccaaatctcatgtcgtatcataatccccagtgttggaggtggggcctggtggagaggtgattaaatcataggggtggatttctcacttggtactgcctcgagatggtggatgaggaatgagttattgtgagctctggtcatttaaaagtttgtagcaccttccctttctctctctcttcctcctgttctcgctatgtgagatgcctcactccccctttgtcttctgccatgactggaaacttcccaaagcctccccagaagcagatgccaccatgcttccgcacagcctacagaactgtgaatcaattaaaccttttctttataaattacccagtctcaggtatttctttatagcagtgtgagaatggactaatacttggctaattaaaaaaaaaaattgtagagatggggccttgctttgttgcccagactgaattcctggactcaagttattttcctgcctatgcctcccaaggttctgggattacaggtgtgagccaccatgtccagccagtattctattttaaatgtaatacaggcaactaagagaagaatcagtagggtaatcagcatgcacagggttaaaaaccagatcctatagaatgattagatatctgggtaactgtaatttggggacaaggacttacagacacaggaaagcagcccttcaatacctgaagagcatgtagtatgaatgacgtaaaatttaacaagatttaacaaattttctcctattcatttactgaagaaaaaaaaaaaaacccacacacttctttccttccccattttaaagttattgttagtattgatatacagcatttaagattactgacttaaattactgacttagcatgtaagatgactgttacaactcaaattatacaaaaacagattatcaagaatatttttattaaaatcaatttaagatattattctctcgattatcctagaaagaatatatgaacataataattaaacataagcttaattatataataatataaaaatatataaacctaatttgtgaagttagaagatagggtatttcatgaaccttacctgtagattcagtggtgaggaaaataaacaaggcttgcactagccaagtctgcaacgtcaacatcttgcgcggatatttctgcaacagacacatgtaatattacttttaatattttttctcttatatacacataatttaagacacaatcttgtttccatgctgtagctgtgtttctaaaaggtggtaaaattcttatgagaatgtagaaaacttaagtcttcacattatttttctttattcccactgaagttatggctatggaaaacactgctagaaaacataatttatactttaaggttaattaaaagagatatcttgtttctttcttatgtgaagtcttatattagtaaataactgtgagattaagaacttcagactgacaaatttctacatggcaaaactcaccataatatgtatccttaaaagatacctgacaaatggaaaaaaatgtttgtaattcatagcatggccaaaaattttcccgatatataaagaatgcctacaaatcactaaaaaattctaacacctaatagaacaggcaaacatatttgaatagtttatagaaaaggaaatacaagtaaatcaagcatgtgaaaagatactttcaacctcactcaaaatgagagatataaattagaactactcagataggaacgcaaaatgatacagacactctggtaaacaatttgatagttcgttaccaagttaaaagcacaccataagacttggtatttccactccaaagagcgtactccccaaaataaaaacatatgcccacaataagacttatactcaaatgttcacagcagcttcattcataagtcccaaactggaaacaatccaaatgtccaccaactgctgaatgtataaacatacattcaaacaatggtagagacatataatagaatactactcagcaaacaaaaaaaaaagagtatgaactggtgatacatgcagtagtatgaatgaatctcaaaagcattacactgaataaacgaagccagacacaacaggttatacattgtataactctatttacaggaaattctttttttttttaagagatgggggtctcactatgttgcccaggctgtctcaaactcctgggctcgagcaatcctcctgcctcagcctcccaaagcactgggattacaggcatgtgcctcagaaattcttgatacggcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggccgaggtgggcagatcacttgaggtcaggagttcgagacgagcctggccaacatggtgaaaccccatctctattaaaaatacaaaaagtagcttggcgtggtggcgggtgtctgtgatgccagctactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggcttgaggcaggagagctgtttgaacccggaaggcaggggctgcagtgagctgagatggcaccactgcactccagcctgggcaacaaagcgaaattctatttaaaaaaaaaaaaagactacatttgtcaaaattcactgaattctgtgtcaactgtttcaaaggcactgagattttaccttactttcaagctaacaagtcagcctaccacagtgtcatggatactggcaaaaggcatgacatttttgcgtcagaagcaaaggactgtattactcataacagtagtcagagtatcagcattttcttgcgccagctgcttgagtcccaactgtcacagggcattgtgaagtcagatgacacctgaacaggctgcttcacaggaaagaaagacagatcttaagtaaccctaaacttgaaaaatatgcaggaagcatgtctgccatttactctagagggagacattatctgtatctttgaagactgtaagtaagcctgtcctttgctccacggctctgagagtctaccttccaacattctttaaaaggtaagttggctgggcatggtggctcacgcctataatcccagcactttgggaggctgaggcgagtgaatcatgaggtcaggagttcaagaccagcctgaccaacatggtgaaaccctgtccctaataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaacgcagaaatgttagactcatgggtttcctatcaagttgtaactaaaaaatggtgaattttattgtttataaattagaccttaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaatctcatatataatacagaatgaaagaaatcagacaggttgggtgcagtggcccacacctgtcatatcagcactttgggaggctgagggggaagaattgcttgaggccaggagttaagaggccagcctgcacaaaatagtgagaccctgactctacaaaaaaattttaaaagagaaaaaaggcaagaaagtacgctctgcatgatttattttacagaagttcaaaaagaggcaaaagtctacggtgtttggtgacagaggtcagagcagttgttttttgtgaggaagggtataaaaggggacattctgggtgctgagcatgttctgtatcttgatctggacagtgataaattcactgagctgtacacttatgagttctgttttgcagtatgtaacaaaaggtaaacaaaccaaaaattatcccaataccattcttacatattagtgttggcaaaaatataaaaacccaaaaagtatcaacagggtgttgtgagactaagcaacgaaagtatcgtcacacactacaggttatagtgtaaattggcataagcttcccaatacattgaacactttaaaaatggtcagttttgttgtttgtaaattagacctcacttaaaaacaaagaaaaaagctctacccaaacaaggcagagagccagttcggcaatatcaatcaaaattaaaacacacacatttgattctaatgattctactttattttatcctacagatatgaataaaacaacacatgtacaaagttattcactgcattgtttttaacagtaaaaggctgaaacaacctgattatgatgggacactagttaaatgatggtataccaaaaccatgtaaatgtaaatacttgtagccatttaaaaaaaatgaggaagctctatatgtacagaaacataaagttatctaaaatacattgttacattgttaaggtacagaacaacgcatttgctattatttgtgggcaaaacaatatacaagaaaacaaaacacacattcgtttttttatatatgcacagtatctctaggaggataaaagttcaaatactggctgtgacagggtatttgagagatcagggtggtagggagacgctccaccatatactctgcagccttgcaatgttgaccatgtgaatctttagtacttatgcaaaaaataaatttaaattaaaaaatacttaatgtcagctaggtgcagtggctcacgcctgtaatcccagcactcagggaggccgaggtgggtggatcatctgaggtcaggagttccagaccagcctggcctacatggtgaaaccccgtccatactaaaaatacaaaaagtagctgggcgtggtggtgggcacctgtaatcccagctacttgggaggctgaggcaggagaatcacttgaacccgggaggcggaggttgcagtgaacggagatggcgccactgcactccaggctgggcgacagagtgaaactccgtctcaaaaaataaataaaataaataaatacttaaggttcaaactattgggtactatgctcaccaactgggtgacagttcaatcgtactccaaacctcagcatcacacaatatactcatgtaacctgtacatgaactccctgaacctaaaataaaagctaaaattattaaagacaaaatacttaatgtgtaatttttttcttctaaataaaactattaactcttcttgatgagaaatggcttcctagttctgcacttggaacacaatattgttttattaaatatacatactaacttgattttatgcactccctaatcatgtaacagcttgccagcatgcccagctaattttttaaaaatttttctgtaaagatgggggtctcactatgttgcacaggcaggtcccaaactcctggtctgaagcaatcctccttctttggccacccaaagtgctggaattacaggtgtgagccactgtgccaagccaaatgtactatattcttgcaacaaagctgctccagaacaagaggtccatgaaagaatttatgattacttcaaagcaattagatttgtttgagtagtaccatggaacacaagcaaagcgaactaggcaaaggtagattccacatttcacatttagaaagtaatctttcctaatttttaaaagattgtaatggagaggtgatgaagaaacatctattatgggacttgatttcatagtccaaatctaagagatgaagacacagtaacactatataaaatattatatgcaatacagttaacttcacttggggcttgcttaaaaattgacagaattatggccgggtgcggtggctcatgcctgtaatcccagcactttgggaagccaaggcaggcggatgacaaggtcaggagttcaagacgagcctaaccaatatgatgaagccccgtctctaataaaaatacaaaaattagccgggcatggtggcgcacacctatagtcccagctactcaggaggctgaggtaggagaatcacttgaacctgggaggcggaggttgcagcgagccaagatcgtgccattgcactccagcctgggtgacagagcgagactccatctcaaaaaaataaaaaaaaaaattgacagaattgacagtagtttgcttattttttccctcctttccttctgttgatactaatatttaatttaaaattatattaatagcactattacctcacctcttgcagagttttctatgcatatattataaccatacattgcatacactaaccttccttgaaatttgcaggtaacttgagaagcttctatgaagccaaaacctaactagtaaccataaatacaggaaagattatttctgaaaaccaaaagctgtaatcattcctcaactatggtgatataacatggtagtgtgccgaaaggagctagatgatgtataacaagtattgctacttttaatgttagagaaacaaagttcataaatgatttatttaaaatagaataaattcaagattatccctatagttgttcattctcatttactttcatttccatatgttttctcaagtgagagaaaaagcagtagagttacaatggataaatatttaatggttaggctctttataaattatttttgtcacctatggattgtgatttttttttcattttctaacttaacctaaggatgaaataaaaagcacgaatatatttagatttacattgcatgtgaaaaagaatgtcaatataaactttgttactatggtaacattactattacaattgtagaacagtatatgaactaaaattgccaaatagaaggcaaaataatgcttgttgaattaataagttgcgtggggatcaagatgaagaaaatttctatatatctttcacagtacagtgttactgtgaataaactgccagaagttggtaatacctacacaaaattaactaattattaaattagtttttaaattatccactctgttctcttccattagtatcaattatgagttcataacaattaacactaggatattattttacattacacaaaatgttgtcacataaattatttcactttagtctcctaatatcctaaagaatcaggtgagtagggcagggattatttattggaactttgtaaaataaaaaaacaaaaaattcagacaagatcaattacttacccaaatcacaaaattagtaagtgaaggagtagggatttgaagctaagtcttctacttctaaatgtcatgctttttccattgggtttcactgtaaagagaggagagtcttgttcagaaggctggctttgataattttattatatgtgtactttaaaaatccccatctgctcttaggcttttgggtttgcagaaagtatcctactttagatatgttctgagcttcagaataaaataaacccataaacacttgtataagagtattcaaatattctagtgctttttttttttttttttgagacaatgtctcactcccatcaccaggctgcagtgcagtagcacaattacagctcactgcagcttgaacttcccaggctcaggtaattctcccacctcagcctcccgagtagctgggactagagatggcaccatcatgcctagctaatttttttatttttagtacagatagtgttttgccatgttgcccaggctgagctcaaagggatctgcccacctcagactcccaaagtgttgggattacaggcatgagccaccgcgcccagccctagtgctatgatttgatatacgcttgcaaacattattggctcacccacacctaatgcaaacttccctgacgtctatgtaatgtcacagaaacatgacaggaacatttatgacagacggagttctttaacaatcacatatttcttcttctactagcactaaattaagcctgctaacaactattctatgtaaccagagataaaaatccattttaagatttgttcacttaaattctagcttaagtactagtgctcctctttgaaatacaacaagtaacttcaaacttaggcaaggagttgaatcttccattattgtttcatacacattaagcctttgatataacttaataacacataaggaattaaatttataaaaatattttttaaatgtctaatgaaaagaaactgaaaaaatgccatgtgaaagtgcactataatcccaccaagagataactaccatgaacattttggtggatattcttgcaaaattttttatacatgtattatataactttacattgtataaatatacacacttttctattttacaaagatgggatcatgtaagtgagaaatgttttataacctttttcacttaacactacatagtggacatcttcataagttaatatatagagagtaattccttgtagcctttgctcaaattcacctcctcatagagatcttccctaaccaccctgtgtttcttatacccctttactgattttttttttttctacaacacttaacaccttctaaaataggctagcaaacattttctgtaaagggccagataataaatattttagatttcgtgggctttaagttctctcttgcaattagttaactccgttattaaagtgcaaaagcagccatacacaatatgtaaataagtgggcataggtatattcccatgcaactttatttataaaaatggctgcaagctggatttggcttatgggctatagtttgccaacccctgttctaaatacaatataattaaattaattttctttttgtttgttatgggctgaactgttccccccaaaaaatatgttgaagtcttaaccccagtagcacaaaatgttactctatgggcagatttaattggatgttatagtggagtataataggcctttagtacaatatgactggtgtctttaaagagacagagccaggaagaataccatgtgaatacacaggcagagattggagttatgcagctgtaagctaaggaatctcaacgacgatggctaccaccagaagctaggagaggcaaaggaagattctatccaaagtctcaaaaggacttctagcctccaaaaccttgagagaataaatttgttgttttgagccacccaatttgtggtacaggttgaacatcccaaatctaaaaactgaaatgctctaattccaaaacgttttgagctctggcattttggatttcagattttaggatttgggatgcttaactttaagtatataatgcaaatacaacacaaactgaaaaaaaaaaatccaaaatccaatatacttctgttactaagtatttcaggtaagggatactgtaacaaagggatgctctattacagtagcccctaggaaactaacacatagtgtgtgtccccaaaatagaaggtaagtgaagagtggaatggctaggccctacggcaggtgtgtgcttggctatatcttctttgatgatgtgtctgttcaaacatattgatcaactgggtttcctgttttctcattaagttttgaaagttctaagaagatattctggcctttattagaaaatggatttacgcattattttcttgtatgcttgtcttttcattcttttaacagtatcttttgacgaataggaggtttaattttaataaagttcaattcatcaatttgtgtttttgatgtatctaagaagtctttgcttaatctaaaatcataaagggcccgacgcagtagctcacacttgtaatcccatcactttgggaggccgaagtgggtagatcacctgagttcagaagttcgagaccagcctgggtatatggtgaaaccctgtctctactaaaatattttaaaaattagccgggtgtggtggtgcacatctgtaatcccagctacacaggaagctgaggcaagagaactgcttgaacccgggaggcagaggaggctgcaagtgagcagagatagcaccactgcactccagcctgggtgacaaaatgagactccttctcaaaaaaaaaaaaatataaaaaataaaaataaagtcaaaaaggttttttcctacaagttttatagttttagggtcatttaggtctcagttatttcaagttaatatttatgtgtggtgtcaagctgaaatttgagttcattttgtatatacggataattgtttcaaaactatttgctgaaaaaattatcctttctcaagtgaattgcctttgcgtctttcttaaaaatcagttgttcacaggtgtgggtctatttggctactctcaattccagggtgggcaagcttttcatgtatgaggtaggaggtaaatattctaggtttgtgagccataaggtctctattggagctaccaatctactgttacgacacaaaagcaaccatagaaaatacataaacaaacaggggtggctgtgttctaacagtactttatgaaaacagaaggtaggatgactcctactctatttgttccactgatcaatttgcttatttatatgctaccaccacactgtcgtgatgactttagccttataaatcttgaaatcaatattctgtgtgcacttaaaaagcactgctgctgctggtagagtgttacataaatggtcattacgtgaatttggttgatagtgttcaaatcttccatatccttactgattttctgactactacttctatcattgttcaaaaagggatattgaaatccctgaatataactgtggatttacttctccttgcagtttttaccctgttgtgttttgaaactatgttatttggtagatccttttgataaattgacccttttatcattaggaaatgcccttctttaccactggtaacattctctgaaatctactttgatattactatagccaattctgtcttactttgattagtgttatcatgacatatcctctcccattcttttttgtttaatctgtatgtttcttcatatttaagtggcatctttagggggtaggcagcatgtggttgtatccaatctgataatctctgctttccaattgggtgttcagaccatttacatttaatataatttgtgatatgattaggtttaaagctatcagcttcatatttgttttcttcttgactgttctttgttcctgtttacttttctgcatttatttttcttaattattttttattctcttttccttgttagctaataagctataattctttgttttcttattggttgctttaggtttatagtgtacatctttaacttttcacaatctatcttcaagtaatattatgtcacctcaggcatagtatataatagtatacttccatttctccccccagacctttgtgctattttagcatatattttacttttgcatatattaaaacttcacattggtagctcccacctgaaatcccatcactctgggaggccaaggcaggaggatcacttaagcccagaagtttaagatcaggttgggcaatatagtaagactctcgcctctacaaaaaataaaaagttagacagctgtggtggtgcatgcctgttgtcccagctactcaggaggctgaggtgagaggactgcttgagccttggaggtcgaggctgcagtgagttgtggttgcactactgcattccagcctgggtgacagagtgagactggcacatatttactcgtgtggttaccatttctagagcttttaattcctttgtatagatccgtatttccatctggtatcattttccttgggcctgaaaaactgcctttaacatttttttgtagtatggttagagaaaagtctaaatagatttgaaaacaaaaccaaagtgtgaatgctaacaagtatttagcctaaaataagcacagttcaaaatgagaaaagatactgctaattactatattaacagaccaaaggaaaatgacagggtcattccaacagatgtttgaaaagcatctgataacattcaacaactgttcatctaaaacttaaaaataacaacaaagtgtcagaaaactaagactgaaagagaccatccttaccttggtgaaggataacaaagatgatacagggactctagaaccagattgcttgtgttcaaatttcagtccctatattttaacatcttaggcaagtttttaaatagccttcacttttacttcctttatctgtaaacatggggtaccaccaccacctacccatctaggaatgttatgatgattaaataactcattatacataaagtgcttagaatcatttggctcattgtaactactcaataaaaggttaacagctgttattattagtgcagctcttgctgttgctgccacaggtactactataagaaacctacaaggccaggcatggtggcttacgcctgtaatcccagcactttgggaggccgaggcaggtggatcacaaggtcaggagtttgagaccagcctggccaatatggtgaaacgctgtctctactaaaaatatgaaaattagctggtcgtggtggtgggcacctatagtcccagctacttgggaggctgaggcagaagaattgctcgaacccgggaggcagaggttgcagtgagccgagaatgcaccactgcactccagcctgggcgacagagtgaggctctgcctccaaaaaaaaaaaaaaaaggaagaaagaaacctataataagcatctataggtttaaaggtaaaaattagaagcgttcctattaatgtcaagattcagacaagatgcttgaagtcatcagttattcaccactgctctaaagggcttaagcaaaaatataataaataagatctaaaaatggaaaataaattgtgaatgatatgatcatctatcaagaaagagtgagaatcacatgacaaactattaggactattgagaatttaacacagtagtcaaacaaaacatcatcaaaaaataataggactatttagagtttaacataacagtcaaacaaaacatcatcaaaaaatagctctccagctggcgcggtggctcacgcctataatcccagcactttgggaggccgagataggcagatcacctgaggttgggagttcgagaccagcctgaccaacatagagaaaccctgtctctaataacaatacaaaattagccgggagtggtggcgcacacctgtaatctcagctacttgggaggctgaggcaggagaatcacttgaacccagtaggcggaggttgcagtgagccgggatgtcgccactgcactccagcccaggcaacaagagcaaaactccatctccaaaaaaaaaaaaaaaagctctcctacataccagtaataactaattagaaaatgtaacagaaggctgggtgcagtggctcacggctgtaatcccagcactttgggaggccgaggtaggtagattgcttgagcccaggagttcaagaccagcctaagcaacatggcaaaaccccatctctataaaaaataaaaaaaaaataaaaaaaaaaatcagccgggcatggtggaccatgcctgtaatcccagctactcaggaagctgaggtgggacaaccacttgagcctgggcttatagaggctgcagcaagctaagaagccaagatcttgccattgtactccagcctgggtaacagtgcgaggctctgtctcaaaaaaaaaaaaagtctcgcagaaaaaaaaaaaaagggcagtctaaaggtaaagtaaacatagcactgattggcaaatgaatagacaactaaatcaatggtacaaaacaaaacacactcaagtgtatataagaatttagtatctgattttttaaaaggttgctcatttgctgggaaaataaaggactattcaataaatagtattgggacaactggctccataagcaaaaaagaaaaaaaagaaccccatttcatcagacaaaaagacacacactcatgcacgtgcacatgcatgtataagcatacactctctctccagattaaggacctaaatgcaaaagcaaaattataagcatattgaaaaacacatagaatatgcttatgaccttagggccttttaaaattagactattttagccaaatgaaaaggtttacagagcactttgatgaacatccatgttctcaccattgcttaagaaataaaagctcaagcttttattcaatttttattccgttacaaacataattgaagccatataaatagttcttgcctttaagaagtccaaagtttagagatgcagaatatgcacaaagtgccacaggagcacagaaaatacccaattcagacaggggccaggagcgcccagtcttaaaataagggtaggggttcctagatagagaaaatagcacacatatgaactctacatcatctttgactctaattgtcaagtgaagattaccaatgacaaaatcccagagcatgccagtctaaccagagctatgctatctgaaacatagctctgattaactcactttgcactagggggtggggttgggggtaatacataaaacagaacatccaaacaaaaaaagactgagcagatcaatcaaccttagagcaaagggtgaagctgattgcttaaaagaaaatgaaactttggaggcagaacattccaaatgtaacagggcaacagatttacagtgctgaaaggaatgaatctcctgctctggatatgtatacacacagctttaaaacaatcatctatatactatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatatcctggtttctatgtaaccagataatgtagttgaattctttcctttatcctctttcttgtctcctttactgaattctctgctagcttttatctccaggctatgaaggtacccaaagataaagtactgggcatcgacttttctttttaaataccaacttctttgaagacatgacttcaactactaccttcaaacaaaataatttcaagaattttggcttggatctttcttttaattccagttacatttcatcttcttagatattctgtctctgagtcttatcaatttaagaggtctaaaaacaatacaccataggtacatgctcatgaacacatatacacataaatgcccacccactttttttgtttattatactttaagttctagggtacatgtgcacaacatgcaggttacatatgatacatgtgccatgttggtgtgctgcacccgttaactagtcatttacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggacatttgaattggttccaagtctttgctattgtgaatagtgctgcaataaacatacgtgtgcatgtatgtctttatagcagcatgatttataatcctttgggtatatgcccagtaatgggatgaatgcccacacactttttaaaaagtcacaaggacttaccatttttccctatctacaaacaactcatcctcttcaactgcctaagtcaatggagtccatcgtttctctcatctatgcagtacattttagcttttctcagttacaaatcttatcctgtcttctctcccataatatctttcccacccatctcttctttttactctctaccacaaactaacctaatttggacattgatcacctcaataatttcaactgtgttcctgcttccagtctctttcctccccaccaagcattctgaacattgttggtggatcactctctctacaacacaactttaaacctgtcattcttctcctcaacagctttttaaagggtgaataataatgccaaatattctaactatttaagaacctaaaattttggctttgatgtgcctatccaatctatcttttccaatactcaagtttctctattctaaaaaaaaaaaaaaatcctttcctcagactcctccctcaagctaccttactactatacttctagagagaactgcttgcaattgcaagcaatctggcttttttactccaataatgctgaaattattcttgtagtttccaaactgcaaagcaaatacttaagctcctcattttgcttgaccacaccatgccatttataattcggtcttatctttcatcactccctactaaccatccctgtagactcagcaaaccactagacttcctctaacataccttgttctttcagtctgtgcttctacatatattattccaatgtctttcctgactctgctgtgcactacaaactgcttttgaagtatcatctcttatatggaatttccccccacttcaaacatctttgctgtcagtgtactcttacatcattccctaacaggactcagaacactgcacagtaattgtttcacatatcttgatatcctcagaatctaccatagtttgaggcacctggtggacaattaagggtgggtttttatagactttctggtatgatcttattttctatctactcgctgtcgctcaagcgtactgtatggagacgcaggatgtatcatggttaagaggtcagattctgaagccaggctgtctatgtatgacctttagatctaccacttagctgggcaaattaattaaccttcttgtgcctgggtttccctatgtgtaaaaagaggattttatcctattattattagacctacttcataatattatgaagattaaatgccttaatatgggcaaagtgctcaaaacagcaactggcacaacataagcactaaatatattgcctgttttaattaatagaccttagttactgctgatcctttccacaagctagtcctatattatgttctatattctccattctacattttgtcctccattcgctattattaatgggctgtcttcatttttccctttatccaaatcctacccaggtttcaaggccaacttctggtaaatcctttgctcattccaatccttaaatgctcactccaatccttaaacgatcattccctaattttaatatctacaggattttctgcatcactctgcatttaattaaaactgctttgcatccttgtagtttttttcgtataagtttgtcaatccaattattataaactctttgaaggtcctgattacatctcctgcacctttgtgagttcgtacagcaggtagtaattgcttagtatttgctgtgtaaaataataaagcacaataggaacctcaactctgatcattctgcctttgcaatcaaagaaacggagaagctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagttttcagcgagactcctgtttccttctctataaaggggacattttaacacctacttcacatgtatttaactttcgccctaacactgaactgaagtgcaaagccttggaaacaaatttaaataaattgaaaatactgcaattcacaaataagagtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtcctttttgacactttctccttcctgtaatttttttctttcactcaagattaaaaacaaacgttcaagattatccctaaagagaaatagttggaaagcacaatttaatagcaagttggttctataaatgtaatatttcagttcatagttcaaaaatacttccaaataggaattaacatgaatttaagaaattaacataatggcacacagctaaactgatgatctgagtccgtaatttcaaattaagagttgttccaacttgaagctggcagtcatacacagtttaaagggtttgtttacagcactgtcaaaagcaaataccacaatctttcagaaaattcaccctggcattctaataactagttattttaaggcagtataattgttgaaatacttcacaaactaagccaaaatgcgtttccttctgaaggcaaaaaaaaaaaaaaaaaaaaaaggtgacgtcttatttttaacctgtgattttttttttttttcagtttcggattatgaaataaaatgctgttcatccactgaagaacagacccttgcttcctgcactatcttcaaaagtttaggtcggaggaggtaaaattttaaaaactgatttgttctccttgggatacagtgagatgtggaattcgttaggaatgataattattaatagaaaagatcaaaagaaggaaagaaacgttaatagtgtttataagcattgtgaactttcaacaaagctgaaacgttacgatttcaagatgaaaaaacggctttggggaagggaaatccacctcgagaatgaagacaagtgcggagcgaatagaatttcaggggagatgaaaaggggattgggaaaaacgtgggatctggtaacaaaaaggggggtttgttcttgaagggcgttctgcggggcgggcgttaagaggggtgcgtgcgtgcgcctgggtgaagtttgtactcagggctgcgataatcgaggtgacaaagttgtggaagtagaattcggaggtccgggagcaggaaggggaaggaatgtggggatttccaggctgggctgacaagttccgggcgctgctctcagggggaagggaggtctcctcgagtgccagatagcccgtccgaaaccaccgacactctaactccagctacgcgacccagcacccggcccctcctcacctcaggccgcgccgcctcgaccctccgcgtctccacagcgcacgaaccccttggcgccaggctgggccagacccgtcggcctggcaggcgcggcccccggttcagctgcgccggggcggcccagcgcgactccgcgggccttttggctgctcgccccggctccggaacactgtcagatccttctccgcagaggtagcgcgccaccccagtcccgcggcggggcggggcgctccccaatcccgcccagctgcgcccccggccggccaacgctgcgccccgccccctaccgggacctaggcgctgattggcccctgagagaccctttgcgcccaggcattggtccagtggccgcctgtcgacgagggggcgggactccgaggggtagcgattcccgtaacgcggctcttcgcgtcccggattccggtggctgcgtccgcgtcgcctctcccagactagatcgaagggttccccccacctcccctctgtgggcggaaagagcggaatgttccatttttctgtggaataacggggtcatgaactggagcccgggtgctgcccgccgcccgctgcccccgccctcccttctcgccagggcgcctgcggcctctcttcgcggccttccccgagggactcagagccgcgagggaccgcctagctcccttggggatggggaaggcgtgggagcctcttggggaaagtgaagagctcggtggccgtgactccgcacgagactgcggcagattgtggcggcggcttctctccaagacttacgtaaacgagccttgccacagtacttttttaaattagtaaatgagtttgggtgcgattgatcagtgagccccagaggtggtggcccaccaagcgactagtgtttctttgcggtttgtacctccccgtttatgataaaaaataccgggtaaaaacctattcatcccgcctccgcccccccctttccctcagaaaatggacctcaaggctcatgatgtttgtttctccccaaaggaagatgagaatcttgagttaaaagataaggcatgtgcgtgcgtgcgtgtggggtgtgtgcgtgggtgtctgtaaaagtaaacacccaaaggtagaggtttttgtggaagaatgagaggatataggaaggaaataatggtttaatgaacttaaattatatccataaattaacaattataaagttcttcattatattgaggattcagatagagtaaaacatagatcgaattttaatctcttagttgttgatcagataatttataaaagggcaaagtgggcctgctaacggagtcgcaggcaaagtagatggtgctgcagctgatgtgttcagctcttgctcctccctgtcatcctatatctaacctatagattgtgaccagattctgttctagctttgccatttagaggggtgtttattttaaaacaaatttttataaaaatttgttaaattgaaaattttgtatagatccaggaaacttgatttttttgttgttgttcacagtctcactctgtcacccaggctggagtgcagtggctggatcatgctcaccgcacgttcaaattcctgggctctagcgatcctcccacctcaacctcccaagtatctcagactacaggtgcccctacaatacctggccaatttttaaaatttttggagagacaagattttggtatgctgacccggctggtcttgaactgctggcaacaaacgatcctccggccttagtggcctcccaaagtgctgagataacaggtgtgatgcaaagatgtatttaggggagatgtatagtggttaaatgtaccctctggttctagattgcctaggtttaaatgctgatgcctctatttctcatctctgtgaccttgggcaagtcttttcaaatttcttcatctgcaaaatgagaataacaataccaacctaacaggattgttgcaaggattaaatgagttaaaatacatacagtgtttggcacatagtaggtgctctgtaagtatcagctataatcattattgaatgtctactcggtcaacacttctgaaatattttagtatcacaacatatattaaaaatgatgatattttgctggacggggaagggcaggtacacagaagtggattgatatgtcacaacacaccagcctgccttggcaccattaggaaaacaaatgactgagttagtgcttttatgggtgtctttttattggctcagctcaggtcctgctcccaagaaactcacattttatgggagtagttaaagtctgaggccaaaaggatgaatcaatattggagaagtatttttcagagcaacaggacggaagacctctgctgtgctggaattacatgactttgcagatacctctgtagagtattggccttgaaattacgaatttcagattaaggatttgttactagaaagccttgtcaaaatgcaaaggtaagtaggggaaagtagtatattaatggagaactctccatttgtgtcctgtgaccatttgagattttagatatgtcaagagcaggccgggtgcagtggctcacacctgtaatcccagcattttgggaggctgaggcaggcggatcacttgaggccaggaattcaagaccagcctggtgaaaccccaactctattaaaaatacaaagattagccaggcatggtggtgggtgcctgtaatcccagttacttgggaggctgaggcacgagaatcacttgaacccaggaggcagaggttgcagtgagctgagatcctgccactgcactccagcctgggtgacagagcaaaactccttctcaaaaaaaaaaaaaaaaaaaaaaagagattgaggaaactgtacagtgagaaagtaacatgaaggcaccaaaattacaattacttgggagtaagtgagcaaagcttaggaaattgtgccatggaacaaaggtgataaatgtcaaagacaaactttgcctgcatttctaattccctaaatctggtgctgactaggatatccctttacttccttgtctgtgcccagttatgtttctgaaattctgtgtcagccctggaattatcctcatgttctgtatcaccttaatgatttcagcatccatgttcatgactcattagcactctgacctcacaatttctcatcgttttcttttccaatcatcttcaacttcactctgtatcagcaacccacagatggagccacaccttcaacctagtcatcaatgaaattacttcccctccaaaatgctggattgtgagtttccctctctgtacctacagccacctacccccatctatctctattctgtggtcattcccattgaatctgtaatttgtcctcaatgtgacagcctgacagccagtctttcttctcatagtttatcagctgtttcctatcattttttatcttacttaccagtaagaaccccctttttttttttgagacggagttttgctgttgttgtccaggctggggtgcaatggcacgatcttggctcaccgcaacctccgcctccctggttcaagtgattctcctgcctcagcctcccaagtagctgagattacaggtgctcaccaccatgcctggctaattttttgtacttttagtacagacggggtttcaccaagttggccaggctgatctcaactcctaaaagtgatgggattacaggggtgagccaccgccccccaagaacccttttatcaaccattttaactgcactattctcttcagttcccttgaccttcagctatgtttaccttatcaggctatttcctaactatttcctttttccttgagctatcagccccaccgtaacatttattcttagtacagaaccttgttttactcccttaaaatcaagaccatcatttgtgagcatccttgacttttctccaacttaggaagcaaatagatatttatcctctttctcttttccccactcagaggaagaaaggcccctttacttttaaaaggttaatttctcctcctctgttcttggtactactttaagtctagtcccctagttttatatttttcattattaacactaaatgactttgaaatgtttaaaaattagatattaactcagtggtgagttgaggacagcctctctgcctgtgttaaaacctttgtaacctgatagcacctaattcaccaaaattaaaaataattaaatgtctaaaaatgaagaatgttaagctacattgaaattcacttaacaaaatgaggtgagaatgaaaaatgaacttaaatttccaaactagaagacaagagaaattcatttcatagcaacaaaactcaaaaccattatgactgctatttcaaaaaatgttttgaagaatgtatattcagaaaaatcaacataccataagagtacagcctgaaaatttttgacaaaatgaacacattcatgtttatcatctatatcaagaaacagaaggcctggcacggtggctcacaccagtaatcccagcacttccggaggccaaggcgggcagatcacgaggtcaggagttcgagaccagcctggccaacgtggtgaaacctcatctctactaaaaatacaaaaattagctgggcttggtggtgcattcctgtaatcccagctactggggaggctgaggcaggagaatggcttgaacctaggaggcggaggttgtagtgagccaagattgtagtgagccaaggttgtatagtgagccactacactccagcctgggtgacagagcaagacttggtctcaaaaagaaaaaaaaaagaaagaaatagaaaatagtctgggtgcggtggctcatacctgtaatcccagcactttgggaggccagaggctaaagcgggtaggtcacaaggtcaaaagtttgagactatcctggccaacgtggtgaaacccagtctctactaaaaatacaaaaattagccaggcgtggtggcacacgcctgtagtctcagccactcgggaggttgagatatgagaatcgcttgaacccgggaggcagaggttgcagtgagctgagatcacgccactgcactccagcctggtgacaaagtgagactctgtcttaaaaaaaaaaagaaacagaaaatgaccagtaccccaaaagggccctcctcccatccagttattggaaggtcataactgaccactattctaatgtcatagcgttgtacccaagcgagttagagaaaacgacacactttgagacgaattaagagtcctttattagccagcgaccgagagatagctaacgctcacaattctctctgccccgaagaaggggctagattttcttttatactttggtttagaaaggggaggggggtctagttaaaacaattttacagaaataaagtaggcaaaaagttaaaaggataaatggttacaggaaagtaaacagttccaggtgcaggggctttaagactattacaagatgatagactcagggctttgggtgttatcaatcagacgaattcctgggaattgcggatatagcttgccacagtatcttatcagttaattgcattcttggatgtgctgggagtcagcttgcacaagttaagtccttgaggaaggggctgccagtgaaagagtcaagatggagtctgtctggctctcttagctaagggagagtcaattcaggtggaaacaagcctaaaaacagggttagtaaaaacaaggttgggcattacaatagttttatgctgtctttttaaacttgaaaagtgtacagaaaaattttttcacatcagatgggtaatgtgccaacgtcgtaacaaggtttgcgggaggcacatctcacacatgcacatgaaaacccaatcatcaggcttataaactacaaaagaatctgaaacttcttaggcttaatattaggttggtgcaaaagtaatttctgccattacttttaatggtgaaaaccacaattttacaccaacgtaatatatttacttattttattttaatgaatatactaaaccaagagagtttaaaatgaaataagtactgctctgtggccgggcgtagtggctcacgcctgtaatcccagcactttgggaggccgagacgggcggatcacaaggtcaggagatcgagaccatcctggctaacacggtgaaaccccatctctactaaaaaatacaaaaaattagctgggcgtggtggtgggcgcctgtagtcccagctacttgggaggctgaagcaggagaatggtgtgaacccgggaggtggagcttgcagtgagccgagattgcaccactgcactccagcctgggtgatagagcaagactctgtctcaaaaaaaaaaaagaaagaaataagcactgctctgtaaaggtaaacacagaggaagggatctagctcagagatctccatactgtggacttccagggataaccctggtcaaatagccatgggctggtcaatgattttgagttactctttgagagggaagcttggcttcagagaaggaaaggccagtgcaagacatgtgagcagcagttaggtgcatcctattcctagacacatacataggataaggaagtcaggtattgggactgtagctttggaatggactatacttgcttcagaatattatcagggggagtttgagaagcaagggctttccttcgttgattctcctttcaccagtcttcctggaaagaatattctgcagttacaaaataggttccttggctgccagtctgatacttgtgctaaaaccaaatagatgaaaaagtatcaacatgaattttaaaaaatatattgtgtgagcttgtatagctaagaattcccagccccctacataggatctgaagaaagatctagtactaattgtattaaataatggtttaggcaaatgtgtatctgtctccttaagagaggaaggcagtccctactgtaaagtaaaaatgaaatggatatacttcctgagagggctggaattttctgataattgtcccctctgatttttcacaggatttacggaatggccatcttccataattaacaaataaataaatgaaatttaatgtcagggtcaaatgaaactggaaacaaagcttatctggtgatatatcaaattatgagagtcattatttggatgtaaggatatatgacagatagactcttaggagaaatgctatgacctcctgcttcttggtattccttgtgtgatttcctcctcttgagtgtgaaggcatgtatgtcattgagttatataagatagtgcccatcttgctagtgtctctctctctcttgtggctctgaaaaatcaagctgcctgccatgtttgagctttgatatggaaagacccacatgttaaggaactgagggcagactctgccaacagctagctttgaaactgaatctcccggccaggcacagtggctcatgcctttaatcccagcactttgggaggccaaggtgggtggatcacaaggtcaggagttcaagaccagcctggccaagatggtgaaaccccatctctactaaaaatacaaaaattagctgggtgtggtggcaggcacctgtaatcccagctacccaggaggctgagggagagaatttcttgaacccaggaggcagaggttgcagtgagctgagatcacgccactgcactccagcctgggtggcagagcgagactccatctcaaaaaaaaaaaaaaaagagagaaagaaaccaaatctctcagtcctacaacctcaaggaactgaattttgccaacaaaagcagatccttccccagtcaagcctcagatgagacagcatcctcagctaacaacttgtttgcagcctcatgagaactgaagcagagaacccagctaaactgtgcctagactcctgaccacagaaactgagataataaatgtgtgttgttttaagctgccaagtatgtgataatttgttatgtagtggagaactaatacaacagggaaaagttaaaagctattcacataaatatttataatggatactatttctacacatttaaatcaagcttctcttacgttcataagaagatacgaatctggagaaggaaattatatcaagcagaacgctgctctggtgttgtgaagacgggatcccaccattctaatgtattcaatttatttattcaataagttttgagcatcaactatgttccaggcactgagatattaatctaaggaagacacacgtgttgtcctcattgaggagctcaaaagtctaatacataaaccaacaatcatacaaaaatcatagccatgttacagtgctatgaggaagatgttaagagaatattctggaagtactcatacataaatacttcagaaactgggcattataagaagtcagttgcctctctctactttcagttctacatttttataccttgtagtggatttaaaatggccacaaattcttcaatactcttctatggagagatttgagggctatttcccttcatcttgaatttaggcaggcttgttcagggtctggcttttaagaggagctttcaccttggtctgtggaagtcctgagtcactgtgtacaaagtccatctaccttattacaccatctggagagagctgagactacagggagagggggagtggcccggctgatcccagtcttcctagtgaccctgcccaggaacttggcatgtgagtaaagccatcttggaacctccataccagaccagccacgagatgaataatactaactgatcccagtcaatgccacatagagcagaagaactgcctaactgaattctttccaaactgctgactcaaaaatttgtatggtataataaaatgtttgttttaagtcactgttttgttaggagtaataagcaaccagaataaaattctaatctttatcatgtaccgtgctgaaaatctgaccatctcactctccttaaaactccgtcaatcccttcccattacccaaatccctcttgtatgtcatagaagtccctcattacgtgacctctacctacttctctggtcttgtctcctaacatggcctccaactccaggctctcatattacctatttgctaatggttcctgggccagcatccaacatactgttccctccttccatgccaagaagagacagcttattctgtttccttggccggtcattgccttcttcatttgctttgcctaacttgctcaccgtgtaaaaatattcatctaagtagttacttcctctcagaagtctgctctaggccatgagaaactcacagccaaaaatgcaaatgattccagatgatcattcactgtagaaaaggaattgatgggccgggcgtggtggctcatgcctgtaatcccagcactttgggaggccgaggcattaggatcacaaggtcaggagattgagaccatcctggccaacatggtgaagcccggtctctactaaaaatacaaaaactttgctgggcgtggtggcgcacaccagtagtcccagctactcaggaggctaaggcaggagaattgcttgaacccaggaggcagaggttgcagtaagctgagattgcgccactgcacgccagcctggtgacagaacgagactccatctcaaaaaaagaaagaaagaaaaagaaaagaaagaaaaggaattgaggaagagatttctagaccacagagcaaaaagggaatgggggaacccagataaaatggcagactgaaaaaattctttgctctttaagttagtctctcccaacatatacaatgtcatggatgctgtattagtcatttgaacaaagtgctatgttaattcagaaaagagacaattaattttccctggagagactggagatgctttctagaggaagtgtgacattgaagcaagttcatgaaagatgagtaggaactcactaagggagataatggagggaagcagttcttggcagagggaacagcaagaggaagcagtgggaatgcgaaaggacaaggtattaccaagaggtctggtgagagtagatcagggagtgcggggtgagaaataaattgagacgagaaggtggaggccttccttaaaagccatgctacacaggggatttacactttattttgtagggagatattagaatttttaaagcaggatactgttgagaacagatttgtgattcagaaagcaaattatattaatactgtgaaggatgaattgggggaacaagaaactggaagagagcttgaactagaatagctccttattttggaagagaaggaagagggtgttctgaataatgccagggagatagaatggcaagacttgacagtgggatatggtaagaaatgtatggacagatctgtgatcaaagcctgggttaatcattgcggataagctgtatattcttaagtaatttcttccccctcccctcccctcccctccccttccctcctctgtcctcccctcccctgttctctcctctccttttttttttctttgagacagggtctggctttattgcccaggctggagtgcagtgatgggatcatagctcactgcagcctcaaactcctgggctcaagcgacttttccacctcagcctcctaaggagctgggactataggcacacaccaccatgtgtggctaatttttttgattttttgtagatacagggtctcactttattgcccagactgatctcaaactcctgggctttcactctagttgtgtcctttgtggttcttggatgtcatcacccccacattaggcacctgcaggtatgtccttgtccccacctgagctctggatgtacattccatgctactttccacttttgtgtctcatggtcatgactgtaagtccccttggaccctttgtcagctaaattatgtgtctttcttgggggcccgttagcttttctgtgccactctcggggctgcaaaagattcagagggactgcctcagactttccctacctagggcactatatgtggtcatctttaccttaattctgtgacaacattgtggtctaggaaacatctgctaggctgctgcctcccaggattccagatgttaatagattcccaacattgtcatgagcctccaccatgtctccccaacttggagctaaccccaagtaaggggcatggtggaggaccttttcttagatctttattacctgaagttattttgcttaacactcatttctctacttttgcgctccccaacttggaaagtctttatctagcctaggggtgggggtggggtaggggggttgatattagtgggaggggcaattaagatgggtcagcaagtatctccccaaatctttctgtcttactactaaggcttttgaatttgagagtccaagagtttggcaccttcattctctgctagtcagtgggtttttgttgtttgtctttctaatgcaatcagggagagttgttaagtgaagagtgtagagagaaaaaaattctggaacaaataccttacttaaatatcttgatatgctgaaataaagtttttgtctcttccaaatatatgcatcctcttctcacatctgccaagacagtcataggtaagaaacctcaaattagaataaagagtatccgcttccttaatctgatttctgtgtgcagataatgagaagaggcgaaggatcaaccagattctgaaaacttgctttcaggtaccaggggccagagcataaaactagatattttcccaggattgattgatttaggtactgaccctcaggggtcacatagaaaatttcccagtgacattaaaggaagcccatactctattgtgtaagaaaagagaaaaactaaacaagctgccaggtgttgaacttctccttgtgtccagttctcgttctgccttgtggagctgtaggagagggtcaccaatgcccagacatgccattacaccttcccttcttttgcccaccttcttacctcttaacatcattctcatgaattttttttcatatacttgctacctttttctaactttataaagacagaaaaataaatgaagaatgaatcatctgtcttgtgtgttagatgtcatggcaggaggtagaaaggaaactgaatatgtctttaaacccctggagcatctagctacagatggactaaatggtccaacccaaatgcagaaaatcagtgtaaaccacttagactgtgattctgatttcaataaaaagtgaattttttttccaagtaggaatatgttaagctgttttctctaatcagagacaaattttcaatgcctggataacaagtattatcctaagtgctacccctttttgtgtgccagctatgtgacagaaactcactataccagacactttatatcccaattaatctttgcaacaaacagggcaggaaatagcagttgttcactgtagtcacactcttatgacctagaagtgttaatttatatatatgtaaattgtacatcttccttatatattataattatataattaaattatacaattattatatattatattatatattatatatattatatgatatatgatatatgatatatattatattatatattatttatatatttaatatatatcatatataatatatattatatattatacaatatatacattatatattatatattatacaatatatacattatatattatatactatatattatatatcatatatactatatataatatataatatatgatatactatataatatataatatatgatataatatactatgatatataatatatgatatatgatatatcaaatatataatatacgatatataatatataatatatgatatcatatattatatattatatatattatatattatatattatattttatatatgatatatgatatatcatatatcatatataatatatatgatatatcatatatcatatataatatatatattttatatattatatatgatataatatatataatatatgatacatgatatataatattatatattatataatatattacatataatatataatataatatatataatatatactatataatataatataggatatataatatatataataattatattatatagtatatattatatataatatatactatataatataattatataattatataattaaattatataattaaattatgatttatataattatatattccttatatattataaatgtatatattatatatttattgtatataaatattatatatataaagaaacacagtctctctgtcatgcagtggctctatcatagctcactgcagcctcaaactcttaagctcaagtgatcctccggcctcagcctcctaagtagctgggactacaggtgtgtgccattacgcccagctaattaaaaaaaatttttgtagagatgaggtctccctatgttgcccaagctggtgtcaaactcctggcctcaagcaatcctcttgccttggcctcctaaattgctggaactacaagcatgagccactacacacagctattttggtgtatttctaatatcttttagatgcatataattttttatttgttttgtcaattaccaccatggcctaaacaatttcctatgttgttaaaagcttattttactgactacactcatgacgtttttaatagtgcattgaaattttccaataaatttcacagatatattgggagtagacatagcagagggtatggtagcctcagattagcctgggtgtaatcttggaaggaggcaactgccttgctgctccctctacttttgcctctcctgtagccaagcctcaggagaggcttttctgcatggtttccagggtttggtttgtgagggaagaagatgagggtaaagtcaactcaaacttcatcatagcattgtgcccactttgccctgtcactgccattctccagcagaaacactttggacaccaacacatgctccctcttggagaaactttctagtttgggtaaaaagaccaaaaagtgggaaaaaattaattagaaatatggagatcatgggtggaaggagctaccatggcatgaccctgaaagccctcagcatattctggcatggatctctgaggaaatacaagatgacctctgtgtgaggtgtttttcatgttggttggaattttcactggtaagaacacaagtacctttaagctttggccagaaggtttcagatcttgaataaacccaaactcatttgtgctttttctaagtagaatagtcaggttgaacctgtggatcaacagttgacattatgccaaccaaaatatttctctttttggaagcaactaatgagtttcaataattcttcttgagtctttctcacataaggaaacagggcacatcattaaaactgccctggaggaaattatatgataatctttgtaaaactaacattccagaagggaggggactttaccaatgcaggggattattaatagctattttgtgccttcagatggcatgatgctttatgtgttagtgaatttcacaggatcacatatgtgcaagggggccaggctcggatcaagggggtatgtggctgctggctctgatttttgttctgctgggccttggtggaagcaaccagttaggcaaatagagccaggcacactatccttaatgtattagacaattggtaattctttgttgtttatgatgataggtttgataggaatctctggacatggagatagaaaaccaggtggctctaccatttattagttctataactatagacagattacttgtctcacctgaacctccatttccttatctgtaaaatggaaatacaatctctttcaataagttgttatgaaatctaaataagataatatatgtaaaagtgctagacatggaaaaatattttataatttttaaggtatattattattgttgttatgattatcattactagtaagtttaatcatggaagacttatggactgactagtaaactaggataacttagtggggatctgtggtttggagtctcaaaataataatgaaagcctaaatgtcagaccttttttttttcccctgagacggagtttcactcttgttgctcaggctggagtgcaatggtgcaatcttggctcaccgcaatctctgcctcccgggttcaagcaattctcctgcctcagcctcctgagtagctgggattacaggtgcctgccaccacgactggctaattttgtatttttagtcgggacagggtttctccatgttggtcaggctggtcttgaactcccaacctcaggtaatccgcctgccttggcctcccaaagtgctgggattacaggcgtgagccactgcgcctggcccagacctttattttacacacacacacacacacacacacacacacacacacacacacacactgcagtttgtttcactgaagacattgggacttggtttcaattagtttctggttcaaacaattagttaatggcaggatcaagatgataaaccactgttttggccaggcacggtggctcatgcctgtaatcccagcactttgggaggccgaagcgggtggattacttgaggtcagcctggccagcatggtgaaaccctatctttactaaaaatacaaaaattagctggacatgatagctggtgcctataatcccagctacttgggaggctgaggcaggagaatcacttgcacccagaaggtggaggttgcagtgagccaagatcacaccactgtactccagcctgggagacagagcgagactctgtctcaaaaagaaaaaaacagcaaaaaaatgataaaccactatttcaagtaaatgtgaaataggactgagcgttgaagcagcctgaatctgacattaaatcctatggtgacctatcacatggagacacagaggcttgcgggcaaataactgaagttcttgataactaagcttgatggaggacacagagagattgttcaggctaagaatcaccaatggatttttgtcattttaatgatattattaatctgtaaaggtattgtttagaaaacattgccatcatataattcttgttaattgcttaggataataaataatatctgccatttattattaatcacccattacatgccaggcattctacttaaatcatgtcacttaatcccttcgaccatctggaaagtggcactactgtcccattttacagatgaaatcaaagctcagagacactagggaacttgctcaaggtcacacagtgggtaaatgtcagagccaggattctaattcacatttgtatgacactgaagctcaggccctttctatcacttacagttaatgagtgtggatgacccagagactaagattgtttccttcatggccacatctttaatttctgccaatctgaaaacaaaacttctgcacaagcgttagtgtccttaaccagagctgcttgcccaacacagtccacaccattaagattctctactgcaaacagggctttcgatccttcccttttacagtgaattcacactcagtttgaccccagctctccaaagctttctatctgatcttgttttctgttttcaattttcataagcatgtcagattcctttcttgaatgtgaaggggaggaaaagaatcattatataggccgggcgcggtggctcacgcctgtaataccagcactttgggaggccgaggcggtcggatcacctgaggtcaggagttcgagactggcctagccaacatggtgaaacccagtctctactaaaaatacaaaaaaattagctgggcgtggtggcgggcacctgtagtctcagctacttgggaggctgaggcaggagaatcacttgagccagagaggcataggttgcagtgagccatgatcacactgttgcactccagcctgagcaacaagagcgaaactccatctcaaaaaaaaaatcattatataaagtcaaatatggataccttttgtttgaataaacatgagagattagggcaaacactcaggttaaataggatatgactactgcttagggttaaagcatgacaataaatatttttagacaactaactgaaagacaggtctgtcctctcattttcctgagacccatatacatacttgaacattaagcaacgggtcctggagagggaggtaagaagtatttcacatttctacaattttgctgaaataatcttacatgtagaacatacacatcatgcttttatttggaaaacctcattccacatggagggcatttgggctgtgacggggtgggcagatgactaagtcggagtcagaacatctctatttgagctctgtaacttcctgactatgcagcctttggcaaatcacataatcattctgaatttcactttcctaatcagtaaaatgtgactaacaacagctgtccctgactactgcagaaggatagtatgagggccaaatgggagaagagatgggaaagggctttctaaactgtaaagtgctgggcagatgttaagagttaatgtcaactcttggagaacatcctagctttgtgtattactatgagtgagaaggtggcaggctgcggaggtggtggtggtgtgctaaggaggatactggcagtttttatattcagatgctaaatcacagctgttgggcaggcagaaagccagggcaaagcctgctctctctagctgcacctgaaaccccagtttcctctacactattcactaactgccctgcctatgagcagggaagtgtaaggcccttcacctcccacaatcacaagcaggagggaagaagccagcactgagccacagaaaggctgagtcactaataaaaactaccatttatcaaatgcttactatgtgtcaggcaagatgctaagcattttacatatatgatcttatctatttctcatatcagcaaataaagctggtctgattattatccccattttacagatgaggaaagtgagagtcagagaagtcaaatgacttgcctacgattgtaattagacaggagtctctaccaagagtcaaatccaggagatctgattgtaaaacccacatcctcaaacactaagctatactgcaacttctggttgcaacctcacatgctcagcttcctgccaccaaacacaactccattggtggtatccagttccaaagagagcaaatacagaaaaggactttgggcgctgatgctggccgggcaactccatttcctactcaccacgcagacctcccttagtacaataatgtcctaacttgaggagtgaccaggcatttacctggtaacctgtatcttctcaatggggaaagaaaaggagagcaaaatatgtttgtgcctcgagtgtctggctaatagttgtcataaagttgtttaactctagttaggccacagcagaattagagttataatttatttttttttttgagacagagtcttgctctgtctcccaggctggagtacagtggctcagtctcggctcactgcaagctctgccgcccgggttcacaccattctcctgcctcagcctcccgagtagctgggactacaggcgcccaccgccacgcccagctaattttttgtatttttagtagagacggggtttcaccacgttagccaggatggtcttgatctcctgacctcgtgatccgcccgccttggcctcccaaagtgctgggattacaggagtgagccactgcacctggccagaattagagttataattaaggcaggacgtgccaaggtgatcacagccaaaggtcccactgtgacctgggaatgcggttgttgttagcagcggcaacaactggtacttcacccaatccctcatttccatagatcaacacaatctccatctatagcaaacatttacttagcatctgtggagtgccatgctcaacgtcaggtgccaggaacatacacatgataaggcactttgacatgagaaaaagcagtagaaggaagtatataataataacagattggtgcttcagaaagtacatgaaattgaattctgaagaggaggtgatatggtttggctgtgtctccacccaaaccttatcttgatttgtagctcccataattcccatgtgctgtgggaaggatctggtgggaggtaattgaatcatgggggcaggtctttcccatgctgttctcattatagtgaataagtctcacaccatctaatggttttttttttttttttaatttttattttttttattgatcattcttgggtgtttctcgcagagggggatttggcagggtcataggacaatagtggagggaaggttggcagataaacaagtgaacaaaggtctctggttttcctaggcagaggaccctgcggccttccgcagtgtttgtgtccctgggtacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttatcttagtacagaacaaaatgaaaagtctcccacatctacttctttctacacagacatggcaaccatccgatttctcaatcttttccccacctttcccccctttctattccacaaaaccgccattgtcatcccggcccgttctcaatgagctgttgggtacacctcccagacgaggtggtggctgggcagaggggctcctcacttcctagtaggggtggccgggcagaggcgcccctcacctcccggacggggcggctggccgggcggggggctgacccccccacctccctcccggacggggcggctggccgggcggggggctgaccccccccacctccctcccggacggggcggctggctgggcagaggcgctcctcacttcccagtaggggcggccgggcagaggcgcccctcacctcccggacgggtcggctggccgggcggggggctgagccccccacctccctcccggacggcgtggctggcccggcagaggggctcctcactccccagtaggggcggctgggcagaggcgcccctcacctcccggatggggcggctggccgggcggggggctgacccccccacctccctcccggacatggggctgacacccccacctccctcctggacggggcggctggccgggttgggggctgacccccccacctccctcccggatggggcggctggccgggtggggggctgactcccccacctccctcctggacggggtggctggccaggcagaggggctcctcacttcccagtaggggcggctgggcagaggcgcccctcacctcccggacagggcggctggccgggtggggggctgacccccccacctccctcccggacggggcggctgccgggcagagggactcctcacttctcagacggggcggctgccgggcggaggggctcctcacttctcagatggggcggatgctgggcggagggtctcctcacttctcagacagggcggctgggcagagacgctcctcacctcccagacggggtcgcggccgggcagaggcgctcctcacatcccagacggggcggcggggcagaggcgctccccacatctcagacgatgggcggccgggcagagacgctcctcacttcccagatgggatggctgccgggaagaggcgctcctcacttcctagatgggatggcggccggtcagagacgctcctcactttccagactgggcagccaggcagaggggctcctcacgtcccagacgatgggcggcgaggcagagacgctcctcacttcccagacggggtggtggccgggcagaggctgcaatctcggcactttgggaggccaaggcaggcggctgggagatggaggttgtagcgagctgagatcacgccactgcactccagcctgggcaccattgagcactgagtgaaccagactccgtctgcaatcccggcacctcgggaggccaaggctggcggatcactcgtggttcggagctggacaccagcccggccaacacagcgaaaccccgtctccaccaaaaaagtacgaaaaccagtcaggcgtggtggcgcgtgcctgcaatcgcaggcactcggcaggctgaggcaggagaatcaggcagggaggttgcagtgagccgagatggcagcagtacagtccagcttcggctcggcatcagagggagaccgtggaaagagagggagagggagaccgagagggagaggggagagggagaggcagaggcagaggcagaggcagagccatctaatggttttataaaggggaattcccctacacaagctatcttgcctgctgccatgtaagatgtgactttgctcctcctttatgtgaggcctccccaggcttgtggaactgtgagtgaattaaacctctttcctttataaattacccagtctcaggtatgtttttattagcagtgtgagaacagactaacacagaaggtggtgacaatttgggatggagtagtcagggtaacttttatgaaggagggagtgaataagactttgaaggatgggtgagacttgactaaatgagaagggatgggattgaaagcagaaatgtcagaagagatgatattgtgggagaaggtctagtgcaaagataggttcaaaacaagtgagagtgagcactggtgtgttagtatgctttcagctatttgaagtagaaatggcttaaaccaattatttttttcacatagtccagaggtaaaatgggcttctgaattgcttgattcagcagtcaaagtgtgccatgaaagaaccaagtccttttcatgtctctgctctgcagttcacagagtcatcgcagagtcaggcaatatgctcccttgttcacatccaacgagagagattgatttatctttcccagaaatcgcaaactagcccctctctgtatgtcattggctcaggctggcttgggacctgcttattcctaaaccaatcattgataaaagaaatgaaatattttaattggcttagactggtggactaaaactttagcctccattggagggcttgtaaaaacatattgctgcctgccctactccagagtttctgactcagtgggcctggggttggaattcgcatttatgatgcattaccatgtgatgctggtgctgcaggtctggggccacaagtttactttttttttttttttttttttttttttgagacggagtcttgctgtgtcacccaggctggagtgcagtggcatgatctcggctcactgcaacctctgcctcccaggttcatgctattctcctgcctcagcctcccgagtagctgggactacaggtgcccaccaccatgcctggctaattttttatattcttatatttttatttttatttttatttttatttttttattttttttttgagactgaatctcgctctgtcgcccaggctggagtgcagtggcacgatctcggctcactgcaagctccgcctcccaggttcacgccattctcctgcctcagcctcccgagcagctgggactacaggcgcccgccaccgtgcctggctaacttttttgtatttttagtagagacagggtttcaccgtggtctggatctcctgacctcgtgatccgccctcctcggcctcccaaagtgctgggattacaggcgtgagccactacgcccggcctttttatatttttagtagagacggggtttcaccatgttagccaagatggtctcaatctcttgaccttgtgatccgcccgcttcggccttccaaagtgctggaattacaggtgttagccaccatgcccggcccccttttttttttccttttttttgagatggagtcttgctctgtcacccaggctggagtgcagtggcgtgatctcggctcactgcaacctccgcctccggggttcaaacgattctcctgcctcagactcctgagtagctgggattataggtgtgtgccaccatgcctagctaatttttttttattttcagtagagattgggtttcaccatgttggccaggctggtcttgaactcctgaccctgtgatccgcctgccttggcctcccaaagtgctgtgattacaggcgtgagccattgctcccggaccgcaactttcaagaccactattgcaggataattaattgaggtggaatagatgttggggtatcaatccatggtctcctataaatgtcctggtttgcctggctgagctggtgtaattatgtccccctttactgtcaaaagtgttctggttcttttcttttcttttctttttgagatggaggctcactgttgccaggctggagtgcattggcacgatcttggctcactgcaacctctgcctcctgggttcaagcgattctcctgcctctgccttccgagtagctgggactacaggcatgtgccaccaagcccagctaatttttgtatttttagtagagacggggtttcatcatgttggccaggatggtctcgatctcttgacctcgtgatccgcccgccttggcctcccaaagtgttgggattacaggtgtgagccaccgcgcccggccggttatttcatatataaattatgtgatcaccttaccacacagggctttgagttcaagtcaaggttctttcactacaagtgaacacaggagagtgaaccagtattggtcaataaaatgtgtgattccaattgggagatctcttcttttttccttgtccaaggatctataagagacagagaaaaaagccatcagtatcaatcatatttcacattaagtatcctgactgatgtgttttaagggcattgcttttaatttatatggaaactattcttataaatatagcttttgctatcctttttgcttaacattcttaatagcatgatttgatttataaaaaaataaggcattgattgcaactaattcattttatgtcttaagttcattgacttatagttttacaaaaatgtgaaacgtgtattaagctaaactatcatagttttaaaacattggtcatggctgagcatagtggctcacacctgcaatctcagtactttgggaagccagggtgagaggattgcttgaggccaggagttcaaggccagcctgagcaacatagcaagaccctgtctctaccaaaaaaaaaaaaaaaaaaaaaaaaatagcaggcgcctgtattcccagctatctgggaggctgaggcaggaagatcacttaagcccaggagtttcaggctgcagtgagctttgattgtgctactgcactccagcctgggtgacagagtgagaccttggctgcaaaaaaaaaccaaaaacacactttggttataatgcaggtcacagttaaacagagttcagaaatagtgtttgttgccaagtatttctggttcatccagaactaagagttttttattgaaaactaactatatctggcaatcttagtagaggccatgtaatttctgagagcaaatagtgaatacatatttttgtttttctttcttaatctagtttctttttcttgtttttttctacctaaaggttgccaaagactaagtttgaaattatcttacatattagatacctccaatcttgtcatggaattagatgtaatctctttaaggtctttcttcagaaattgattgcaagcagtttgggatgccacttaagaatttgcttaaaccacttcctcccaaccccacaaaaaatcacaaacccaagcacaatccagatgagaatcataaacgtctcactgctctttgcaacagcatgaattgtgaaattttagttaatccaagaattttttaatgttgttgttttaaaccttttattagattttcttcttatgccaaaataaccacatatggttccaatccttcaggataaggacaatttggggtaagtctaatagaatagcaacatttaaaaagttcaaatatggtagaattgttttgtttatatggtagagataaatttttgagttagagagatctagcggtcttctgttctaaacttacattcattgtaggaacctcctcaacatccctgagagagagggttctttaaactgaattattaattccagtaatagagaagctgcagcctgacggggaggggtggcattggttttattgttgaaccgctttagctagttttcttacagtgagttacacagtgtctcccagtacagtttgtgttagaggactatagactatgctatagactgtactgtaccctcctcaaattgatttgttgaagccctaactcccaacgtgactgtatttggagatgggccttttaggaggtaattaaggttacatgagttcataagaatgggatcttggccaggcacagtggctcacgcttgtaatcccagcactttgggaggccgaggtgggtggatcatgaggtcaggagttcgagaccagcccgaccaacatggtgaaactccgtctctactaaaaatacaaaaattagccagtcgtggtggcacacacctgtaatcccagctaatcaggaggctgaggcaggaggattgcttgaacctgggaactggaggttgcagtgagccgagattgccactgcactccagcctgggtgacagagcgagactctgtctcaaaaaaaaaaaaaaaagaatgggatctctcgacggaaaggccatgggaggacacagtgagaaactgtggctatctgcaaaccaagaagagagccctcgttataaaccaaattggccggaaccttgatgttggacttcccagcctctagaactgtgagaaataaacctctgctgtttaagccaccactgtggtattttgttatggcaatatgagtagactgagataggctatatgtaatgccttttcttatttttttatttatttgttcttgagatggagtctcgctgtgtcacccaggctggagtgtggtggcacgatcttggctcactgcaagctctgcctcccaggttcatgcccttctcctgcctcagcctctggagtagctgagactacaggcacccgccaccaggcctggctaatttttttgtatttttagtacagacagggtttcactgtgttagccaggatggtctccatctcctgacctcgtgatctgcctgccttggcctcccaaagtgctgggattataggcatgagccactgtacccagcctgtactgccttttctataccacatttctcagctatcaagccaatcctaacacatctattctttaaaattaaacttcacaggccaggcacagtggctcatgcctgtggtggatcacctgaggttaggagttcaagaccagcctggccaacatggtgaaaccctgtcgctactaaaaatacaaaaattagcctggcatggtcgtgggcacctgtaatcccagctactcgggaggctgaggcaggagaatcacttgaacccaggaggcagaggatgcagtgagccgagaccacgccattgcactccagcctgggcgacatgagtgaaactctatctcaaaaaaaaaaaaaaattaaacttcatggtgagttccatttttctttatttgatacaatttccagattgttgttccaatttgctgcccactttgagatcacatcagtttgtgtctacctcatcaaaatgatgatgtctagaactgaacataatattttaagtgaattctgattaatgcagaatatattaaaacattactttctatgagctgaattccatatcttcttgtgggccacacataatatagtgttggttttgctttttcagaaaacacattatatgcaggttaaacttgttgtcacataaaatatgcatatttttaagatgagctttttttctgggccttgtaatccagtaggcttttggattaccaagtgtgaaacatacgaaaaagtgcgaatgtttagaggaaccaatatttcaccatgcaggtgtgaactccaaaaaaagaaagaagcaacaacaaaaaccaaaaaaaaaaaaaaaaaaagggagataagatgttaactccaagagctagttggtttaatggtaaaatgaattctgtatttgaaacctgccctagtacacataacttcgtactcaaaaattgacgctgtataaaaaacgttagactgagtgttagaagagatgaatttaaatcccagctttataagtgatgagctaagtggctcttgggaagtcacctactctttctaagcctgagtctccttatctctttacctgtaaggagttgtagcatacctctcctaacatacaggaaaacacatacacacaaacacatgccaccagttaccatctactctcacgagtattttaccaaataaaaacatttaacaccaaaaaaaggaagaacaacagaatttcaggatgacaattggcaaatatacatgcacatttcctttaaggcctggtgaaaactgtcacttactaaaggaccttttggaaactactgaactagatcatctctaaggtcttatctagaccctcaagttgggtgtggggcatctgaacactggatagtagtgagatgatagatttgggggtgtaaagttattcattaatctattcatgtgttaaatcaacaaatatttattgaatacccactatgtgccatatatttaaaagctgggatatatcaatgaacaaaatagacaaaaatgcctgtcctcacggtacttatatactggagggaagagacagaaaacaagtagtaaacataaaacagaaggcaattataggctgggcgtggtggctcacgcctgtaatcccagcacttggggaggctgaggtgggcggatcatgaggttaagagagcgagaccatcctgggcaacgtggtgaaacctcatctccactaaaaatacaaaaattagctcggcgtggtggcgtgcgcctgtagtgccagctacttgggaggctgaggcaggagaattgtttgaacctgggaggtggaggttgcagtgagccaagattgcgccactgcactccagcctggcgacagagcaagactccgtctcaaaaaaaaaagaggcaattatatacagtgtactactttggaagatgctgactgccatggaaaacaagagaaagcagagcaggcagggtaggcagggagtctggggacatttttctggtcacagcacagcaaggagcactggatctcattaacatgataggcacattttttggcttctacttattgcctcaaacctagccatgagtaaattgattaatttagaaatttattacttatttcacatatttaatatctctaatgcagggttgttgtagatcatagtaattaattcagcttgggaaattgtcactgagttatttatttagaataacagcttgtgattttattagcggtgtatctgattttgaaaatgccttaattcaatcaattgattaatcatttatcatttagtcaataaatatttatggattgcttgttatgcagaaggctgaattatatgtgcatgtattaaagttatagctatagaattattaagtctagaattcctgagtgtttataaaggtggaattaggtgctgtgaagtattacagagttaaaaacggcaatatttttaacccagagaatatagcgtatttgtttgctaatttgctttagaattatctaagaacaggttagttgatctcacaatacttctctggtagatagggtagcatattttccttattgcatatgtaggcagacttgagattccaggaagttagatgccttatccttagtcacttagggagtgtagtgtcgatatcgcaacgaggaccttaggtttcaggggtcgttgtttagcaatatctgatcttgagccagttggtataagaggacacatacctttggttcctgatctctctgggagacgggggtcctttaatgtgcccacccagagctccccttccacagcacccacctctttctggattctacatctttgatgccaaaaggcctcagattgcaaaaattatttggtgcttcaggtcttctgtctcagcgaatggggttcaggcctccctctggtctaggtgttggcaagtacagaaggaaggtggaggggtaagaaagggggcagaggaaaaggccaaaagagaaactaccatgttcatttcagctctttcttcttcctgcagctcgcagcttactaattattcttctccttcccaattacagaaaaaagagaaaggatcatcataaagagattctagaaatgtgaccttgaccatttagcttttgggaatgacatgtctagccttaacttttggacatttttagctagcaattttcaacttggttacaaaatgagcagaagaagtattatcctatgaaggatatttttttttttgagtcaaagtctcgctctgtcgcccacgctggtgtgcagtggtgtgatcttggctcactgcaacatctacctcccgggttcaagcaatttgaaggagatgtattaaaaatacctgaagggagccaggcatggtggctcatgcctataatcccagcactttgggaggccaaggtaggcaagtcacttgaggtcaggagttcgagaccagtctcgccaacctagtgaaaccctatctctactaaaaatgcaaaaattagccaggcgaggtggcgcatgcctgtaattccagctacttgggaggctgaggcaggggaatcgcttgaacccagaggcagaggtttgagtgagctgagatcatgccactgcactctggcctgtgtgacagagtgagacaagactccgtctcagaaaaacttaaaaaataaaaacaaaataaaaataactgaagggaggttgtcaaaatatggatctcccccgtctcccaggatctcattctagcaaaagttctcagtcttggctacatattaaaatcacctggagaacattcacaaaatgcccaggtatacagcctacctctaagaggcattctgagttcattgttctgggatataatcctgctgatattgtattaaagctccaggtacttttaaggtgcagccaggatcactgccccggcaatcctgaattactgacaggagtgtgtcctaatcctggtgtgctgcccccaggtgtgttggagtgtggagaaaaaaactcgagaaccattaatccagtgtttctcaaagggtggtctgcagaacagcagcatcggcatcacctgggaacttactagaaatgcaaattcttgggcctaactccagacctactaattcagaaactctcagggtgtgacccagcaatctagggtttcaggagccctcaggtgattctgatgcatgttgaatttcagaaccactgtcctaatctaacctgtagtattctgaaatgataatctgaatataattgagttagataccttcttttctgataaaaagaacattatatctataagcaggtgtagggagctttgtttagctaaagaaattaaagtgctatgataggaatgttagacattaactagaaaggaatctgggaataggggcagaggttgttcatgattttctttttgaggtacaggatccttcccagaaaaatcacaccatgtggtcagccatcttctctccttgagctaaagctctttttgtgttgactatgagtttatattttaacctactccaggcaaactcttccccataatcaaataaagttttcaaagacagtgaagattagcaaacaaagccttgcattagacagaagggctgggaaacactaaaagcaaccttgagccaagatgtctccctggtaatccagcaggtccaccactaggatagtaaataactctgatgacatcatggcatgatgtctggtgactctcggtcaccacagtaggggcagaagagtgaggttttctgatccactgatccatttggtccttcagtgacccctttggcgctgatagaatcttttttttttttttttttttttttttgagagagggtctggctctgtcacccagactggaatgcagtggtgcaatctcggcttactgcagcctctgcctcctgggctcaagtgagcctcttgagtagctgggatgacaagtatgtgccactacgaccagataatttttgtttttttgttttggtagagatggggcttcaccatatattgctcaggctggtcttgaactcctgggctcaagtgatctgctggttttgacctcccaatgtgttaagattacagatatgagccactgtacctggctcatagaattttttttttttttttgagacggcgtctgtctctgttgcccaggctggagtgcagtggcacgatctcgtcccactgcaagctccgcctcccaggctcacgccattctcccgcctcagcctcctgagtagctgggactacaggcgcctgccaccacgcctggctaattttttttttttgtatttttagtagagacggggtttcaccgtgttagccagcatggtctcaatctcctgacctcctgatccgcctgccttggcctcccaaagtgttgggattacaaggcgtgagccaccgcgcccggtcagctcatagaatctttagagaagaatctttgtaggtgggatgatacgtgcttctggacatcatgtgaatcatcatatttccagcttttaagcatattaatgaggatttgaacaatgtcttaaagcaggagtactgttttattatgaaagaagcttcctagttgacaaacttttcatacagagtcaaacttcattctaatggcaataattattatattataagaaactggggggccgggcatggtggctcacgcctgtaatcccagcactttgggaggccgaggtgggtggatcacgaggtcaggagatcgagaccatcctgactaacaccgtgaaaccccatctctactaaaaatacaaaaaattagccaggcatggtggcgggcgcctgtagtcccagctactcgggaggctgaggcaggagaatggtgtgaaccgggaggcggagcttgcagtgagccgagatcgcgccactgtactccagcctgggcgacagagagagactctgtctcaaaaaaattaaaaaattaaaaaattaaaaaaaaaaaagaaactgggatcatgttgaatttgcctgaaacaaatccaaggagttagattgcttcagaggtcacctgatagaaatagctcataaattccctaggagtaaatcactcttactaggcctgaagacatgcttcaagtcagaatgtgatagtaatgattcactctgggatttcatttcaagccacaggaactaaaaatgcaagtacagttcccaatgcgaaacgcaacctgtaatcttaatccatttaacttcctcaaattgctgtattactcaaaacagctgatttcttcattgagcatagatgaatttcctctgtggcaaatgtcaccatctgacccaaggatatgtctaggccctccttaccacctgtgagctctccttcaaggaaaggccgttgagcaagcccaattggtctagttaagagcctgtgctttggaatcacttaagagcctgtgctttggaatcagattacctgtgttggaatctaccaatatggcttggtaggagcgtatttttggatgtatctcttaaccttcctaaactacaattccctcaactggaaaatggagaaacaataatactgacgtcatagtatcagcagttgcacaggatctagtataaaggtggtcaggtataaaagtggtcaataaatattagttcttatttaaggaggtaatattataatggttaagaggaggattttaaggccaaattgtctagttcgaatcccaattctgccacttactttgtaaaagttacctaatcacttggggccaggttgaggacaggtgcctgggaaacaccgggaagtactccagggaataaatgagaggctccaatttttatttttatttatttatttattaaggcggagtttcactcttttgcccaggctggagtgcaatggtgcggtctcagctcactgctatctctgcctcccgggttcaagtgattctcctgcctcagcctcccaagtagctgggattataggcacctgacaccacgcccagctaatttttgtatttttagtagagatgggggtttcaccattggccaggctggtctcgaactcctgacctcaggtggtctacccaccttggcctctcaaagtgctgggattacaggcttgagccaccgcacctggcagaggctccagtttttaaagaaaaaaggacagctccggaaaagggattgaatgcaaaagttgttcatcaggaattctcattagtttacaggaataacactgaatagtgattggctatacattgctgaactgtaggctatgagttatggtgtccaggatatggcattttttggctcctttgtgtcagtctagagctcatatagcaagtggcttcaagaagtgattcctgggccgggcgcagtggctcacgcctgtaatcccagcactttgggaggccgaggtgggcggatcacgaggtgaggagatcgagaccatcctggctaacacggtgaaaccccgtctctactaaaagtacaaaaaattagccgggcatggtggcgggcgcctgtagtcccagctactcgggaggctgaggcaggagaatggcgtgaacccgggaggcggagcttgcagtgagctgagatcatgccactgcactccagcctgggagacagagtgagactccatctcaaaataaaagaggtgattctttagcttgagggaagagtgatagtcctgtcacatttcaaatgcctctctgggcatgataatttaaaggggcttgcatgcctcagatgcaaatttctttttctttcccatagcacactaggagagagtacaaatgaggcccacctatcgtgttttaaatacttagaagttgtacatcaagttaaataactcttaaataaaatgttttctgttctcctatcttgacaaatataccttcatagcaaactaggttcaggttcaaatgtagaatttttagagttccacaccagaggtgggaggaacagagggagccagcccctggacactgggttctggcctccagctacttctcttacccagcttcttcctgcacccagccctagtatccagggctccccagcccccgtcccatacacatacctgtggtaacagtgtgctacctggaaatctccagggaagtgccaggtagatgctctggaagttggtgtgcgctctttcggcaaaagaaattccagagtcagccgggcacagtggctcacgcctataatcccagcactttgggaggcccaggcgggcagatcatgaggtcaagagatcaagacaatcctggccaacatggtgaaaccctgtctctactaaaaatacaaaagttagctgggtgtggtggcacacgcttgtagtgccagctactcgggaggctgaggcaggagaatagcctgaaccaggaggcagaggttgcagtgagctgagattacgccactgcactccagcctggtgacagagtgagactctgtctaaaataaataaataaataaataaataattccagagtccaggaatgcattctgaagtggagtattatggactaaatgtttgtgtcccccaatattcctgtgttgaagccctaacccccagtgtggctgtatttggagatagggcctctaaaaaagtaattaagattaaatgagattataaggatgaggttctgatctcataggcttagtgtccttataggaagtgacatcagagagcagtctatgcacaggcactgaagaaaggcatgtgaggacagtgagaaggggtcacctgcaagccaggaggagggtcctcaccagaaatggactatgctggcaccctgctcttggacttcccagcctccagaactgtgagaaatacacttctgttgtttcagccacccaggctgtggtactttgttatggcagcctgagctgacagtgagtgtggggctggttcctgggggacacacccctgcagactccttggtctgtgaggaagaaaggcaaccagagaaaagctagagtctcctctaaagagcaggccttggtgtagggacccccttgagctgcaaggacagaacagctcttcaaaggtgctcagggagaagtggagaaatgttgaatttcatgtatacttggcctgggcagacagactcaatgtggaaatttaagccaagaactaagtggacctgacagttatggtcacaggctgtttggctagaaattatcttagaggtcatctagccctcatacagttagagaacagaactccagggactttccaaaggttgaacagaaacttgttgagatcatggctctctaaaatctcaggcatatacctttgtatgtgttaggttataaaagtttcccaatttgtggattaactttcagaggcctgctgaatttgctaggaggagaactttgaagaatgcattaagaattcttgcttcactgcaggccagagctacttgtgtttgcctaacctggagctgatgaaacaaagcatctggttaaaaaattatacataaggccgggtgcagtggctcacgcctgtaatcccagcaccttgggaggccaaggcaggtggatcatgaggtcaggtgttcgagaccagcctggccaacatggtgaaactccatctctggccaggcgcagtggctcatgcctgtaatcccagcactttgggagcctgaggcaggcggatcatgagatcaggagatcaagaccatcctggctaacacagtgaaccctgtctctactaaaaatacaaaaaattagccgggaatggtggtgggcgcctgtagtcccagctactcgggaggctgaggcaggagaatggtgtgaacccaggaagcggatgcagtgagccgagatcgcgccactgcactctagcctgagcgacagagcgagactccatctcaaaaaaaaaaaaaaaaagaaaagaaaaaaagaaaaaatgctcaacgccactcactgattatcaggaaaatgcaaatcaaaaccacactgagatattatcttcccccagttagaatgggcattattaaaaagacaaaaacaaaaacaaaacacagatgctggcgaggatggggagaaaagaaaactcatctccactgctggtgagaatgtaaattagtacaaccactatggaaaacaatgcagagatttctcaaagaactaaaagtagaactaccatagcatccagcaatgccactactgggtatttattcaaaggaaaagaaatcagtatattaaaaagatacctgtacttctttatcaaagcactattcataatagcaaagatatggcatcaacctaagtgtccatcagtaaatgaatggataaagaaaatgtagtatatatatatatatatatatatatatatatatatatatatatatatatatatatacacacacacacacacatatatatatatatatacacacacaatggaatactattcggccataaaaagaatgaaataatgtcatttgcagcaacatgggtggaactggaagtcattatgtgaagtgaaataaatcggcacagaaagataaatattgcattttctcactcatatatgggagctaaaaaagttgatctcatggaggtagagtagaatgataggtaccagaggctgggaagagtgtgtgggtgggtggtgaggattaagagaggttggttaatggtgaaaacatacagttagatagaagggataagttctaatgttcaagagccgagtagtgtaactatagttagcaactatgtattgcatatttcaaaatagctagaagagaggacttgaaatgttcccaacacatagaaatgataaagactcaaagtgatgaataccttaaatatcctgacccgatcattacacattttatgcatgtaacaaaatatcacatgtaccccataattacgtatcaaaaaatgatcagaaagtataaacatatcttactcaggctttgcctgtgcttatccaatgaaattatttttaagacagaaagcaggccaggcacggtgcctcacgcctgtaaccctggcactttaggaggcagaggagggtggatcagctgaggtcagaagttcgagatcagcctggccaagacggtgaaacctcatctctactaaaaatacaaaaaattagccgggcatggtggcggatgcctgtaatctcagctacttgggaggctgaggcaggagaactgcttgaacccgggaggtggaggttgctgtgagccaagatcacaccattgcactccagcctgggtgacagagtgagactctgtcttaaacaaaaagacagaaagctgatatattttatcttttcccagtagagctccaagtttgcagatgttttctgcttacagcttgggcagtccaggtagtttccaaacctctctcttctatttccaagacagaactgcggcccttttccttcacagtagctctgccttggacagaaatgatcaagggccactaccactgctcttaggtttgagtagataagatttgggggggtatctctaactggtattccatttatctccccaaaagagtaaaagtggctcaaaataatgttccaaataattttctcaaaacaatataaggttcattggctttttctcattataaaagacatttttgttctgttttgttttgttttttgagatggagtctcgctctgtggccaggctggagtgcagtggtgccatctcagctcactgtaacctctgcctctgaggttcaagtaattctcctgcctcagcctcccgagtagctgagactacaggtgcgtgccaccacacccagttaatttttgtatttttagtagagatggggtttaccatgttggccaggctggtctcgaactcctgatctcaagtgatctgcccaaacttggcctcccaaagtgctgggattacaggcatgagccactgtgcacagccttgttttgtttttgagacagggtcttgttctgtcagccaagctggagcacagtggcactatcatagctcactccagccttgacttcccagggtcaagtaatcctcctgcttcagcctcccaagtagctgggactacaggcatgcaccaccacacctggctaatttttaaatttttagtaaagaggaggtttcgctatgttgtccaggctgatcttgagctactgagctaaagtgatcctcccaccttggcctcccaaagttttgagattacaggcatgaggcaccatggctgtccaataaatattcttaacatgattatctatttctaattctaagatccttagaattgattcttagaagtggagttactatgaaagagccttaatacttcaagtcaaattgcttttcgagaggcattaccattaattccagcaacagcagtgtagaatagtgcctgtttcactacgtcctcctggatagactcttgcctattagtgtagcactgggatctgacttctgaatcagcctgtctagaattgaattccaactcgaccacttcctagctgtgtggattgggaaaagttgcttagctgctctatatcttggtttatctttgttcaaatgggcatagtaatactgcctacttcatagagttattatgaagtttaaaataatatattacaggtactcaataaaggctagtctattacattaataaaattatcttctaatatgacatgtgaaaaactgtacttcattgttgccttaaattgcattctctaattactactgattataaactttaaaaatgtttattggctaatttgtgtgtgtgcatgtctgtgaattgactattcatttccattgacttctcctaattgtggctggtgttttcttgttatagatttgttggagctctttatatattgacattaatctcatgcatgtcatatacacaagtagttttcacagtatttaatttgcttctaatctttatgattttgggggttatataaatgcttaaatttctatgtagtgaaaagtgaaatcaaatatgataatgttttctttgactttttttttttttttgagacagagtcttgctctgttgcccaggctggagtgctgtggtgtgatctcagctaactgcaagccccgcctcccaagttcatgccattcgcctgcctcagcctcccgagtagctgggactacaggcgcccgccaccacgcccggctaacttttgtttgtatctttaggaaagacagggtttcactgtgttagccaggatggtcttgatctcctgacctcgtgatctgcctgcctcgacctcccaaagtgctgggattacaggtgtgagctaccgtgcccggctctttggcttttttaattgcttttttatttagaaatccagctctcttcccaggttagtttttttgtttttgttttgtgtgtatgtgtgtagagactaagtctcgctatattgcccaggctggtcttgaaaccctggtctcaatcctcccacttcagccttgcaaagtgctgggattacaggcatgagccgccatggccagccccatgttagtttataacacataatttattattcataaattgaatttttacatagtctgaagtttgttttgaggttccctaaaagattccatttttaatcaatactactttaattattctaggtttagaataattaaatagttaattaaataataaataattaaataaaattataaatagttaaatattaactgttaattaaattacggtttatatatttacattttcttaataatatatcatttattattaattataattctaaattaaattataaatagctaattacactatagctaattaaataattaatacctgatagcctttttttaaatatttcttaaaaattcttgaatgcttattctttcagtttatttatttatttatttttttgagacggagtctcactctgtcgcccaggctggagtgtgagtgcagtggcaccatctcggctcaccgcaacctctgcctcccgggttgaagcaattctcctgccgcaggctcccaagtagctgggactccaggcgcgccaccacgcctggctaatttcttgtatttttagtagagatggggtttcaccgtgttaaccaggatagtctcagtctcctgaccttgtgatctgcctgccttggcctcccaaagtgctgggtttagaggcgtgagccaccgcgtctggcctctttcagtttattaagcatcgacagatgttaacatcttgacaagatgttaaattttaacatcatgttaagttcccacacgtgaattttttttttttttttttgagacagggccttgctctgtcacccaggctggagtgcagtggcacaatctcggctcactgcagcctctgactccctgacacaagggatcctcccaccctagccttttgagtagctgggaccacaggtgcaagccaccacacttggttaattttaaaattttttgtagagatggggtcttgctgagaggtggcagcgtgctggcagtcctcagagccctcgcttgctttcggcacctcccctgcctgggctcccactttggtggcatttgaggagcccttcagccccccccactgcactgtgggagcccctttctgggctggccaaggctggagcccactccctcagcttgcagggaggtgtggagggagaggcacgcgcgggaaccggggctgcgtgcggtgcttgcgggccagctggagttccgggtgggcatgggcttggtgggccccgcactcggagcagccagccagccctgctggccccgggcaatgagggacttagcacccgggccagtggctgcggaggatgtactgagtcccccagcagtgccggcccaccggcgctgtgctcgatttctcaccgagccttagctgccttcccgcggggcagggcttgggacctgcagcccgccatgcctgagcctcccacccactccatgggctcctgtgcggccggagcctgcccgacgtgcaccaccccctactccacggcgcccagtcccatcgaccacccaagggctgaggaaagcgagcgcacgccgcaggactggcaggcagctccacctgcagccctggtgcgggatccaataggtgaagccagctgggctcctgagtctggtggggacgtggagagtctttatgtctagctcagggattgtaaatacgccaatcagcaccctgtgtttagctcaaggtttgtgagtgcaccaatcaacactctgtatctagctgctctggtggggccttagagaacctgtgtgtcgaaactctgtatctaactaatctgatggggacgttgagaacctttgtatctagctcagggattgtaaacgcaccaatcagcgccctgacaaaacaggcctctgggctctaccaatcagcaggatgtgggtggggccagataagagaataaaagcaggcttccggagccagcattggcaacccgctcgggtccccttccacagcgtggaagctttgttctttcgctctttgcaataaatcttgctactgctcactctttgggtccacgctgcttttatgagctgtaacactcaccgcgaaggtctgcagcttcactcctgagccagcgagaccacgaaccccccagaaggaagaaactccgaacacatctgaacatcagaagggacagactccagacgcgccaccttaagagctgtaacactcaccgcgagggtccgtggcgtcgttcttgaagtcagtgagaccaagaacccaccaattccagacacattgctatgttgcctaggctggtcttgaaatggcctcaagtgatcctcctgcctcagcctcccgcaatgctgggattacaggaatgagccaccacgcctggctgacaaatcttttaaattatatatatacatatatatatatatattttttttttttttttgagacggagtttcgctcttgctgcccaggctggagtgcaatggtgcgatctcggctcactgcaacctccacctccccggttccagctattctcctgccccagcctcccgagtagctgggattacaggcatgcgccacgacgcccggctaattttgtatttttttttttttttttttttttttagtagagatggggtttctccatgctggtcaggctggtctcgaactcctgaccttaggtgatccgcccacctcggcctcccaaagtgctgggattacaggcgtgagccaccgtgcccggacttaaattagatttgacttaaagctacatattaattttgttttaggaacatggaatatttcttcatttattacaattttattttttaaagttttgccagtttgctgttgtttttgtggttgttttcacataggcatactcatttcttgctaggattatttctgtagttttaaatatttttgtattatatttgggcttattactcctattaggttgtttaacttactgatggtatatggaacatttatagattcctggatattttgtatttgatgacactgaagaactttcttaggaattctgaaaggcttgtagttgagccacgctgggttttctgagtacataatccaatcatctggaaaaaacattaatcttttccaaatcattatgtctcttatttctgtttcatgagtatttttagttgctgaaaatgtgtgaaaagtgcactgtctaaagcaatctcttttctgctctcttcactcctacaacaaatacagtgaactgaggatgaggttgggggaggggaagaaggagaggagcagggctggtgcttatctgggaagcgcagaagatgtcttcgggctgcaggcagcagtttctgtagatctaagtgctggccaggggcttcccaaggcagctgtggtctaagctactgatttgctgtatcagcgatctgccaccttccttccccttgttttcttgccctctgcctcagccttgctcctctctccccaacctcccttctcagctctgctcctctctgtctgcttcctcagtagggatatggcagtggccacagcctctgcactgaggagagaacttgtcaacatgttttttgctccagtaggagctcgttcatctgtggccaagatcagaccttggctcagtggcatgggctgcttagtgcacctaccctgatgtaattcctccctctgtccatcttccctgctcccaccttcctttgagccatcatcagctatcaccttgactcctgcaataactttctaaatggctctcctccaatacattcttttcacagggcagtattttaaaaacataaatcagaatacactcccttattaaaaacctttcagtgacttcccatagcacttagaataaacataaactccttaacgtggccctgtgtgattggtctcttccaatctctcgtagcctctttttatttatttatttatttatttatttattttttattgatcattcttgggtgtttctcgcagaggggtatttggcagggtcataggacaatagtggagggaaggtcagcagataaacaagtgaacaaaggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcacaaggcagaagaatttttcttagtacagaacaaaatgaaaagtctcccatgtctacctctttctgcacagacacggcaaccatccgatttctcaatcttttccccatctttcccccctttctattccacaaaaccgccattgtcatcatggcccgttctcaatgagctgttgggtacacctcccagatggggtggtggccgggcagaggggctcctcacttcccagtaggggcggccgggcagaggcgcccctcacctcccggacgaggcggctggccgggcggggggctgacccccccacctccctcccggacggggcggctggccgggcagaggggctcctcacttcccagtaggggcggctgggcagaggcgcccctcacctcctggatggggcggctggccgggcggggggctgacccccccacctccctcccggacggggcggctggccgggcggggggctgacccccacacctccctcccggacgcggtggctgccgggcggagacgctcctcactttccagactgggcagccaggcagaggggctcctcacgtcccagacgatgggcggccaggcagagacgctcctcacttcccagacggggtggcggccgggcagaggctgcaatctcggcactttgggaggccaaggcaggcgggtgggaggtggagattgtagccagccaagatcacgccactgcgctccagcctgggcaccattgagcactgagtgaaccagactccatctgcaatcccggcacctcgggaggccgaggctggcggatcactcgcggttaggagctggagaccagcccggccaacaaagagaaaccccgtctccaccaaaaaaatacgaaaaccagtcaggcgtggcggcggctgaggcaggagaatcaggcagggaggttgcagtgagccaagatggcagcagtacagtccagcttcggctcggcatcagagggagaccgtggaaagagagggagagggagaccgtggggagatgggagagggagagggagaaatagaatcttaattcttttttttttttttgagacaaagtcttgctgtgttgcccaggctggaatgcagtggtgtcgtctcggctcactgcaacctccgcctccagggttcaagcatagaatgtctctcatagcctcttgtaccacctctcctcttgttctctggaacaccgctctgtcttctcttctgtccctggaacataccaagagtgtattcaccctagagcctttggacttgctactcccactgtctggaacatcttctcctagcccttggtgtgtgtgtgcctcctcattattcaggcctcatatgcaatatccatattcccaccctttctgctctcagagtaccctgtttgtgttcttcatggcatttaccataatctgtaatgatcttgtttatttgttcacttatttgtgtctttgccacctggaatgtaaactctatgacagcagataattttgtcttgtttacttctgatttcctggaatcgagaactgtggcacatagaaaacactagaaaaataccgtttttgcctgggttccctcaataaaatagtctgttatcaggggttgcatgcattttgggaagtgaatcatgcaagaggaatgaggttggggaagtaaaacagtgaaggagggaaggccaatacagatatctgttgtaagtggtcactgcagtggactactcaagactggattgtgatgatgggcatcttctgtgaagccatgtgtctaagaactgtgcattctagggagagtggaaggtgtatctacccaccagattctgtttcagctttgagtcaagggcttacgtttccatggatgcatgtaggaccagcgacatgatttgcaaggcccagtgcaaaataaaattacaggtcattgttcaaaaagtattcataatttcaagatagagatagtagagccctaaaccaagaatgaggctcatctgagcacagagtcctgtgccactacacaggcctcgtgcccttgccctcatgcgctaggccaggcaggttcttgcagcatcccactgatgtcagagtgtcagagaagccccagagcatgagagctggagtgaagaagcatggctgaagtcaggtgctgtcacgttacacctgtaggaagcaggttgcacagcagtggttggagcaaaaggtggactgagaggatgtcaggccttgtcacttgagataacaagatatccaaaacaataaatgagtttagagtttctacggcttactgtcatttgccaaaaattccagaagatttaaatggtaattttgagagtaattactcttgtagttttgatgatgctaatggatggaactcttgtgctttcccattgagtatgatcatggtattgatttaaatgactatatttcctatgtgagaagccctattccttattattatttttaattgagacaggatctcactctgtcacccaggctggagtgcagtggcacaatcttgactcactgcagcctgcgcctcctgggcttaagcaatcctcccacctcagccttccaagtagctgggaccacaggtgcacaccactactcctggctaatttttttttttttttttttggtggagacagggtctcaccatgttgcccaggctggtcttgaactcccgagctcaagcgatcagcctgctctggcctcccaaagtgctgggattataggagtgagttattgtgcccggttcacaattttctaagacaccttagatagaaactctgtccaatagaatgttctgtgatgatgaaaaacgtcttgtctacacagtttaatatggtagccaataggcacatatggctattgagcactttacctgtgaggaactgttggttaaattttatttaattttaattcatttaggccaggcacggtggctcacgcctgtaatcccagcactttaggaggccgaggcaggcggatcatgaggtcaggagttcgagaccagcctggccaatgtgctgaaaccctgtctctactaaaaatacaaaaattatctgggcgtggtggctggcacctgtaatcccagctacttgggaggctgaggcaggagaatcccttgaacctgggaggcagaggttgcagtaagccaagattgcgccactgcactccagcctgggtgacagagcaagactccatctcaaaaaaaaaaattaaattaaatttaaaaagattaattcatataaatttaaagcaccatgtggctagtggctactgtattgcagagtgcagctattgatagcaaacgacacttgtacattctaccaatggtaaaattcaagtctttacttctgttcagtctctctgtgagctccactaactcagtaagttatctcaagcctgctttattttaaggcaatggattctagatccaggaaaaaaagttccatttccctatcttgtgtccaaggcagacatagctaattgaccatggcatttttattttctctgagtttagaagtagctttgtcatctttctcacagtgaggatctggaaagccactactcgttgagagggggtaacaataaactcatatttattgagggctaactgcgtgccaagtactttaagttacattagaagtaaatcccagtccctccaaccacacagatctgcattgtcttctttgtgttgggaaccaagatactcttccaactgggttggatgtcaacctgctcagccacctccatgggacagaccaatcaatcattcaaaggacaaaggaatttatttctcccctcacaatatttgacaaaacttaaaacactgatctttccatcttcattccactacaataattatatgttcataatggagactggacatggggaaagcaaagtaaaagaacatttactacgtgtcgatgtcagcgctgtgcaggatgctttagacatttttgtcatttagcagctataggaaccacatggacaggatatataaagcatctttagtttgtccttttctgctgtgcctcacaagaagtgagtaattaattttgtcagagggtgtttaattcagtttacttattaattcatttactaagtcaatgatattaattaagtgtccagtaagtgcaaaaaacaatgctaggttctgggaagccacatagacatcaaggtcctggcctcaagacattcagctttgtggactataaacggagtataatgagccatggcgatacagggaagagagagtttgaggagacaaggaaggctgcaaagagaaggtggcctttgaactaagtgttgatgaataaaaagaattcaccaggtaagaaaggagattctggactgaggtaaaattatgtgtgatagcataagcacaacaaatccatatggaatatttcagaaatggcaagtgttttagtgtaatttaccaacaccagaaattctgctcttggagtgacgtgtatctacttataatggtacattgtaaattactttgccattgcatgatgaactcaaagcgtacgtaagttaagctgtcaagaaaatatcagcatattatattattgaagtaaaatcagagggaaagtgatctactgctaactagctatctgacttcgggcaagtaagcttggttactttaggttttagttgccttatttataaaatgaagaggttgatgtagaatgtattatttatcctctacactattctaagaagcaacaataataccaagggcttattctcagaatgaaggaaagaagaaaatcaacaggtacttactgaatctgcccctagtaagttgacaaaggaaaggagataagtatatattcattgtcaatttgcacaaaacaattaaaaactgctaagaaaatattaaggtgttagtttgaacttctgaattctttattttttttttttttttgagatggagtctcgctctgttgcccaggctagagtgcagtggcgcgatctctgctcactgcaagccccgcctcccgggttcacggcattctcatgcctcagcctcccgagtagctgggactacaggtgcccgccaccacgcccggctaattgaacttctgaattctaatggctgggagagggtgggacatggtagggaaaagtgcagatatgaatctaagaggctcgttttgaggaaggactgccagatttctacaaagcaatcagaaaaaggatactactatgctctttcaatatcttgttcttaaaaaacaaaagtgatcattcctggaactctgataagaaagattccagtaggctgtttatttacttaacattgccattgcctggactgaagagagataatcacttttagtttcaaactcgatctagtctataacacatggaaagggatttcatgtgttttctaggaagaaacagatgttacccataaaaaacaaagcaaaaaaacccaaaaaatctatattgctattgcaaaatctgagtgtgagaactcatgtcatattcatacacgataaatgccatatgttatttgtataaagaaaggtaataatgcattttcaaataattagttaaaataattttggttggtcaaaactgtattagaagatgaattctctgaggccaactggtgactgtctgaggctcccacatttacagattttatgttatttcaacaaatatccatggagtgtgggagaggcactgtgctaggtgccagatatacactggaggatgaaacagacagagcccttgtcctcatggagcttagagtctggtagggacaacatacctacaaaataaacaccataataggtatttcattcatgccttaaaggaaaacaacaaagatcgggggtcgggtggaactaattcagggcggggcagccaggaaagcagagaccctggctactctcttcactgacagttaaacagatccattcagctgttcaccaggaatttctcagtgtaactttcagagtaagagtaaaacaattccttttttaagagaccagggtatcactctgtctcccaggctggagtgtagtggcatgatcatagcttactataacctcaaactcctgggctcaagtgatcctcccacctcagcctcccaagaagctaagacaccaggcacatgccaccacacccggctagtttttaagatttttttgtagagacagggtcttgctggtcttgaactcctggcctcaagtgaccctcccaccttggcctcccaaagtgctgggattacaggagtgagccacctcacctggccataacacaattctttaagcatctaagggatttaagtatcatttcagggttttgtggtcacaagagttttaaaatctccatccctgacaggtgagtcaaaaactactctcattcatggcaccctgaaccacataaaaataacaatgtaaaccatacatcatttggggattgctggttccctcagatttagacgacgtttcttgaaacctcccccatcccatgctcagtagaagtcaaggcccattccaatacttctgcaaattccataggagtggctctgactctgaactctttgcttttgcaaatgggtttagatcatggaacgtgttgctttactataaatgtggtttgtgtttcatgccatgttaacctagatgtgaaacgtagtctccttttgattgccacagagctcttttcttttttttttccttgagatggagtcttgctctgttgccaggctggagtgcagtggcgcgatctcagcacactgcaacctccgcctcccaggttcaagcgattctcctgcctcagcttcccgagtagctgggactacaagcacgtgccaccatgcccagctaatatttttgtgttttaatagagacggggtttcaccatgttggccaggatggtctcgatctcttgaccttgtggtcctcccgccttggcctcccaaagtgctgtgattacaggcgtgagccaccgcacctggccagagctcttgtaggacatttgtatgtatagtagtttttttaaaaaaagatttcagaggggatgaagtgaagaagaggtttgtattagtcaggataagtcaactgctgtaacaaacaagccccattatagtaacttagcaataacaacaaaaggattctttctttctgatatcactgttcagtgggggttggagagggcctgatccatatagtccttcacagactggagctcttctctggcggcttcagaatcttctagggtattagagtccccaacttgattctctgcaatcagcctgcaggagagggaaaggcatgtggaagaactgccagatttgaagagaagtgtttgaggagacaaggaaggctgcaacgagatactttgggagttatattggccacatctggaggtggcacacaccacttctgcccactttccgttaactcgtagtcacatggctatacctaactgccgtggagggtgggaaatatagtttagttttgaggccaggatgaaaacagcttttgtaatctgtctctgccacaggatttattctgtagtggcacaaacaacttcaaatttaacgtttaatctcctagtttttaggaagtccttggccttctcacttctatggatttttttttttttttaagacagagtctcattctgtcaccaggctggagtgcagtggtgcgatctcagctcactgcaacctccacctcctgggttcaagtgatgatccttccttagcctcccgagtagctgagagtacaggcacgtgccaccaggcccagctaatgtttgtatttttagtagaaacagggtttcaccatgttggccaggatggtctcgatctcttgaccttgtgatccacccaccttgcctcccaaagtactgggattacaggtgtgagccaccacgcctggcctacttctacggatttttaatgtaattttcagactcatgccaactcctcttcccctctccacttcattccttccttccttccctttctgtcttcccatacgctaatatttttgtttttttttttctggcagagtgtattcaatgacccctcattgccttgtctccaacaggctactgatgtaactgggcagcttaacttcgacatgcatcttaaaacctgttttcctttctcttgggtttcaagatataaccttgacacaaactgcagaagcctttttcccttagccttaagatatccatgtccctccccttctcaccatatatactcccttcacatttacctaactgtatgctagtatctaattatgtgccttcttagttcccggggctaatcttaagacaggcagaccaagcctgagacccagctgcaaaatttgagagattacttcaaggcaactagtcaacaacccaaccattgttgagatgatgccagcccacgctccaggtagactgggacccaagatatccaacagaacaagacatgcagacattgtactcagcacaattcttgcctgccttccgtatcaagtttcccccccaacttttttttttcttttttttttgagatggagtctcgctctgttgtccaggctggagtgtgatggtgcaatcttggcttactgcaacctctgcttcccgggttcaagtgattctcctgcttcagcctcccgagtcactgggattacaggcacccgccaccatgcccccctaattttttgtatttttagtagagatggggtttcaccatgttggtcaggctggtctcgatctcatgaccttaggtgatccacccgcctcagcctcccaaagtgctgggattacaggcgtgagccaccatgcctggcaaaattttccctttttaagcccttgcctttcccccaaaaatcaaagtgattactttggagggcatcaggctacttccccattgctagatttggttaatgaagtcactttctttctgccatacctcactcatgttaactgtactctgcaaacgacgagcgaccaaacctgcattgagttacactgagactctcaccatccatctaactgtcttatttatataggcaggaggtgggaaatactgggtagaagagggcagggtgcatggtgagggctccaccctcaagcatggacccatggccctaagtgagcacatgcattcctgttttcccatctgaatgttgccttttcccaaccaccctggcctgccatgcccctggccctgtacccataaaaaccccaggctcccctgtcagaggagcagaatggtgcagcagagaaagagaaaagtgtctgaatgtcgagaggaaaagaggcagctggacaccagagactatggttggaggggagtttggccagggatggtcagagaggagctcctctggggacggccaaactctaggggaagatgatcttcccacttcatcccctttccagcatcctatcccactgagagccacttccatcactcagtaaaattctccacatacaccacccttcaatcctgattcttcctggatgctggacaagaatttgggacgcactgggtgcaagaacccaaaaaggctgtcacactgactcttcactgaggtgtttaacccttaagccctctgtggatggcaaaagctaaaagagcattgtttataacacgtgccttctggggctccagaggtcccgggcaacacctagatgctactgtagtctggtacggggcttgttcctaccagtacccaaaggcactcacccaggctcctgcacctgctcacctgcggctccctctctcacaagggagttgagtatggaggtaaacaagccacacccctgttgcaaggcccgagaaggggtcaaaggaactctcccatctcattatcagagaaccaaggcagttcttcactagagaa

SEQ ID NO: 30 - DNA, 160484 bp, Artificial Sequence
  Synthetic BAC sequence
gcttctgaacctaaaatctaagaatttgatgggagagaaaatggatccccaatggctcctgtgagtggattccagagataaggatgttgccctctggcccctgctccttcatcatcaaagctggaagcgtcttttgctggacaatttgcaaatccccacccagcccttcctgtttcatttcttctttcctttctctcctcttgcccctatcttgtgctttgttttcccccactgccagagcttctcatcttttaacacttgctattgttttcttgtttcttttcattcctttctccccttccatcagcctcctttgatcattttccatggttttattacctttgaggggtgggaagatggtggctctgtttctttctaggtgagaggagctgtttctatgagtccccaaaaggcactggtgggccacaccttagctctcctgagcaggttcacaggatgtgagcctcagagttcagggcgcaggtgacttcctctcctggatcgagtcaccaactgtccccgctctgggcaccagggactgcctctgtggctggagaaggccatctgtgttttccctgtttactgtcagagacattgtgaggacacaaacaggaagacttgtgttttagcaaggttattaaaaatggataaaccagttttctgagaccctgggatccatgcagacagctaggttagtggcctttctttaacagtaagagcagaaaatttttaaagaatgacagagaaaccagtctgtggcttaaataaaaagaccacaagttccttctggtgtcttgggaggcagcggtgtgaaaacaccacgcaagggtctggaggaggcaggagatggggagagatgaaaaaggagaggcccacagtatggatgcctccggctgctctgctgatgctctgtgtgcgaggaaagcctgtgctggcctgtccaccccagtctgattctgtccccatttccagcacgcccctagttactcctgctgcagcaggcaccctgccacccagggcagtggcccacgggccaaatccaggccctgtttttgtaggttcatgaactaaaagctataatgacctatttaatggttgaaaacaaaaagaataacattttgtgacaagaaaagtccaagaaattcacgtagtgttgacaaagtgtaattggaacacagccatgcccatcgttgacctattccctatggcggcttgcccctacaaaggcagagttgagtagtttcaacacagagtttttcccacaaagcagaaaacgtttactctctgaccctttgcagaaaaaatttgtggacgcctaccataacccacagacatgaaactcagactgccactatgtttcaactttgaattagctgcaaattaaaaagaaatcaggatatgtcattctgaatttctgaccaaataaggactgccctctttgaagggtgcacacacacttactggttccccaccagccctcctaaattcctgtccccttcccatagctaaggtcgagagttggtggcttacaccagtggtctttcaacaggagtgattttgacccccagcctccaaacctcagacatttggtgatgcctggagatatttttgattgtcacgactgggaaggtgctactggcatctagtgggtagaggccggcaatgctggaaattatcttataatgcgcagaacagccctcacaacaaagaattatctggcagaaaatgtcagcagtgctgaggctgagaagtcgtggcctgaactaccctctgccttctagatccacacacagtgttcacatgggtgagactcccctctaggtgtcccctcttttttctaatttaaaatttgttttaaattcaactttacagcagtaatcccaagagttttaaatagcaattatttgtcatgcttaattaactcctaacatgatctgtgtgcacctgtacacatttttcagctaattgcaaatcatactgaatacattatgttctcccatatataaaaattcatgcatgagcaaagcattttgaacatccatgaaaaaccccatggcgggcctgcatggtgtggtttgctaaggcatcccttggttgataggattcgtttaaaggtcctcctagtatagagtgcaatgcgataaacatttatcttttcttacctttgtcctgtctctttggggctgttttcaaaagtggaattgctggtcagaattttatggttgtcacattttgcgtgactgtgtcccatcaaaggttatgctgatttacagtatcaccagacatgtctgacggatcctttgtccttttccactgagaatcagctgtctaccactgtgagcttgattttgtcaatttatcgggaatagttaatgaaactttatagttatttgtgttgctttaatccttgtgaagccaaacttttctttttttattgttgccatgtccctgtgttgacattacagaatgttctctgcctccgtgctcctggggacattgacagaccagctgagttgctagaaataagagggactcagtaggcccttagcacagcgggtggactttgccatttggttgactatttaaaatacttgtttttgtagggcatctgaaaaagaaatttcacactggtgtattttgttaattgtttctacgtaaatgttgattattgacaagcctacttgtaatcaaaatgtgtagtgtggtcagtgtcttgcactcttatgttgtggcggggggggggggcggttcctgaagagtggagtgtgactaaggataacagcagtcctcatttcctttggacactggggtcagtggggagagagtttgctccgaagcacaaacagctccaatccatgctggaagagaccccaggccacaatagcccttgacacagagctctatgcagggctgtgctgcccaagacgcttgtcgtgtgctgatgaaaagggctggggagaagcaaggggcaggggaggggcagaactccacaagagggcaaaacctgctgtcagcaatgctctcgtggctgttcaagggaagtgagatacttgtactatgcatttcatttttaggactagaattctgtcttcctgcccaacttcaatataagtgtggactaaaatgcgagaaaggtgtcctgtggtctatgcaaattagaaaggacatgcagagttttccaactaggaagactgaatctgtggccccaagagaaccatctctgaagactgggtatgtggtcttttccacacatggaccacctacggatgcaatctgtaatgcatgtgcatgagaagtctgttattaagtagagtgtgaaaacatggttatggtaataggaacagcttttaaaatgcttttgtatttgggcctttcatacaaaaaagccataataccattttcatgtaatgctatacttctatactattttcatgtaatactatacttctatactattttcatgtaatactatacttctatactattttcatgtaatactatacttctatattaaagttttacccactcagccaggtgcagtgactcacacctttaatcccagcaccttgggaggctgaggtgggcagatcacttgaggtcaggagtttgagaccagcctgggcaacatgctgaaaccctgtctctacaaaaaatacaaaaattagccaggcgtggtggtgcgcacctgtaatctcagctacacgggagtctgaggcaggagaatcacttgaacccgcgaggcagagattgcagtgagccaagatcgtgcctctgctctccagcctgggcaacagagcaagaccctgtcttaaagttttacctactcagctatctaaactgaggctccacaatgtaaatacgtgagagatcagggaagcctggtggctgtgggaaagggctccagttgaccaggactcggcagctcattacactctttgctgcaggaaatgactcctgcctgcatttcctgtggaggatccgagacccacgcccgggctctcattgtcttcctattccaggctccttcccgctcctggagctgccgctgggtctcagctctctgctctgaggctacgccgcagctacagctccctgacctgttcctgttcaggctcccaggaaacctcagagtggcaggtgcctgctgtttcctctgtctcccgcccatcccaccacggcctctcctgtactttcaatttgtttttctttagccattccttcccttcagcttctaaacacagttgggtcacttccattaaagaaagaaagagcccctggatcttcctctccctctggctgcccacagactcttgtcacaacgcaggccgtggtttaaagggaacgtggtctacagcccgtctggcagcttctccaggcagctgaacttgtttccgtttttggtagtgagaaaattgcaccgctagaactttctagaggtgtagaaagcagggagtcactcaacccattctggttcgggggactgccagattttttttaaaaaaaagggggtgtagaaagcaagtgagaccaaacaattttgggacaaggaatacggacacagaacagactggtaagtacccaagtgtatgacaaacatccaccatggatctaggagaagccctggggcagggtgatattcacccgcagagacccctgttcatcactaagcttatgaagaaccattgactggcatttaacaccaggtgctgtgctcaaggtgtggcacgcagtacccagtaagcctcacaactgcattgtgagtaggtagctctggccagtggcagatgaggaggctgtgctcagagaggctagatgacttggcggaggctctctgaggctctaagcgggaagtggggggttggagcccagccctttgactttccttgtgcttttctacctcgggtgagtaagatgaccaagggactggggagatcaagaggagtggagactccaaggggacccctttttggtgagacgtgtagaccattcccctctcccctgggtgcctgcagagagctcttgagactggttttagagccagtgaggtctaagagaaatgctgacggcaggtgtggggatggagaggggaaccatgtccatgttcacagccctggtgacaagaagacagaagcccccagggacccagagcttcagaagggtttacgatggctacagaagcaggtagtcccatgacggtgtagaatctgtaagcacccccaggagctgggcagggcaaaagcaggtctgctggaagagtggatgtcccatgactgttggaataaggtaccacgtgggtgcctcctcccacccctccttccccctcccccacccccacgcgcccttggggcaaagcgagactcgtatcaaaataaaaataagttattggctcacgagttacactttcagagtccacagacttagcaaggattcgtgtcctcttgccgctgtaacacatttccataagctcaatgccttaaacaacaggaattgatgatttcacagttctgcaggttggaagtcacactgggctacagtccaggtgctggcagggctgtgttcctctctggaggccatagggaagagtcttccttgcctcctccagctcctaggcgatgcctttattccttggcttgcggctccttcctccgtctgcggagccagcggtgttgcgtctctcagttctgcagtcacactcgctctgtgtgcaggacctgggctgcacagcatgaaggccccaactaaagcctccgtctccatgtagggactttctcccgagatgccaggtttgtccttttaggagttcctggcccatagaagactgtggctatatagtcttatgtgagatcagaacccaatgggagcttgatgggaactgagcccagaaacccatcaaaatctcatcttattgttgtcaaagctatagggccaaaggatctagggcctagaaaacctagccctagatccatggcccagggggctcactaacagtgcccctagaattagacatcccaggtccctggcccagctggattcccacaggccttgctctgcagggacaagatcctgagagagcaggaggggcagactctgggggtagaaccaggggctgtcttggcctcggcccatcagaaccacaagcgcaggcccatggaagggcgaataaggggaagtccaataacaataaggtccaaatgaacttccatctgaattcagaattcttaaggattagcaagtgctggagtttgtgcagggctcaggggtccaggaaggtgcaccccagttagtgaaaagcctagggtgctggttcagtcaaaaccacgactgcatatgtgcacctcacacatctcccaggggcttgatttcaaaccttccttcataggaaacaagccacaggacacaaaacacatccagttggccttttgaaagaaataatatgtatttacttagaaacaaaattgcacttttccctataagtcaacaaatgctaaggattctggacgtcaaatacctcccaagacgttttatcagccagactttgttgtccttcaggaaaaaatatgagttccaggaaaaatgacaggcatgcaggatgctgatttccttcctgatggtaagacagcagcctcctagactgacgatttcgtgacttctcaggggctgggtccggagaacaccttactttaaacaaagggagaatgctctgtccaaaggcatcttctcttgaacccaaagcaatgttttcccatcatatatcagaattttcactcttttctagatccttatcccctcactaccccttccccatcaaaaatataaaacaagaaattttaaaaaaatcttttttttcttagaaacacagtctaactttgttgcccaggtcagagtgcagtggtgtgatcatggctcactgtagcctccatctcctgggctcaaggaatcctcccacttcagtctcccacatggctgggattgtgccactacacccggctgattgttttgtttttttgtagagatgggggtcttgctttgttactcagaccagactggtcttgaactcctggcctcaagcaatcctgctgcttcagcctcccaaagtgctgaaattacaggcatgagccactgtgcccggcacaaaatcttccaaaaaacaaaacaaaatgaaaaccccaggagtcctgaatatcatcctttgagtcctcctgacctccttgtctgagagagccttgagtgaaggagctcaggacggtacccctgaggcctgcactccagcctaggtgactgagcatgggtgacccgtcactgtgctgccgacagcagaatggactgacagggcttccagatggacaccgtccctgtaagagcatcttaatgcctcaggctaagtcccatgtcagagtcagggcttagctaacttaacaggtgggaagctaacttaactcacggcatgtttacaagtgtgataacatttataaattctaaaataataaagctaattgtattagtctgttctcacacttctaataaagacatacttgagactgggtaattaataaaggaaagaggtttaatggactcacaattccacatggctggggaagcttcacaatcatggtggaaggcaaaaggcacgtcttacttggcagcaggcaagagagaaggagaaccaagtgaaaggggaaaccccttataaaaccatcagatcggccaggtatggtggctcctgcctgtaatcccagcactttgggaggccgaggcaggcggatcacctgaggtcaggagttcgagaccaacctgaccaacatggagaaaccctgtctctactaaaaatacaaaattagcctggcgtggtggcacgtgcctgtaatcccacctactcaggaggctgaggcaggagaatcacttgaacctggaaggtggaggttgcggtgagctgagatcgcgccattgcactccagcctgggtaacaagagtgaaactccatcgcaaaaaacaaacaaacaaaaaacaaaaaaacaccatcagattgcgtgagacttattcattaccacgagaacagtttgggggaattgcccccatgattcaattatctcccactaagtccttcccacaacacgtgggaattatgagaatataattcaagatgaggtttgggtggggacacagccaaatcatatcactaatgaacccacttaattaaatattcttcaattttgtgattttcttttcttggttatttgccatcaattgttttcttcaggtcaagcatatttttgtaggtccccaaaaaaactcactggcctgggagcctgcctctctgttgccaggtggatagaatatctctggctaagtgttgtaatgaaaatgccctgctggcgtctaattggagaccattgccgggtggtcccaggtggagggcatagggttggggtcagcttgggctgtgggtggagaggcaggaggtcacctgcaggctgacaggacccagccatcgtttcccctcgtcccagactaggtgttaaacgtgaagcattaacaggtagtcctgatgggcctttctggagtttgctaaactgaggtctggtgagtgagtctgacgctttgggtggttctgtgtgcaactatcacctggaccctcctgtgaacactgtcaccgcagataaggaccacgcccaaagtgtcccaattctgaatgctgtatttgtacagggatggggttaggaatggaaccttaggttaagtccccccaaagcaaatcctgagacaaacatccaggtgtaactaattcatccagggcacattcccaagagaaactggtgagcgagtgagggaggcttgagaggaggggaagacgccagggcagggtgggatttcaggcagagccctgcaggtcagcgccagtctcatccccagatgatgctggaggtaagtgactcagtccttggcgcgtgtcctccccaggcaaggggcctgggctatcacactcctaagctcctcagtctactagtaaacagctgtccccacagggtatgaaacctccaggcacatttgactgtgtgcttggaggccaggagtcaggctccggtagcctgagggaagctgtggaaagataactgcaggtgcccgcagtggaaagcaaagcccagggaagctggtggagatgggggcagatcctgttgccagatttggcaatacaaaatgcagagcacgtatttacataacacacaccaggtactgtcctgtgtgtttttcaaagactatctcgtttaatcccagcctggccagctctggagtgggtgctcccctagttgtttttttttgtttgtttgttttttgggtttttttttttttttttttgagatggagttttgctcttgttgcccaggctggagtgcagtggcgcaatctcggctcaccacaacgtccgcctcccaggttcaagtgattctcctgcttcagcctcccgagtagctgggattacaggcatgcgccaccacacctggctcattttgtatttttagtagagacggggtttttccatgttggtcaggctggtctcgaactcctgacctcaggtgatccgcccgcctcagcctcccaaagtgctgggattacaggcgtgagccaccgtgcccagcccagtgcgcccctattttgaaggtagaatgtagtcgtttgaagcaggagcactggggtcagactgaattttaagccccagcgttgctccctgctcctctgttgccttccacgagttcctcaacctctctaagcttcagttgctttatctgtaaaatgggtgaaatagtatcaccacaacaattggggcagtgaaacgaagcagtgattctaccacttcattctaccactgtttgctgcacatagtgcttggcacatagtaagcgcggggtgagtaacagtggggcttgttgtcatcattacagatgaggtaactgaggtgaggaaagcccatgctgtttctaaagggtggctttgcattggttttcatttctgtgtggggccaggggaggggtggactctggggaggtgtgaacctggctgtgagtgcatagggcaagagtcccctattttccagccccctctcagggtctccttcctgatactgtccacaaacaagaaggggtccgcccagtctgaaggaccccagaacctcacggcaggcctggggaggctaggcggcgatgctgaaataaaggaggaggcaaggaggagaagccgggcaggggattgtctagaattgtccaaaaagaggaaacgagctatttctcagctctttgcctttagtgcttgcctggagatgccattgttagggtcccaggccagtcccacaatctagaaaccctccctccccacatttcatagacacagccatagtcgtggcatggacactgcatgagcccctgcaagcaatgcacaggcctcctcaggaggggaggtgccacctggtttctggagcctcaggcctccctcaccctccgcaggatgcttctccttggacatgatgttcccaggcttggaagcagctacccttccttcacctcacaggctcattgcccctctctttccctggagcctccagctaaccagtcgccacgtctggccgcgctgctcctgagctggctttgctttcctatttttctcctggcctcagcccccttcagacttcaccctgatgagaaaagtgctcctgagtagtgtcctgtctcaggcttaccctctcttgtccattcctcaagtaggtgttacaataatctcaaagacaagaaagaactagaatagtccccatctcatgggatgaatgacggaaagcccagctccccagctggtgacatcatcaccaagcagggcctggactggggcaagtctagggctcccaacagaaggaggtgctcactttcggggtcacgcaagggcaccaagtacctcccatgactgtgtgccctgggtacctctcttatctcacccactgtgtttcttactcttctctctgctacgggaggccctttgacatcaccagattgtgacctttcatttagcatggaatcagtagaaaatctgacacctgcagaattatctgcacgaagaaagcctccttgtttggaaatggggctggcttacattcacacatgactctattggagaagacagaaacctgtttgatgttgccttaaatgtagtaaaaatgttgtggttggactggcacagtggctcacaactgtaatctcagcactttgggaggccaaggcaggagcatcacttgaggccaggatgttgaggctagcctgggcaacatagtgacactccatccctacaaaactttttttaaaaaattagccaggtctggtggcacacgtctgtcatcccagttgctttgggggctgaggcaggaggattgctccagcccatgaattcgaggttgcagttacctaagagcgcataactgcactccagcctgggccacagcatgagattgtgtttcaaaaacacggtggtgattagacgtctcttttgaacctgcctcaaggtcagaggtgtatgattaggtgccaccttgggcattcctttctgtcctgggagtagaaaaagtgtaagattacctccccacgagcacttgagcatgggttgtagataaatccatctgtgtccctgctggggctgatggagatatgaggactgaggggtcctccttgcttgaagtcacatctttggcaaagggctggaaagagggcagggaatatctagatgttgctcagaggggtcaacaaaaattcttccggccagtcctgaaatacaagtctcattgtaacaataagaattatagtttagtctgacccagagaactgaggcaacattgatttgaaaacagtttgtgcacactgctggctctcctggtcaccagctcatgcctgcacgacaaaattctacagaagatgcttttcctccaggaaggcatcccgatgagcacagctttttgcccgaacataaaatgttttctgaaaaatctttccccaaaaaagagggagtgctttagtaaagtacttacaaagtttctcatatcacagtttctctcttcttatttatttatttattatttttctgagacagattctcgccctgtcacccaggctggagtgcagtggcatgaccttggctcactgcagcctccgcctcccgggttcaagtgattctcctgcctcaggcacccaagtagctgggattacaggtgccgcaccaccacgccaggctaattcttgtatttttagtagagacggggtttcaccatgttggccaggctggtctcaaattcctgacctcaagtgatctgcccactttggcctccgaaagtgctgggattacaggcgtgagcctctgtgcttggcctctcttcgttatttaaacacaaaagttctgtttgcgaaagacccattcactaaaatgacctcatccaatgttaatttttaattttgagaatcacacggagatcaccagaaggaactggcataaaaggagacaagggatttagtcattattcctgggatatgatctcaatattaactaggttagatttcagtgtaaagttttttaaagaccattttaaaaagcaaaatggtaacaggttacattactgggatggggggaaagtctcttaagataaaagtggatacttaaggcttgaatactgttttccacgacagcattgtctgctgtctctcacacaactagatggaaatgttaggaacgagctcccaaaacctgtgcctatgattcacaaaggggatctggtaatgacgaggaaggacctcagtgtccaattgcaagtgaagagttgcatggaactatcttcataaagtacgagtgaacaaaatcaattctatatttctgcattgttccacatcatcttatttaaaatatggatcataggcagacatctgactatttaatcaacatctgtaaagctcacacagttaagctgtccaaaaacttttcttgggatcttctcgttgaggaattgggggattgttttatactgggagctgcctggtgtttggccaggggttggtcgtagcctggtttgtagggcctgagcctacttgcactttctgatgtgttcttaaggcggagcctgatcctggttcactccgtcttcctcactagacagtaacttcccaaagggcagggccgtccttttataacccacaaacccagcgttttctcctgtgctgttggaaagtttgctggcccctcttctctggacctcattttcctcgtccaggatgaggagtttggataaaatgatttaataaggatccatctgactttaattttctctaaatttttgcttttggattgagtatatattttgcttcaaatgaaagctcttgccaaggcacggtggttcagagatgtaatcacagcactttggaaggccaaggatggaagatagcttgaagccaggcatttgagaccagcctggccaacaaagtgagcccgtgtctacaaaaaagaaaaaagaaaaattagccgggcatggcagtgctgcctgtagtctgagctacttgagaggctgaggtgggaggattgcttgagcctgggcaacagagcaagactctctctctcttggttgggggaagctcttgcctgtagccagggtgggatgggaatcaggaaatgatcccaggtttgagatgcgaaggaggcagattcctgactgcctatggcactgtgcaactctggattagaagaaacctgagacacattttaaacattttttaaaattaaaaataacttgtttattcacccacttacctgttcatataagcaagctctgccaaacaccgagcactatgctgggccaggagaggactgagctggggccctctctccagaggcccagcagtaggtgccaggatatagaaggcccttaactcagggggaaggagagagaagaatggaagatttccctcaagagggtatctatttgagttgatttttggtgaaccagtaagaatttcccagcttaacagggactggggactggagaacattctaggggaggaaatcatgtgcatgggctaggttagaagaaactcagtatgttctggaaactataaagtgtgcagctggggggttggaaaggtccagcgaggccccaaaaggacagaaagcaaatgtggggaatgaggtcagcacagcggggcagcagcaggcagcccctctgggagtggcaggagatggagaggagtggctggcggcaccgtgaaggtgaggcaggctggaacgggtgctcgcgctaggcagcgggcccggggaagtctgtggacagaaccacctggggtaggaccgtggtctgagcacccaggaaaagcccctgccggagatcctcctgtcactagttgccatgggctagattccaccattagaggagtctttctttggccaaaagaatgagactccaggggtcgtgtgagggtgcattctcaggaaagtgggacacattgacctcttttgcaggggttgctctatagggtcagagcaaatgtatgtgctagtaggggtggggagccagcctcggagtaaaccttgagggcataaggagaagtactgctctgggctcgaggctcagttaggacacttcaaggtaggcaattgcagggggctgcttgagggcacaaggtgccccatattcacaaataagggtggtggggagggagatgaggggaagagaaactcagaagagtttgaagggcctgggaagcaggtgtgcattctccttaagctagcctgggcatgacgtcatcaagaattttgcttaagtggttgggtacaattggtgtacacatcaaagaatgcggactttggatcaggttggagttggaactccactgtttgtcaaccacatgaccccgggcaagttattcaacctcttggaggctgcatttgtaaatggtgctggtatttacctcataagtttctaggatttcataacccacagtaaacacttcatagatggcatatatttgctcacctttggacaccctgctccggcatgtggcccccagcaggtgatcagaaaggtctgccggttcatttgaagaggagcggcccctcacccccagcagcaatgtctagtctcgattctgaccgtggcagttaaaagtttcttggaggtcctttcctaggcactgatgctggctgggtagccctggtgttcgtatgtctagattgaacaactggcaaaatccacactgactttgacctgaagagtggctgacttttcattctcagaacgcttatgcagaattatggtttctattgtcagaatctcagtgcctttttatttaaatattccccttcatgccattcctttaaaagcattatccctctcataaagcttatagagcctatttccaagaattttctataaattcatttaaaagctatcattagtcaacaggctgcttctgactacaggcaagactgcagggaaaaccttttcctacggggaagggacccagatgtatacttaatagttgtgtcttggacctgttactaagtgaagattgttctaggaaagtaggcctggactgaggtattagatttctaatcaacaggctggtctcattcagagtttgaaccagcactctgggggagaaaccacttgtggccgttgaattactctggctagcctgtctcagaaagaccatccacagccagggctaatgagacagttgaagaaagagaaatactttacctgagggttttggtttttttttggcttttatttttgtgtgtgtggattaccaccatatagctcaccatgttatcccagaaagactacaatttcatacagaatgcacagatgtttaaataaaaagccatttaagtgaggggataattctcactaaaaaaagctcaaaaataagaaatgacaattctagatacacttttttgacatgtaaaatgacataaccatagtcacagggaataaagaatcaggtttgaatgtccacaggtttctaaaactaagctctggcttcgtatctgttgaaaatctttagcggttggggaaaatagctatatttaaaaacaaatattgaattttgagttgaaaggtacattttcctcccttgatggagacagaacttttctatggagaacccaagcagcctttccatgatcttactaagttgtccaagagccaaccccgatcagcagcaacaggactcaagctgttcaccctgctttcgagttggctgagcttcctgctgctttcacacattcttctttttctacctcagttcctctttgcttgtagtctttcactccattaacttgcccaagcactggacttaagtatggaagagcctatacgcagttgtaatatatttcgtattttgaaagtgtagaagtttgtattaatttaaaaagaaaaagcttaaatggaaagttaagcaatcctgaacaagaaaactctctcactgcctttgggctagagaaagagtatgctctcaaggagttacataatcttttccaaagcaggatggactgtatctatcatacacattaggataagatgagccaccacaccttaaagaaatcaggcttgagcctatacaagccataaccaaatagaagattttaaacaaaggagcacatagcccaaagctgacatgttatttctataaactctggtatatatgtgaaggagttactgttggctggcttgtgggttttttgactcactacatttttttagacaaaatcacaatgtgaaggcacattaatagttgagattttcttttccttccaggtggacttgctgactgattagtttcatatactacttagtaacctcaagaagtagcaggaggatgccatgtatcaatcttgaacttcaagtctcactgcaacaaggatggagactccagcagagtgcagggtgggcacagacaggccacaagatggcgcagcacctccatacttgggctcttgacaaccaagtaggtttttttttttttttttttttttaatgtccactaggagggaggatgctacgatttcagacctcagctattaaatagtaaatctggaaaactagtggataaatttgccatctccattctatgttattaagaccaagatagtgtactggttttcttttaaatcacattccattatgtcatttaaaatgtcacaaaacccacacgaagcatctcatttacactaagatgcttatttagctaacaccactaatgataaatgctgttacaaatatgcatagtcagatgatagtaaccacatacagaaaaaaaatttgaacaagtatttatttcttaaaatttacttaagggattagagctaatatataatagaacatttaatataacatttggagttatgtcaacataaaaatagctgtggttacaattagcacatgcaattcactgcaaaggtaaaaatacatgctatactctagacaagccttccaaatgaagttagagtagatggggtaaaacagcaagtgaacatgaaaggattgcacttagaagaaagtgggacatagctaggatataaaagaaacatacctaatgctagtcagtcactgcattgtcctactagcaaattgcacatttatttttagagtatattcaatacacatacatattgagactagagaattttcaaatatctacctttgaaatatccctttgtttctaacacatcacattatggtattaatgtaacagcacttaaaacctgtagttatcattcaaagcttgtgttcaagagataaaagaacatcattcagacaaagcctgtgttcaagaaataaaaaaaacatctatcactatcggccttaaatgcatctcatcacacgacccatcaactttaatgaaatgggtaatgaagttaaactaaccagtttgtacaaactattgactgagaaaaagcccttaaaaatttaggaacaaatgagcaacagaagagctcaccctgagctgccaccttttaatttttaatgcaatgtatatgagaatatcatgctaatgcacatactagtagcatgtatgatggaaaaaaataggttaatgcaaaagataatacgcttggctttgtaaagttttgttttgacttacatcatctgaattctgtttatcgagtctgaaaaggaactgctgccaaggaccagtccaaagaagaattaggctgtaagactgctagttcataccttctttgaaatcaatgacaatgtccaattttaggctaatcctaaaacacttgccattttatgactccatattcttttaatttacagaaaagtacaaattttttagaaagtaatcttatcagcacaatataatctaacaatacctgtaatagaaagctatcccagtaaattttttttgaacaattgaacttttgtcttatgcagcttataactttgttattttattcatctcaacaaaataaaactttattgaaacaaaagtgtatggtttaggaatatgctcttaataacaactgagcaaaattagaatgatgtggactataacagaatgaaggaagatctctcctgcttgatgtacttggtcaatatatgttagtaaacagaaatattttagggaattctatgattattctacttctacatttacatgtcatggttttaactagttaaatgggtagaaaaaagacatctttaataattgatttctatttctcaaactagatgctctactttaaatatgagctttaatgaatgttttgtaacattttaaagttgtaacatttctaagtatactccactaacttcacaataagagctagggtcactggatgacttcatgtggtaaaatcccttatcaaggaataaggctgaaatttaaatgaacaattaggtagagaagaggtatgaacacagaacatgtgaatgaaatttgctttttttccttgctgctgttcccgagtgccgactgatccatagtaaaaaaggacaagattaaaattttaggttttaatggtacaaagtgtgaagttttatagttttctaataattattcagtattatccctttcagagatgagggtaggataccacagacatcagtaactgacaagttataatatcaacacatgtaacatttgggtcattattttataaccctaaagggagcaactgcaggtgcagaagcagtgagtgaactagttttgtccagacaaggttttctgatgtgctattactttaaacaccacttttggacactaaagatttaaagtgataaagccactaactaactttattagactagtttttacataaataaccagatttctttgcctacctaaagtacaatttacatgcatcaacacatagattattctaagacatgcttgggaaagtaattttgaatgtaaaaagttttataatttattttctccttagggcaggtgtacattacatattagtgctcaaatatatgttcatttccagaatgaatttttgcacagtaatcatatatccatttaatatgtataaagtgttcttggggatgggggtatattcactcactgtaccatgttttatacaggcttcaacatgcaaatttgtttatatcatggccttcaatgatcctccattctcattcctgtagattaagagttcatattgtatatctgaccctgaaatgtacaaacttcacactacaacattcttcatgacactatttgttatgaggaaagttgcagctaaatattagtcatgtgacttaaattttgagaaaatggaaaatgtaataggtataaatttcctgacacatacagcaagacaaatccagcccagcctttgatgatcaacttaaaagctggagatgtcattatcttgttgtgtaaatttgggtctatccctacctttacttctctgtgcctgattttcctcatctactttgaattcgtcattctattaatctacttttgcctaaagtgggaaactgaatatatcagaatgaaacatctatttttttcataaagaagatcatataatatgtgaaagaactttgaaaggatgaggcattatataaatgcaagaatataaaagataaacaggaagtctaatgtgaacaatattctgagagtaaaaagtgtaattatatttccattgtaaatgtataccaagttttcttagctttctattctccaataacctctagaaactattctaagcatgcctggtttctgtaacttaaatatggcataaaaacctgtttcctttgaattcacttgatagcagtagtcaatcactaataacgcttgctaatttcctcttactttctaagaaaacccctatatttagcatctgcttccatatcgcacgtggtggttaggggacagcataagtacactagcggctttagcactaaactcgaggcctgggtcacttctcccttgaagaaaaaaggttttaaaaattcctaaatcacaatgtagaactaagttccaccctacctcagaactgcagacattaaaataccatctctttattaagtgtctctacaataatgatatttgctaagaacaagatgtacattttttggggttctgttttgttttggcaaatattgcccaagttgtcttagtgtgcctcaaacatttactaaaaataaaaaaatttaaatctttgcctacttatttaaaaataaaaaaaatactcaaaacaaatttaagctgaagatatatactgtataaagtgttcatctacccagtactctgaagtcttaagaaaagtcaatgatatgtgtgtgtatatatatatatatatatacacacattagcaatttaagccttttaacatgccaattttttagatgctttattggttttttttcccctttactactacttcctgttttcccctttactactacaatttaagcctttaaaaatggcaattttttagatgcttgagatagtttgggggatccctagctcttatcatggcactctgttgagtttgtgaaatgcatcttcaaagaggttgtcaataatatgcaaatttttgaaaactagtgagattactaattattgatgaataaaaaatgagtacttttaatctgccaagttaaagctctagaattccttttctccagtaataactcgcagcatcactaccaatggaagggacctaaggaataccgtgtacactgatatacacgaagctgctcctcatttttttgtcagattacaaaagctgggctcatgtagttatggcctatggacctctttttaagttattttagcagaagtagatgatggtctacaccttgctcctcttttatattaactgtccctaagccactctgatgactattctaatcaaaatcagtatagctgtgctcactaagcatatcactgcttattattcaaataccttctgttttctatgtagcaaaacaaaaagttttataaatttcagataagctttctgtttttcttcagtgcaaacatcctgaaacagcacaaaatcattcagctagtctgaggataaagtcagtttatgtagtgcttaaagtagaatcccagatattctggaatggaaatagctcatgtgaaacttcagttcatttttgtccttaagggcaaatgatcatcttcagagagtgaagactttttaaaatctgaattcacagataaaatcattttagctttactttataggtactgctgaagttgtagcaggaactactagtccttcactgaggcatgtagccgccttgccgtacagtctgtggtaagtaacttttaggcatgccttcatcagtcgcagcctccatgccaactgtttcaaatctttctacttgtccctcagtacctggaccaaaagcatctgctgcagaaacttcctgaaacattttcatttgcccagatccacaggattgtgaaatatgatctgaaatctgctgtttaagtctaacaaaatcttcctcattgactgatgaaacttgctttgacctttcaaaatgtgaaatatctggactggattcatgctgactgcagttctgtttgaagtactgttgcctgggcaaaataccatcaccgccatctacatgatctactaattgtagatcttctggccgctcctctgaatctaacaagggctgggtagactcggatcttgagaagacttggactgacggaacttggtgtctgtagccactgtgtaccacggtagaatactggacagtgctcgaagtgttttgtgaagattcattttcatcactgctagaaatgcttggcctagaagatgacatgcatgaagaccccccaataccactgctgtgtccttcagtattaattttttcctttttgaacaggtccaatgatttcagatcttctggaaaaggctttttgtcatttgcttctatttccacaacacttacatcagtgaaattgccatctgaatacatttgatcttttgaattaaaattgtgctaaggaagagaaaaaattgtatatggcaagtattagttaaagccacagagctaatgcatctctgaaacttcccagtaactctcagtggtacagaaataacctgtattatgtcactaagtcactgtcaactacccaaaatgcagatactataaaatgagtctaagtagtctaaatcaatattgttggtgttacattttgataagctaatggtctacaagtagtatttaatatttcatgcctagactaggcagcctaggattaactggacagaaaactagaaaacattaaggaaaatcaaacctgaatgacagagattttgtagaatataaaaatacataatacattttaatctgttaatataaaatttaaggactaccggaggataataaatataaatgagttcccctttggggcatatttaaaattcagagtttagagtaggttcccagagatcatttcatcagtgctaaaatgataaactgttgaacttggttttaatactcaacccaaaatgcttgaggtagttaccatcacatagcagtttcagcacctcaagttttcagtttgcaagttcaaccaaacatctgtaatgtgtactaaacaatttaaaatatcagaacaaatatactatgatggtgataaaacccctaaaatatgtcatacatattaaattttgattaaaattttcagttatgtactgttttatcttcatttactttttgattcagcttgaatatcttatcttttggtacatttgtagatactcaatatacctactaactgtagatactcaatatacctactaacatgtctgtatattataaacaactcagaagcattttctcttacccttggaggagtgtgaggtgaccactgggcaatatgactctttgaaggatctggaacattaggccagatgtgttttttaattctgaagagaaaagaaaaatggcctatgtaaaaccacacataataaacaataaatagtccctatttctaaacatgttcatcaaagactcttacaaaccaaaccaattacctaaatgaacaaaaaatacctactctaccccaaacaaaaattatttttcttataaccaatagaaaaatactgttgaaaatgcataaggattataatgtattcataatgaattaacaaagctaaatctaatcagtgttcaaatttttttttaaactctcaaaattctgcaattaaaaccacttaaaatctttacccaggccacatgttgtggtattccaattaaaagaatccagataacaaattaatgttcccactgataccaaaaaagttcaaatataaaaatcaaatttaaaaaagtgactgagaatggtgcttcaaagagtgagagcctaccagactgactctcctgtaggaaatacctataacatttggaagtaatataaaaagtagtaaagctgacaacctagacaaaccaatgaatgaatccttgaaagacacaaattaccaaaacagattgaagaaaaagaaagctatatttataaagaaattgaatttttaattaaaaaccttcccacaaaactctgggcaaaaggaaacaattgtattaatactatacaaactctttcagaaaacagaggaggtaacatgttcccattcattttatgaggccagtattatcctgattttaaaaccagacagataaggcacataaagacagactaacttcactcatgaacacagatgcaaacagtattaaactgaatgcagcaaaatccaaggaatgcaaagatgttatatgaaaaatcaataaaatgcaccatattcatggaaggaaggagaaaaaccatatgatcatctcaatagattcagaaaaagcatttgaccaaattgtgacacccattcatgataaaaattgctagcaaggcaaaacagaaataagaacttcccccctgcaagtagtagtaaaggggaaaaaaaaacacaaagcggctgggcgcggtggctcacacctgtaatcccaacactttgggaggctgaggtgggtggattacctgaggtcaggagttcaagaccagcctggccaacatggtgaaacccccatctctactaaactaaaaatacaaaaaaattagccaggcatggtggtgcatgcctgtaatcccagctactcgggtggctgaggcaggagaattgcttgaacccagaaggtgggggttgcagtgagccaagattgtgccactgcactccagcctgggcaacaagagtagaactcagtctcaaaacaaaaaaaccccacaaagcaaaaacttcaacctacagctaacatcacatgtgatggtgaaagactaaatactttcacctctaaaattaggaacaaagcaatgctcttatatggtctagatgtactatatgtactagaggtcttagccagtgcattaagacaataaaaagaactaaaagcataaagattagaacaactataattactcccaagaagcatgattgtgtatctagaaaatcctaaggatccaaaaagctactaataaatgaatttatcaaagtctcagtatacatgatgaatatattttaaaaaatcaattgcatttctatatactaagaattagaaaatatttttaaacatttcatttataataacaaaaaatacttttgtcatgaattcaaaaaaagttatgcaaggcctgtctactgaaaactacaaaacactgcaaaagtaaattaaacaaaacccaaataaataaagaaataaaccaggttcacggattgaaagactcagtagcgttaagactgcagttctctctcggccttagcgccatttttttggaaacctcggcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcaaaaacaaaatgcccatgttggtcctctgccctggacctgtgacattctggactatttctgtgtttatttgtggccgagtgtaacaaccatataataaatcacctcttccgctgttttagctgaggaattaaatcaaaaaaaaaaaaaaaaaaagactgcagttctctcctatagattcaattaaatctgacctatagattcaataaaatcccaatcaaaactatagttttaaaaaagttgacaagctgaattaaaatgtatatgaaaaggcaaagaacctagccaaaataacttctttaaaaaaagaacacactggaagaattctacctattttcaaaatttactatagagctatactcatcaaggcaatgtggtattggcataagaacggacatatatacatttatgaaacagaagtgagagtatggaaatagatacagacttataaagacaattgcttttggcaaaggtaccaaagcaattcaatggggaaaagacactcttttcaaaataaatgacaatggaattagacatctgaaggaacaaaatgaaccttgaccctgacctcacaccatgcacaaaaataacctgaaatggatcatagactaagagctgaaactattgaacttatggaagaaaacatgagaaaatattttgatactgtgtttggcaggacacaaaactcaggaaccacagaaaaaaaactgataaaatgaacttcatcaaaataaaaaacttatgcttttttttttttttttttttttttttttcagacactctgtcacccaggttggagtgcagtgatgtgatcttggctcactgcaacccatgcctcctgggttcaagcaattctcctgcctcagcctcccgagtagctgggattactgacgtgtgccaccatgcccggctaagtttttgtatttttagtagagatgttagccactgtgttagccaggatggcctcaatctcctgaccttgtgagccgcccgccttgacctcccaaagtggtgggattacaggcgtaaaacttctgcttttctaaagccacagttaagacaaaaaaacaaagcacagactgggacaaaagtttgcaaaacgtatttaacaatgttgtaaccagaacatataaagcactcttatagctcaattataaacaaaataacccaatttgaaaatgggtaaaagatttcaatagacacatcacaaaagaaaatatgtaagtgacacatgaaaagatccattactagtcatcggagaaatgaaaattaaaacgatatagtactacacacccactagaatgaaagaagtctgacagcactaagtgttggtgataatatggaacactgctggaggcaatccaagatggtgtagccactctgaaaaagtttggcagtttcttataaagttgaacatatacttaccatatgacccagcactctcactcctattatttgttcaagataaaggaaaacatatgctcgcacagttttgtatgtgaatattcatagcaacattatttataatagctaaaaattagaaacaacctaaacttccataacagatcagtctaagttttgatatatccatactacagaatactgttcagcaataaaaaggaaaaaggtaggccaggtgtggtgactcatgcctgtaatcccagcacttttgggaagccaaggtgggtggatcacttgaggtccggagttcgagaccagcctggccaacatgatgaaactccgtctcaactgtaaatacaaaaattagctgggcatggtggcaagtgcctgtaatcccagttactcaagaggctgaggcaggagaatcacctgaactcaggaggtagaggttgcagtgagccaagatcatgccactgtactccagtaagggaacagagtgagactccatctcaaaaaaaaaaaaagggagaagtatatgcaacatcatggatgaatctcaaaaatattatgtaaaagacatacgcaaaagactacacgctatgtgattctatttatataaaattcttggccgtggctcacacctgtaatcccagcactttgggaggctgagggtggatcccctgaggtcaggagttcgagaccagcctggccaacatggtgataccccatctctactaaaaatacaaaaaattagctgggtgtggtggtgggcgcctgtaatcctagctactttgaaggctgaggcaggagtctgaaccagggaggcagaggttgtagtgaactgagatcgcaccactgcactccatcctgggcaacaagagtgaaactctgtctcaaaatagatagataaataaaaattctagaaaaggcaaaactacagttacagaaaagcagatcaatgactgcctggggttgggctgagaagaagacagattacaaaggagaacaaggaagctttataaaagtgatgaaaatgttctatattgtgattatggtggtagttatacatctgtatgtaattacaaaaattcatcaaactgtacacttaaaatggataaattttattgcatgtaaattcagctcaataaagctgggggaaaatgcaaaaatatgaataaagttacttacaggtctcgcttattaaagcagaacagcactcccagaagagttgtcaataggaatgctaagcaaacaggcacgactatggcttcaatttctccttgagcttaaaaaaaaaaaaaaaaaaaaaaaaagaggtgtgatgggaaataatgttgacatatgaactaagaagacataatacaacttcccaaccagacttactgttgaaaagataaaatacaatcctaattatttttcaaggtctcttcagacttgatgatttttaccctcttctctctttggtaaatcacatcccaaccatttatgtcttatacattaacctggccgcatagcataaaatatatgttggttgggggataaaaatgatcagtgtatcgggtaatctactgggttagagctttcaaacataaccatttgtaacatttatgatctgcatttggtagaatcttagtaaaagtttatctctgagttctaatactgtataacagagaaattatgtcagaacaaatataaatactgggtaaaatggaaaagctataaaaacataattgaactacacatttaaccttctaaaaaataaaaatgcaactctcagaagttttaagagttatttaccatttttcaaaaggaggatatagctggtacagggctaagaactttaggagctgctcaatgggcatgaggagtggcacgagtaggaataaactaaaaagtaaacaagcctaagatccctaaataccacacaaatcctcatctgcatttaaaagaggacttgttcatcaaattaatcactaattgggataattaacattggagattttttaaatgactgtcctgattaattttgaattttacttagtcttttacagtaaaaaatgtatgaaagtaatattgcagccatatactattcacttaattttatccttccaccacacatatccctttgtaagtaactaacatcctatgaagctcagtagaaatcaagaaatcagttaaatgcttgagaataaactatgggttggcaaatattaactcttaaatgctaagcatcatatatatatatatatgggtgtatgtatatatatttatgtgtgtatatattgatatatgtgtgtatatatatattgatatgggtatgtatgtgtgtatatatatataaaatgccaaatctaatttaggcagaaactttgctttattaaacatctgcttttatgttttcaagcctgtgcctttgctcatgctgctctctaagatgccaccttcttcctatttgtccacatactaactcaaggctcaagtattttcttcttcataaaacctttgaaggtaaaattatccactactggtatatttaaattcctactctatttactgtctacatagtccacaggttctcctttttctgatttacttatgcaaaatttcttcaactaagctgtaaggtcctcgttggcaagactcaagccatgtgaagaagccataatggatccatgagactacagatagagaattgaaaaaaggtaggttataaaataatactaagtataatttaattttaggaaaaaaatatatacaaagaagacactaaaaggatacacaaatatgttattttggggtaagggactaggactaatttttcttcctctctacattttactgtacagtctaaattccctataatgaacacctatgtaataaaaaaattttaggctgagcatggtggctcatacctgtaatccggcactctgggaggctaaggcaggaggactgaggccaggagttcaaaaccagcctgggcaacacagcgagatcccatctctaccaaaaaaattgttttaactagccaggcatggtggtgcctaccagcagtcttagttacttgggaggctgaggcaggaggattgcttgagcccaggaatttgaggttgcagtgagctatgactgcaccactgcactccagcctgggagacagagcaagactctgtctcaaaaacaaacaaacaaaaaatatacatatgggcttttatgtgtgtgtgtacacacacacatacatatatacaaagctctgtagagatggctggtctccacagaaatacataaaatatacatttttaagtttattttttaatttttctcaagattatggtataaagttttattttaaataacatacctattaacataccaccacatgggaccaaccttatcccagaaactatattcattactgaccctaacagcaaagctcaggaacttttatcatttattttatgtagtcactcattcatttattccctcattcagcaagcattcaaccaacaaggcacatggaatttactacttatcattaactaggctggcacttgggggtgggggttacaattatggtaaaataaggtaattttctataatgattcaaaatgtagggggagcaagaaagaatgttggttaagtttgctttagggaagatacagaagagccagatgatgaggtgaagacctcactgggggcaatgcactaagaaaagagaagttagcatgaggagcttgcagttgaagaaaatgatgatgaaagggtacgcacaatcaacaggacttgacactcagcttatgtgagagaaaaatatacaaatacatttattgtaatcacatttaaatttatggctttggcatagaacgagggagggaaaatgtatttgggaaggaaagagaagatggctaaagccatggacagagtttgaataggcaagtaagaaaacagggtcaagaggccgggtgcggtggctcatgcctgtaatcccagcactttgggaggccgaggcaggtggatcacctgaggtcaggaggtcgagaccatcccagccaacatggtgaaaccccgtctctacaaaaatacaaaaaattagccaggcatggtagtgggcacctctaccccagctacgtgggaggctgaggtaggagaatcacttgaacctgggaggtggaggttgcagtgagctgagatcgcaccactgcactccagcctgggtgacagagcgagactctgtctcaaaaaaaaaaaaaaaaaaaaaaaaagcaaaaaaaggagaagaagaagaaaacaccaaagaacaaggagactcaggagactgtgctagcagaaaaagtatggttagaaaacccaagggaggagggagtttcaaggatggaaggccaacagagtcaaatgcagaaaaggctggaggcagtggcttatgtctataatcccagcactttaggaggccaaggcagaaggatcacttgagcccaggagtttgagaccagccatctctataaaaaaaattagctggatgtggtggcactggtcccagctacttgagaaactgaggtaggaggatcacttgagcccaggaggtcaaggctgcagtgtgccatgttcatgccattgcactccactgtagcctgggcaacagagtaagaccctgcctccaaaaaaaaaaagtagaaaaaagatgaaaactaaaaagcatgcagtacatatgatgatcaagaggtcttctgagtgacaccagagaggtttcagtgcaggggtggggtaggacccctaatttcagtatgttaaatactgagtgggaggtacggaagtgaagactgtaaagtggactagtccttcaagtaatctctcaataaaagaaagaaatgaggatagagaaggaaagaacacacccaaaccagtgaaaaaaatgaacccacatggaaagatacacaaattcttttaggatttttagtacagctgaatatagtcagaagcagttaataaaataccaaaaaggtgaggaataacactttctataaagaaaccaccaaccaaagccagataatataaaaatcatcatgaatccaaagatgtactttttaacacaattttagcacataaactaagttcatttctaacctaagtttgagaaagaaaaaaaaccaaacttcattatttcttaccaaactttggggtagtaaaagtgaattctggaccatccttcccaccttcatctgtgtatgctgccattcgtaccatgtacaatgtgtcactagtcaaagaggacaatgtatattctgtgtgggaagaatccacattcacagctggaagaaataagaactgtgcttcattcaactattcaatgcttttgcttatttggcctatatttggcattgtgaaagtgttaaaaaagaagcgaagtatttttgttggaaaacaacttttataatgttctgacataattttatgttctaaagcacaacacaatactttttcaataaatccatgaaagtaaccataaggcaaattctcaggtgtctcctgaggccaatatactataagatgtataagaagaacagacttaaattagtacttaaaagcttaaggaaaaaataactgattcttaataactgatacagttttattaccagtttcatttccaatgatggttctataaaatatagtataatttctgataaatccattctgaacatcaacaggaagttggtcccactctaagacagcttcgtttttccctactttttttgtccgaacagtaggtcctttggaaggtgctgtaacagagtgaacacatttgctaactgaaaatcatttacaatctagtaaaatttccttgtcataaaatcatttgaacataatgagatacatctttatttaaaagcgataaaatgtttctgttaatacaaagccctaaactttttttttcaaagaagtgagtttggacttacgagcttgtttaaggtatgcctttatggattcagggcttcctggtccatcagcatatactggagtaactgttatcaaatagcatttgctctctgctaagttccctaaagcaagaatagcagattaagcatgtttttccataatgaaaaagtcaagttaataccgtaatttatttttacattataatttcatgaccacttaattttcttttaaaactgcagttttctaagtaagcattgtcttttgtgtactggattcaagcttaatcaggtaaaactgtctgtaaaagtattgccaatgcagtggataaaaaatacattgttaagaacaatgatggtatttacatttagaatttataaaacaatgatctcaaattactctggattttatagagtctgacaatttttgtatgtcttacctacaagagagaacagcctaaggagcaagacgactaaagcagtaagacctaggggaaagcactaacggtcctagtttgcgagttggaaaaaagggtatcttaaaaaatttcctcggccaggcgctgtggctcacgtctgtaatcccagcactttgggaggttaaggtgggaggatcacttgaggttaggagtttgagaccagcatggccaacatggtgaaacccccctttactgaaaatacaaaaattagctgggcatggtggtgggcacctgtagtcccagatgcttgggaggctgtggcaggagaatcacttgaacccaggaggcggagcttgcagtgagccgagatcgcaccactgcactccagcctgggcgacagagtgagactctgtctcaaaaaaacaaaaaccaaaacaaacttcctttatttttatcttttttagcatgcaccactaaaatttttcttatttatacagtatattatctgtacatattagaaaatgttttattgaaatttataccttcaataagaatgtatattccttaactattactcatgaagttacatgctcctttaccttcttaaacagattttaccttttcttaatgattcaatattaccaaaaaatgaacaatttttatattctactctaatgtgatgctttcagggttactgagcaacatacgactacctacccaaacttaatgtctccacaacttatgctagcttctattttttttgagatggagtttcgttcttgttgttcaggctggagtgcaatggcatgatcttggctcactgcaacctccgcctcccgggttcaagagattctccagcctcagcctcccaaatggctgggattacaggcatgtgccaccacgcctagctgattttgttttagtagagacggagtttatccacattggtcaggctggtctcgaactcccgacctcaggtgatttgcccgcctcagcctcccaaagtgctggaattacaggcgtgagccaccgcatcggctgctgctttaaaaagtttctattggctctgagcagtggttcacgcctgtaataccagcactttgggagtttgaggtaaaagaatcgcttgaggccaggtgttggagatcagcctttgcaacacagtgagattccctctctacaaaaaaataaaattagctgagtgtggcagcatgtgcctgtagtcccagatactccagaggatgaggcagaagggtcacttcagcctgggagttgaaggctgcagtcagccatgatcatgccaccatactctagcctaggcaacagagtgagaccctgtatttatttttttttaagaagtttctatagttatttccagcctgtttcaggacttcctaagctccaccatgtttttaatttgataaagtcagtaaactagataaccaagcttattaaaactgtacactaataacatgtaagtccaaacagcctgtattatgactaaagctcaaaaactttatggcaggaatctctctgcttagggcttttctctaattaaccatattattcacagctgaattctaattattaattatcaacaaaagactataaactgagtttttttctcttcaaagttgttgtatcactttataaccacttaagcagcaccataacacacagactggagcgctacgattcattacttctgtcctttgttactacttccaattgaaagacataaggaaatctgagttctagttctgcttcctctatctgatggttctaagacattacacaagtcatccagatgctctaggaaactattttctcatgtgaaggatgaggtacagagaacatataactaatcagcagcaaaggttggactcttatatttctctatactctatagttttaggagttttcccttgacgataaaatcatattggggtacaaaaagaagaaagtattaaccccactctgttcataaagagactgtaattcagagaggttaagtatgacttgctgaaagtcacacatctagtaagtagtgaggctatgataaattggaagtcgtttcaacggaccaaaacactataagcaaaagaaaaagctgcctaaagagttagaaaaaggatatcaatttagatgtttctagccaggtatacctcttaaataggtgcgatgcacggtaccatcttcttgttgccagtctgtgatacagggtgctttatctgataacacacaccactcaagtatatatttctttacagattcccttggagtagtccattccacccaaagcatgttatctttggggaatgctttaagatccattacagggtgagtagctttaaaacaaagtttgaatattgaaataataaatattaacaaatttgaaatttccatattttacagtcatttccaaaacatgtgatttatcaatttttgtagcatatacttccttgcctaaaagcactttattataacttacaggtaaagtagtcaatttttaaacttagattttgcttccccgctgggcactgtggctcattcctgtaattccaacattttacgaggccaaggcaggtggatcacttgacatcaggagttcgaaaccagcctggccaacacggtgaaaccccgtctctactaaaaatacaaaattagccaggcattgtggtgcgtgcctttaattccagctacttgggaggctggtgcacaagaatcgcttgaagccaggaggcagaggctgagatcgtgccattgcactccagcctaggcgacagagcaagactgtctcaaaaagaaaaaaaaaaatttgctttccctaaattcttcaaatgctttcggtttgtaattgcaatttttcttctttgaaagctacgaataaagctacagataaacgtttcagtcatatgtatacaaagttctcaaaatcttgaaataatattttaaaaaccaggtaagtaatcagaatatgcttaaatgaatgaagtagcttactgtgaagtttaagtgagcatgtagtgatggaaatgttcttgcatcctgatgaaatttgtctgctgactgattcctaaaaatgcgatcactagctgggtttggtggcatatgcctgttaatcccagcactttgggaggccaggggagatcgcttgagctcaggagttcgagaccagcctgagcaacctggcgagacccagtctctgaaaaaaagaaaatcattatttataaaatttaaaaaattaaaaaataaacaagtgattatccctgatactgaggagacagtcttagataacttgtgttttttatgggagccctgtccatacctaaccaccatttttccacccaagagtcaggctccatctcacagatacaaaccttgaaagtcacaggcagggatagttaaaacagctgcatctgatttgccaacaagatttcttactgttagggttgctagatagcgatcatttgtgagatttactgtcagttttgtggcattaactgtgtaattttgtaaatgtgatttccatcttgtgagagtcacttcataatccaagatttttccattggcttcaaaaggaggcaatgtctgtaataaaatagtttatttttaaaaataatctcataaatcttgaataaaaaatcagtttttcttcatattcacaaatcatgccattatgtcaaatctctaaatatttaactggaaaggattcacaatctccattttaaatttggttctaaaataaaactagtacatactaaatgaagagtaaaagcatgacctcaactaaaaaagggtaagtagcatcattccgttagcttttggttctgtatcaattctgcactgtggctatgtaggtctaaattatttattttatgcttgagtatttttctaccttcttttttagtatgatctactcatgcacttaccagcatacattttgattatcacaaacttttattattttctgagttactctggaaaattccaaagtacaaaaacaacattcctcttcttatagaacttatactttcacagaactgtacttaaatacctataaggtattatttgtagtttatgaacctgacttctatataatattaatacatataaagcattacctttctatttagtaaaaatagtaatcaaatgctttgctattaaaatgaataaaaatttatctatttaaaagacctccattcataataccatacaaaatgtatttataagggctgggcgcggtggctcatgcctgtaatcccagtactttgggaggccgaggcaggcagaacatgaggtcaagagatcaagatcatcctggccaccgtggtgaaaccctgtctctgctaaaaatacaaaaattagcggggcgtggtggcgcacacctgtagtcccagctactcaggaggctgaggcaggagaatcacttgaacctgggaggcagaggttgcagtgagccaagatcacgccactacactcctgcctggcaatggagcgagactcggtttcaaaaaaaaaaaaaaagatttataagagataaaatataaatgtgattttttaccttccacacgagttgtacagttctgtagccttgagtatgggatggatctattttataccagaaacttggtgctttagatggtcctaaagaaaagacataaactccttaaaataaaaaggttttaacagtaaaataaaattctgcaaattattcttttactttgttcttaatactcttgccctccaattgcatggtgtctctacctctttataccagcattttcccaacccagcacaaaacacctggctcttcctttagtcagggtgatagcctgatcaattatactggaactcttttctaacctcaaaattgtaaaggtaaaaatgtattctgagcaacaactaaagaggcatcactctttcttataacttcatgttctttattctgtttgtgtgctggcactgtatttatctacttgaatctcctgtaccagcagccttttcccagccttcctggtctgcctgtcctcacttctgttttgtcatctgtaattgcctcttcatgatcaacacatcactgcttagattttattcaactcctctcttattctattaaataccaggtcttctaattatatttataaaaattttgaaaaattagttaatatgattttttaaagaaaaaaactttttaaaataaagtttttaacagtaaaaaataaaaatgaaataaacataagttgatactacttatcgctgaaaatcaaactggaaaatctatttaaacacattgcttactcctaaatattcacaagaataataaaacaaattaagataaatgtactaaaataagtttattactttatataaggatgattgagagtgatgggatgtaataaaaacaaattcacagtattgttgtgataatcactaaccatctgaaaaagcaatccataaaacatagtggtttttttccagagacagtgtctcgctctgttgcccaggctggagtgcagtggatgactatagtgcactataaccttcagctcctaggctcaggtgatcctcccacctcagcaacccaagtagctggggtttggccaccatacccagccaaaacataaattgttaaataccagtaattaaattcggttttaaaaatacctgtagtattaatttttcaaaacttataatagccattaaatgtagcatataatttttaattttttagcaataagtaatatcaactgacatttcatttttacttatcattgttaagctttttgtaaaaagtttgtcttaaaaaaatcaatggcattaactgatttctcaaaatttttatgaatataataacaagatatggtagtcagtagaataagacaggagttgaataaaatctaagcagtaaggctgggtgtggtggctcgtgcctgcgatcccagcactttgggaggccgagggatgtggttcacttcagttcagtagttcaagaccagcctgggcaccatgacaaaaccttgtctccacaaaaaaatacaaaaatttgctgggcatggtgacacgtgcctatagtcccagctatgttgggggctgaggcatgaggatcgcttcagccttggaggtagaggctgcagcgagccgtgttcatgccactgcactccagcctgggcaatagagtgaggcactatttccaaaaaaaaaaaaaaaaaaatttaagtactgatatgttaatcatgaagaggcaattacagacagcaaaacagaaaggataggacaggcagaccaggaaggctgggaaaaaggctgctggtacagaagttaaaatagataaattcacatgagtacagtgcagcactcaaacagaataaagaacatgaaattattaaaaaaaaattatgagctggaaatatttcctaacataaagggaacccagagacttcattcacgcattgatttgacaaagattatgtacacttgtccattaaaaatgcacacaggcactaaccacaatattttacctacattttaaactatttcatgaactcctccccatgtatctcattttaagaattcctggtcaagacaaagcaatctggctgaggactcccacagcagcaatagcaaaattgatttctttctcagcatttatgagagaaatcttagggcagaagggtacttttctgcctttgatgttctcaagtcacatgacctaaacctctagaagagctggaagtaaagggatataggtggtaggggattttttcagccacagctactgccattgataactaagagatgagtctgtgataggaaggtctcaaaatgaaaaatctatgccacgggattatttcttgaacttagtaacatcagatgctttgcagtgaggatcttactttagactgtacactctttttgtgccttttttattctatatcatatatattatctataggagaaaaaaggaaaataaaaactaaccaaccaaaattccaggatcaaccgcttcccaggggcttatcaagtgctattagaaaaaaaatgaataaaaggtataatacaagtatatttttgatagtggggatctaaggtgtagtttgctagacagtgtggttttaatgattcaggatatgattctctagttaggagtatctctggacaagtctccttgaataaaatgttctagacttatcaacagttaacggttttctgatagatgtatctaagtcaccattccatgatgaattttttttttttttgagacggagtctcgttctgtcacccaggctgaagtgcagtggcgtgaccttggctcactgcaacctccacctcctgggttcaagcgattctcctgcctcagcctcccgagtagctgggactacaggcgcccaccaccacgcccggctaatttttgtatttttaatagagaaggggtttcaccatattggccaggctggtctcaaactcctgaccttgtgatccgcccacctcggcctcccaaagtactgggattacaggtgtgagccaccgcatctggcctccatgataatttaattaggtatcaaatagacttatactatcaatgatccatattcaattttacatcttaatgtccttaaaaattaaaacgttaaaatactgcagtttgaataaaatgatcacaaactaagaagcaatgaggctatattattaaaaccagaaccagttcacatctggaattccaatagctttacttcttcatatacttatgtacttactatcttcataggtgatcccacttgcttcttcactccagtcactccagtatcccttaccatcttccttcatacagcgaatcctaaacacatattctgtaaaaggtttaaggtcttggacagtgaatgaagatcgggtggatgctgtgtcttcaggaggaatctgaaacaaagcaaaccaaacaacagaaaacctcaattagtaaggtcttctaaattgtgttaaaattcagaaacttttttttttgaggcacagccttgctctgttgcccaggttggagtgcagtggtgcgatcttggctcaacacaacctctacctctcccaggttcaagcgattctcctgcctcagcctcctgagtggctgggattacaggtgcccgccaccactctcagctaatttctgtacttttttagtatcaacaagattcaccatgttggccgggctggtctgtaactcctgacctcaagcaatccacttgcctcggcctcccaaagtgccaggattacagatgtgagccactgcgctcagcctagaaactatttatttttgagacagagtctccctctgtcgcccaggctggagctcaatggtgcaatggcgcgatctcagctcactgcaacctccgcctcccaggttcaagtgattctattgcctcagcctcttgaaactattttattgacacaagactaatacattaaactcaacctctggagagaaataagtgtaagttaaaaagcagtccaaatcagtaaagttatttggttttagaagtatggaaacatctattatctttccttttttccctttatttcttccacagggcctgtaatataacttaggatttctgcaggaaacagatggcacactccatttagaataattcaaggagggcttcataaagggactacatgcagagtatatggaatccttagacagtgcagttagtactctggggcttagagctgtttctacctctaggcccaaagggatgaggggaagtaccagaacctgaaagaagccggtcagctagagagggctgtcttgacaggtagtgaccctaagttgaaagacagccggctgggtgcggtggctcacgcttgtaatcccagcactttgggagactgaagtaggtggatcacctgaggtctggagttcgagaccaacctggccaacatggtgaaaccccatctctactaaaaacacaaaaattagctgggcatggtggcacacacctgtaatcccagctactcgggagtctgaggcagaagaatcgcttgaactagggaggtggaagttgcagtaagccaagatcatgccattacactccagcctgggcaacaagagctaaactccatctcaaaaaaaaaaaaaaagacagccagttcctggaaggaagcagggaaaatcaacatgccaatttcacttttcttctgtcttctctcctgcctagtcccttccttccattaaccacagtcacaaggaagctagaaagaatggaaacccacagatgaaatctatacaggtcagcatgacacaacaaagagaagggtagagcgtagatgtggacaggcaaaaggaagatatccagcccaatcaagaaaaacaaaagttttcctggcttttaaacttggctttcagaaaaaaagaggagattaaatacagataaataactggtcatattactctgataatttagtattagatacaaaataaacatcagtcttttttgtagcactgaattaagattctatacttaataccacattttgaagaacttcaggtatgtatattctctgtacaacatgaagcattaatccaattttgttttattgctttttctgattgtattctgagcactttagataagtggggtaaggagagaagtagtaaagtcattagcccaattccctaacaagctcactgtgaccagagcaacaaaagcaaagacatactgtttgtgataaatggaatcaaaacagagaagagtatggatagctgaatgctatggtgatagcctttttaaaagctccaagtatttcttttgctggtagcatcatctttgggtatactatcattttcagtcttacaagctccctatcaatcccttcctctacctcagtggttggcaaactttctataaaaaggtagataaaatatttactaatattttaggcttgtgggccagagactctttttgcaactactcaactcttccactgtagaatagagacaatatgtaaagaaatgagtgtggctgtgttccagtaaaactttatttacaaaaacaagtcacaggctgattttggtggactgcagcacaccaatccctacactagctaccttatccttataatctctttatttttgctcctctacttaatttgctttattacttgtattctttgtaacacccatcaaaaatgccatttctaggctggtagtggtagctcacatctgtaatcccagcattttgggaggccaaggtaggagaatcgcttaaggccaggagtttgagaccatcctgggcaacacggcgagactccatctccacaaaaaataataataattttaaaaagccaggtgtggtggtgcacacctgtagtgagactaaggcaggaggatcacttaagctcgagttcaaaattgcagtgagccagcggcctgggcaaatggagaccctgtctctagaagaaaaaaaaaaaaaagccatttcctatcaccctatatcattttcatgttttacttaaaggctactgtatttagcaaagctgtattttctatctggatatcttcctgattccccttgtttgaaataacaacccagaagaggttatcaagcaaaatatttcacataaccagaaacttaaagacatttagaaaatgactgaaactttttaagattagagggttgaaagaaggactatttgaataaacggtaactttcaatttacctggctccaagttgaggcatctttggtcctatattgaatgttatattttagtattataacactcttaatacttgggttggtccatgtcaattttaagatactagacagttcctctgagttgatcactgataaattatgtggcggattgggcttcactgaaaaataaaataaatcctaaggtttattatgttttccaatttcatatacaaactcaaatatactctttatattgtccttcctttattttacaataatttatccttaccaaatgaactaatttctctgaaaattatgctatgctatataccttataatggaaaaaaaaagatttctaaagaatcttcagttctccttgttaatttacatttgttaatctcttcaggttcatatgtcaaaagacaaatatttatgatatcaaatttttaaaaaagaataaaaatggaacatacatactgtaattacaatggtgtaagatgtttgagaacagaaaacattcaaagtgaaaacagctgttaagtgtggttggattatggatatttttctttttccaaattctatttgatattattgataaaatgacttcataaaaatcactaagataaatgcttgtttctacattaattaaaatctaaaatctacattaattaaaatctaaaaaagtaaaatctaaaaactacattaattaaaatctaaaaatctacattaaaatcttaaaaaatctaaatataaaaactactttaatttgtaaacgactacagtgtcaaataaactctcaaattcaggtttataactacctttatatacaggatcaaaattgatatgatctgatgtaaccttcccaagggcattctctgcttctacccagacttcaatgttgacaaaatacacagtagaataatcaacagtgcatgaggtgggggtgtcacgttttgctttgcaatcagcaaacttgtgtgttgccctaaatacaaaaaattgaagaatcagtcattaaaaacacatctgaaaaaattagagtgaaaaaaattacttgcaaagagtttgatgagacctagattgttgtagcaaactttgcaatataactgctggtcactaacaaaatttcttaaaaataaacctttctttaaaattaactttgatctatatcttaaaacataaaattattttcaaatttgtagtctaaaaatattgtgctttaaaattttatgctccatccccacttactcctctccaaaaattatctatttccttgtgatcccagtgctgttttttctttttcctaaaacagaacccttactgtaccacaaatttctttaagcacaatatgctagaaggtgacaggaggttaggggtaagaatttctattaccccttagcctttagtcttagggctaaaatctcttagcctctttctagtcaaacttaggcaactactttctgatttctatcaccatggaaagtttcaagtaatattactatatttatttacaattatataaattatgcctcaattaaaaatattcatatacaacactgtttttaaaaataggataaaccaaaccccaaattgaaccaaaacaaaaatggttagcctctaaggagaaggaaataaggtagaggattcaggaatagaatatagacttttctgaacaagccttaatactattaatagatttgactttttggattgttttatataattattaagaaaaattcctaaaaattaaaagcaaaatgaaacatatgaacttgtgtactgagtatgtagtataaccacatagaaaagaactattccaagtaacattaaaacacagtaatctgactattacacatccttcacagagaaaaacaatcttaaaatcattcttggtaatcattttgttggtgctaatactgttgttattattctgcagctgctgtattaaccgtaggataaagcaaatgaataattatgttagtgttgttgtcaactatgtttttcagttcataagaaagaagatgtagacgtcaggtaaatataattatgtaaaaacctatagccctaattttaaactgaaaatatcagtatgaatttgtatttttaaaagatagtattatatctcaaaccacaaaacatgtcctagctctttcgactgaaaaaatctaaaaaatctaaaaactatgacaaaccagtagtgatgaattcctgtagcacccagattgtagtctgtaaatattatttcacactaaatgaaaccagagagttttgggaaaaggttgattccaggtctgggtgaggaaatacatgatgaccctgtaaaagcatgttatatcagagagctatcaaaggctaaggaagttgtgtcaagacgatgaatgagccgggcggggtggtgggtgcctataatcccagccactcgggaggcagtgagccgagatcacgccacttcactacagcctggtcaaaagagcaaaactctgtctcaaaaaaaaaaaaaaaaaaggatgaatgagccaatttgagtaaactgccactgatcaaagatgggacaatccataatgagttaaaacatatcaaatatgtttaaatataaatttataatgagaaagaaaagccctcattattctacctttggaggatactagggaatcaactaattataaaactggtaattaaggaaaaatattaaacctatcttgcttctcctatctgaactgtacttcagggtaaaccacagttgataaaggcaagtttttctttaagtatttcagctaaaacaaaacacagaataccatagttttgtaatttatatacaaattataatcactgatgactgctcaaagctgtaagggaaatactagtgggaaaacaacatgattaaatttcggaaacattctgttgagttataaaacttttcacagaagagtatatactatataatcccatttatatgagacattctgtaacaggaaaaaataatctatggtgaagaatatcagacaggtagttgctcatggggtggggcacttgctgggattgactgaaggagcaggaaggaactttttaggtgtgttagtcatgttctatgtcttgatactgattgagttacacaggtgtctgtacttgtcaaaactcactgaatgatacactaagatttgtgttttcactatatgtaaattttatttaaaaacataatactgaactctagttcatgtaaatactgaagtgattaagaatgaggtatattaatgactgtaactcactatgaaatactgaagtgattaagggtgaggtatattaatgactgcaactcactatgaaatacataaaaaagagatagattgagagatggagagaaggatgcatagataaataggtgataaagcaaagatagtaaaatgttaattgtagaatctagggtatgcaagagtgttcactgtaaaactctttcaacttttctgtttggaaaaaacaaatgggaaacttagtaaataaaggaataaggctgacaacacccgaaaccactgctcaatcttagtatcagaaaaaagaaaaacagtgaaacattatctggtctttcctgacagaagtacacatcactcctacaaaatatttttttggggaaaaaaaaaaaatcaaacccaaatctgatgaaatctgtagatctaaaagcaattttttggaaagaaaaagacaagggggccaggcgcggtggccacgtctatcatctaagcactctgggaggcagaggcagccagatcacgaggtcaggagttcaagaccagcctgaccaacatggtgaaaccctctctattaaaaatagaaaaaaattagctgggcatggtggcacatgcctgtaatcccagctactcaggaggctgaggcaggagaattgcttgaacctgggaagcggaggttgcagtgagcagagatcatgccactgtactccagcctaggtgacagagcaagactccatctcaaaaaaaaaaaaaaaaaaaaaaaaaaaaaaaaaaagacaagggaatatgttaaacaatgtacaatgtataacagtttaacaactgaaatgtaagaaaaaagaacaaatagaacctataatttaagagacaagacataaattcacaaagtatggagcttattcgaatcttgactgaaacaaatgtaaaaaaaattatacatataggcatattcatgagacataggggaaatcaacactaactgaaaatgtaatattttatatctgagtgtaacagtggtatgttgttatgcttttttttaaaatgtcctcatcttttagagacgcatactgaaatatctttggatgaaatatgatgcccgcgattctctcttcaagacaatataggcaaagagtacctttgaaataagactggtcatgagctgaccagtgttgaagctgagtgatgggtatgtatgggtattctactattctttctacttttattttttatttatttattttttttgagatggagtctcactctgttacccaggctggagtgtagtggtgcaatccgggctcactgcaacctccgcctcctggatttaagtgattctcctgcctcaacctccgagtcactgggattacaggcacccgccaccatgcctggctaatttttgtagttttggtagagacagggttttgctctggttggccaggctggtctcgaactcctgacctcaagttatctgcccacctcagcctccgtaagtgctggagttacaggcatgggccgccgcgcctgggggattacaggcatgagccaccgcgcctggcctctacttttacatatatttgaaatgttacagaataaaaaattaaatgttttaaaatagcatttaatattattacttggtaaaataaaaattccagcaaaaatgactaactttaataaatctaacatgaaacaaatttaaaataacgtaccattcagattttaaagtgaagtttgtctccaagtgtgtttcccttccaccatcccactcacacctcattttcttcccctcgttcacaatgcaactcaaatttttaggtttttctggaggcactaaaagggattaattagcatctttcagaaagctttatatccacaaatattatgcaatttatatactacccaaggcatttgcgatctaaattagatgaaaaaaatcaaacccaagcaaaaagtatggacacaatgaaaggctgatgacaatttcttttctatcccaactcttacacttcttttcaggaagtaatatatatacatccatcctaactgtcatcaactggtttgtttcacattaattttctatgtaaaatcaactttcatttataactggaaaaaaatatcaactgatttctccattaagtatatttttaaaagtaatatatacatatgtttgtaagaggcaactaagtagaagccaaaatgattcatttatatttctcttcttattgctttcccaaactcgttggaagaaaagcaaatgccaaaacagtaaagtctgggtgatccacaaattagataacccacttttggatcatagtaagtttattttgtttactttgttactccaaggccaggcacagtggctcacgcctgtaatcccagcagtttgggagcccgaggcaagtggatcacctgaggtcaggagtttgagaccagcctggccaacatggcgaaaccccatttctactaaaaatatgaaaaattagccgggcgtggtggctcatgcctgtagtcccagctacttgggaggctgaggcaggaggattgcttgaacccgggagggcagtgagctgagatgatgccactgcactccagcctgggtgacagagcgagactctgtcaccaaaaaaaaaaaaaggatttactccagtatttgttcgctttcttcaggtagctgctttacacgtgcattttctcagcaattaagggatactgagaattaccatcattatgtcaattcaacaatactttcctgtggtggggggggtctcatgtcaaatatttctctagtaaagtgaaactgcttgactttcaggaaagacaggagacttgtggttcctacttctaagcttattttttaaaaaccaaacatgtccaagtcactaagtccacaagttactacattttataaagatgaaaggacaacattaaaaatgcagttcaatagtcatgacaaagtctgaaataagacaaaaacaaaacttacagcctgaaattattgtgattccataaacattctgttcaagctgtccgaatgtaagaatgttgcaagtgagctgaatatttaatgaagctatatctgtaaaggtgacactggatgctgttctgtttatgatagtatattgctccttaggaatagtaaaatggtttgttttccagacaatgtaattagcatttacatgaaaataatccatacatttttcctttagcacacaaactgcagtgaaattagaatgaagttgtacaactggagattcaggactgatataaccacatggatctagaagttcacctaaaaaggaacaatagaaaatatataaatggactgaatttttctggtacaaaatgatatctagctggtagcactcaatgtagagtccctcaaccgtcactaaaatatccctaaagacacagaaaaagacaatacacaactgaaaattaatatggttagaatttaatgcctgaatttgtaaagaaatatacaaattataaagataatagagctgaattaagaaaaacccattcatgctttatagcccatggtataaactatttctttaagaaacacagactgcctgcagcatgattcatacttgccccacaacgtatcctgtccctccatttagatcccaggtctaaactaaactctccagaaaacaggcagtggtggtctcctctacagtcctgaatgctgttgtggagtacagttggggtcacagacagtatacattgtccacacatcaaaactcagacaacaaaggaaacagcaagggaccaatacaaaacaggaagaatagaacaagatggccaaatagtttagttttaagaataaatgcatggccctgggtatgatggtttgcgtctataatctcagcacttttgggaggccgaggcaagaggatcgctcgagctcaggagtttgaaaccagcttgggcaacatagggagatgccatctgtactaaaaacaaaaaaaattagccgagcatggtggtgcacgcctatagtcccagctattcgggaggctgaagtgggatgatggcttgagcccaaggggtcaaggatgtagtaagccactgcactccaccctggacaacagagtgaaaataaatgcatgggataggatcccctatttaaaaacaaagaatcagcctaaccaacatgctaaaacccagtctctactaaaaatacaaaaattagctgggtgtcatggtgggcacctgtaatcccagctgcttgggaggctgaggcatgagaatcacctgaacccaggaagtggaggttgcagtgagatcacgccactgcactccagcttgggagacagagtgagacagagtctcaaaaaacaaaacaaaacaaaacaaacaaaacaaaacacaaagaatcagattgggtaaaagagaattaaacacaactacatgctttacctatcacctactccacattgatgacatctcaatccctatctctagcactaaacccccatgctttcaatagcccattagacatatatctacctgagatatcccatagctatttttaaatgagcatgtccaaaactattatgtatcataatcttttcaaacttattattttttattcttatttctctgcctctgctaacagcaccactcccatccagacatccaggacagatactctgtagtcatcttccaacatctccaattagcctcctctaacctccaacttaacaatagtgcactgtattggttctatatgcttaataagcatatcaacatcttctttccaatgctactttgactgctgaagcacaggatactatatcagtctgacctccttccagtttatcttacatactactgtcagttactgttctaaaataattaggacatttgtctactttaaattatttagtggctacctactaccaagataaaagtcccaactatttgacatgattttattctttttctctagcttcaatgtccacaattttaaggtggctttcctcaatgaatcctatttgctgtggggttcctgggtagttacccatgaagtgtttttgagattaaaaattactagcctgggcaacatggcaaaaccccatctctacaaaaaaaatataaatattagccaggcatggtggcacacgcctgtagtcccagctacttgggggtgagggtcgtgtgctgaggcaggaggattgcttgagcccaagaggtcaaggctgcagtgagcccagaaaaaattaaaaacagtttttgcagtcaaaattgtatccccaaatggaatcccaggacctctcacaaagcctgtaaaacccagagctggaatgtgtatttctttgtttcaaacttataatgtggtctgtttatatcatcttgctgttatttataaatgcctactgtaaatcttagtgcatatattactctcaatttccaatagcatggtccttcatccagtggagaatctctactaagttactctctgatactgggtcagaccttacaattccctagacatcactttattctttggcaaaatcacttgttatactttctctaaagtaatcatagggatgttaaatatgaaatatactctagagttctaaaaagatataattagagactcagtatgaataatttttaatcacacagaataagagaaatattaaaaatgggcaaatgggctgggcgcagtggctcacacctgtaatcccagcactttgggaggccgaggtgggtggatcacgaggtcaggagatcaaggccatcgtggctaacatagtgaaaccctgtctctactaaaaatacaaaaaattagccgggcgtggtggcgggcgcctgtagtcccagctacttgggaggctgaggcaggagaatggtgtgaacccaggaggcggagcttgcagtgagccaagatcacaccactgcactccagcctgagcgacagagtgagattcagtctcgaaaaaaaaggggcaaatgttccgtttttcaaagtgagacacagcttcaataataccatcccatgtcaaattaatcccattttacagggctaccaggctgagattaaattgtaaaaagaaagtattttaattaagaaaggtatctgataaagttattttgaatgtttatagggcaagatgaagaaatgtgaattagaatacactataactgggttggacgcagtgactcacgtctgtaatcccagcactttgggaggccgaggtggatggatcacctgagatgaggagttctagaccagcctgaccaacatggtgaaatcccgtctctactaaaaatacaaaaattacccgggcgtggtgacctgcacctgtaattccagctactcaggaggctgaggcaggagaattgcttgaacctggggggcagaggttgcagtgagctgagattgtgccactgcactccagcctaggcaacgaaacgagattccatctcaaaaaaaaagaaaaaaagcaaaaaaaaaaagaatatactataaccgatattacaatgaacattatgaaattgctgatattttgctacttttataggttcatactcaaatttatatttgattacccatatataaaaaaactgacttaagaaaaaagtcaattagaggatagtcttaagtagaatatgctgaagtgcatgccctcaatccttggagaagactgtattttaagaatggccacacctacatatttatcccatcccacgtttttcttacgatgtcacgcatactcttttcatgaagaggtggggactgcatttcccccaaccacatcagatctgtatgggtgccttgtgtccactccagccaatggagtgtgctatgagacttcagaggctagatcattaaaagaatacagactccaattagctttctttctctctcccgggatatctgcccttagaacccagccacacattgtaagaaagccagggccataaaaagaggccacgtatggtgttttggacaatggccccagcaaagccctcagcctgcagataccattaacaacagacatataagcgaaggagtctgaagatgactccagcccccagtctgaatattgcagctgaggccccagacattgtacagcaaagatgaatacgtctgattgtgcctgcctatctatagtcttgtcctatacaaatcatgagaggtattattatcattttaagccttgaagatttggagtatttgtgaggcagcaacaggtagctaatgcagtcctgttattttcaacattttaatcaacaacttgggaaaagacagacacacatgcttatcaaattagcagaggacaggactacaaacaactgccaacacttcggatgaaaatgttgggatttaaaattatgctgaaagagtagaacaccaggctaaaactgataaaatgaaattagcaacagaggaaatatatcctatttaggtaataagaaatatacattgggtgagggagaactagtttaagagtaactcatgtaaaaaccacctgagaattttcactgatcactagctcaacatgaaacaagggtatatctcagctaccacatagttacgtaactttataaaaatgatgttcagatcaaagtaagtatgagtgccactgtagtcagattggttttggtatattacgtttatttttttcataaagaaacttttattcaaagacaacaataacctttataataaatatgcagtaactatcatttttataatgcttactgtaggccaaacactgtccaaatatttcctctatattaacttatttttggttgttttttgagatagggtctcagtctgccaccctaggctggagtgcagtggcacaatctccacacaccgcaacctttgcctcccgggttcaagtgactctcccacctcagcctcccaagtagctgagactttcaggcatgtgctaccaagctcagatttttttttttggaaacagggtttcactctgtcacccagactggagtgcagtggtgcaatcttggctcactgcaacctccgcctcccaggctcaagcgattctcctgcctcagcctcctgagtagtggggattacaggcgtgcggcactaccgcctggctaatttttgtatttttagtagatacggggttttaccatgttggccaggctagtcttgaactcctaacctcaaatgatccacccatctcggcctcccaaagtgcttggattactggcatgagccaccatgcctggcctctatattaacttctttaatcctcactaataaccctaggaggtagtggcctttattatcaccatttcatagatcaggaaattgaggtacagaaaatgactgaccaaggtcctacagctagtaagggggacagctgggatagtattattcatacacacacacacacacacatacacacacacacacacacacacacacgtacacataaatatttttacgagacagggtcttgctctgttacccaggatagagtgcaatggcgtgaccatggctcactgtgacctcgaggtccagggctcatgattctcctggctcagcctcctgagtagttgggactagaggcatgatatggtttgaatctgtgtccccacccaaatctcatgtcgtatcataatccccagtgttggaggtggggcctggtggagaggtgattaaatcataggggtggatttctcacttggtactgcctcgagatggtggatgaggaatgagttattgtgagctctggtcatttaaaagtttgtagcaccttccctttctctctctcttcctcctgttctcgctatgtgagatgcctcactccccctttgtcttctgccatgactggaaacttcccaaagcctccccagaagcagatgccaccatgcttccgcacagcctacagaactgtgaatcaattaaaccttttctttataaattacccagtctcaggtatttctttatagcagtgtgagaatggactaatacttggctaattaaaaaaaaaaattgtagagatggggccttgctttgttgcccagactgaattcctggactcaagttattttcctgcctatgcctcccaaggttctgggattacaggtgtgagccaccatgtccagccagtattctattttaaatgtaatacaggcaactaagagaagaatcagtagggtaatcagcatgcacagggttaaaaaccagatcctatagaatgattagatatctgggtaactgtaatttggggacaaggacttacagacacaggaaagcagcccttcaatacctgaagagcatgtagtatgaatgacgtaaaatttaacaagatttaacaaattttctcctattcatttactgaagaaaaaaaaaaaaacccacacacttctttccttccccattttaaagttattgttagtattgatatacagcatttaagattactgacttaaattactgacttagcatgtaagatgactgttacaactcaaattatacaaaaacagattatcaagaatatttttattaaaatcaatttaagatattattctctcgattatcctagaaagaatatatgaacataataattaaacataagcttaattatataataatataaaaatatataaacctaatttgtgaagttagaagatagggtatttcatgaaccttacctgtagattcagtggtgaggaaaataaacaaggcttgcactagccaagtctgcaacgtcaacatcttgcgcggatatttctgcaacagacacatgtaatattacttttaatattttttctcttatatacacataatttaagacacaatcttgtttccatgctgtagctgtgtttctaaaaggtggtaaaattcttatgagaatgtagaaaacttaagtcttcacattatttttctttattcccactgaagttatggctatggaaaacactgctagaaaacataatttatactttaaggttaattaaaagagatatcttgtttctttcttatgtgaagtcttatattagtaaataactgtgagattaagaacttcagactgacaaatttctacatggcaaaactcaccataatatgtatccttaaaagatacctgacaaatggaaaaaaatgtttgtaattcatagcatggccaaaaattttcccgatatataaagaatgcctacaaatcactaaaaaattctaacacctaatagaacaggcaaacatatttgaatagtttatagaaaaggaaatacaagtaaatcaagcatgtgaaaagatactttcaacctcactcaaaatgagagatataaattagaactactcagataggaacgcaaaatgatacagacactctggtaaacaatttgatagttcgttaccaagttaaaagcacaccataagacttggtatttccactccaaagagcgtactccccaaaataaaaacatatgcccacaataagacttatactcaaatgttcacagcagcttcattcataagtcccaaactggaaacaatccaaatgtccaccaactgctgaatgtataaacatacattcaaacaatggtagagacatataatagaatactactcagcaaacaaaaaaaaaagagtatgaactggtgatacatgcagtagtatgaatgaatctcaaaagcattacactgaataaacgaagccagacacaacaggttatacattgtataactctatttacaggaaattctttttttttttaagagatgggggtctcactatgttgcccaggctgtctcaaactcctgggctcgagcaatcctcctgcctcagcctcccaaagcactgggattacaggcatgtgcctcagaaattcttgatacggcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggccgaggtgggcagatcacttgaggtcaggagttcgagacgagcctggccaacatggtgaaaccccatctctattaaaaatacaaaaagtagcttggcgtggtggcgggtgtctgtgatgccagctactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggcttgaggcaggagagctgtttgaacccggaaggcaggggctgcagtgagctgagatggcaccactgcactccagcctgggcaacaaagcgaaattctatttaaaaaaaaaaaaagactacatttgtcaaaattcactgaattctgtgtcaactgtttcaaaggcactgagattttaccttactttcaagctaacaagtcagcctaccacagtgtcatggatactggcaaaaggcatgacatttttgcgtcagaagcaaaggactgtattactcataacagtagtcagagtatcagcattttcttgcgccagctgcttgagtcccaactgtcacagggcattgtgaagtcagatgacacctgaacaggctgcttcacaggaaagaaagacagatcttaagtaaccctaaacttgaaaaatatgcaggaagcatgtctgccatttactctagagggagacattatctgtatctttgaagactgtaagtaagcctgtcctttgctccacggctctgagagtctaccttccaacattctttaaaaggtaagttggctgggcatggtggctcacgcctataatcccagcactttgggaggctgaggcgagtgaatcatgaggtcaggagttcaagaccagcctgaccaacatggtgaaaccctgtccctaataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaacgcagaaatgttagactcatgggtttcctatcaagttgtaactaaaaaatggtgaattttattgtttataaattagaccttaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaatctcatatataatacagaatgaaagaaatcagacaggttgggtgcagtggcccacacctgtcatatcagcactttgggaggctgagggggaagaattgcttgaggccaggagttaagaggccagcctgcacaaaatagtgagaccctgactctacaaaaaaattttaaaagagaaaaaaggcaagaaagtacgctctgcatgatttattttacagaagttcaaaaagaggcaaaagtctacggtgtttggtgacagaggtcagagcagttgttttttgtgaggaagggtataaaaggggacattctgggtgctgagcatgttctgtatcttgatctggacagtgataaattcactgagctgtacacttatgagttctgttttgcagtatgtaacaaaaggtaaacaaaccaaaaattatcccaataccattcttacatattagtgttggcaaaaatataaaaacccaaaaagtatcaacagggtgttgtgagactaagcaacgaaagtatcgtcacacactacaggttatagtgtaaattggcataagcttcccaatacattgaacactttaaaaatggtcagttttgttgtttgtaaattagacctcacttaaaaacaaagaaaaaagctctacccaaacaaggcagagagccagttcggcaatatcaatcaaaattaaaacacacacatttgattctaatgattctactttattttatcctacagatatgaataaaacaacacatgtacaaagttattcactgcattgtttttaacagtaaaaggctgaaacaacctgattatgatgggacactagttaaatgatggtataccaaaaccatgtaaatgtaaatacttgtagccatttaaaaaaaatgaggaagctctatatgtacagaaacataaagttatctaaaatacattgttacattgttaaggtacagaacaacgcatttgctattatttgtgggcaaaacaatatacaagaaaacaaaacacacattcgtttttttatatatgcacagtatctctaggaggataaaagttcaaatactggctgtgacagggtatttgagagatcagggtggtagggagacgctccaccatatactctgcagccttgcaatgttgaccatgtgaatctttagtacttatgcaaaaaataaatttaaattaaaaaatacttaatgtcagctaggtgcagtggctcacgcctgtaatcccagcactcagggaggccgaggtgggtggatcatctgaggtcaggagttccagaccagcctggcctacatggtgaaaccccgtccatactaaaaatacaaaaagtagctgggcgtggtggtgggcacctgtaatcccagctacttgggaggctgaggcaggagaatcacttgaacccgggaggcggaggttgcagtgaacggagatggcgccactgcactccaggctgggcgacagagtgaaactccgtctcaaaaaataaataaaataaataaatacttaaggttcaaactattgggtactatgctcaccaactgggtgacagttcaatcgtactccaaacctcagcatcacacaatatactcatgtaacctgtacatgaactccctgaacctaaaataaaagctaaaattattaaagacaaaatacttaatgtgtaatttttttcttctaaataaaactattaactcttcttgatgagaaatggcttcctagttctgcacttggaacacaatattgttttattaaatatacatactaacttgattttatgcactccctaatcatgtaacagcttgccagcatgcccagctaattttttaaaaatttttctgtaaagatgggggtctcactatgttgcacaggcaggtcccaaactcctggtctgaagcaatcctccttctttggccacccaaagtgctggaattacaggtgtgagccactgtgccaagccaaatgtactatattcttgcaacaaagctgctccagaacaagaggtccatgaaagaatttatgattacttcaaagcaattagatttgtttgagtagtaccatggaacacaagcaaagcgaactaggcaaaggtagattccacatttcacatttagaaagtaatctttcctaatttttaaaagattgtaatggagaggtgatgaagaaacatctattatgggacttgatttcatagtccaaatctaagagatgaagacacagtaacactatataaaatattatatgcaatacagttaacttcacttggggcttgcttaaaaattgacagaattatggccgggtgcggtggctcatgcctgtaatcccagcactttgggaagccaaggcaggcggatgacaaggtcaggagttcaagacgagcctaaccaatatgatgaagccccgtctctaataaaaatacaaaaattagccgggcatggtggcgcacacctatagtcccagctactcaggaggctgaggtaggagaatcacttgaacctgggaggcggaggttgcagcgagccaagatcgtgccattgcactccagcctgggtgacagagcgagactccatctcaaaaaaataaaaaaaaaaattgacagaattgacagtagtttgcttattttttccctcctttccttctgttgatactaatatttaatttaaaattatattaatagcactattacctcacctcttgcagagttttctatgcatatattataaccatacattgcatacactaaccttccttgaaatttgcaggtaacttgagaagcttctatgaagccaaaacctaactagtaaccataaatacaggaaagattatttctgaaaaccaaaagctgtaatcattcctcaactatggtgatataacatggtagtgtgccgaaaggagctagatgatgtataacaagtattgctacttttaatgttagagaaacaaagttcataaatgatttatttaaaatagaataaattcaagattatccctatagttgttcattctcatttactttcatttccatatgttttctcaagtgagagaaaaagcagtagagttacaatggataaatatttaatggttaggctctttataaattatttttgtcacctatggattgtgatttttttttcattttctaacttaacctaaggatgaaataaaaagcacgaatatatttagatttacattgcatgtgaaaaagaatgtcaatataaactttgttactatggtaacattactattacaattgtagaacagtatatgaactaaaattgccaaatagaaggcaaaataatgcttgttgaattaataagttgcgtggggatcaagatgaagaaaatttctatatatctttcacagtacagtgttactgtgaataaactgccagaagttggtaatacctacacaaaattaactaattattaaattagtttttaaattatccactctgttctcttccattagtatcaattatgagttcataacaattaacactaggatattattttacattacacaaaatgttgtcacataaattatttcactttagtctcctaatatcctaaagaatcaggtgagtagggcagggattatttattggaactttgtaaaataaaaaaacaaaaaattcagacaagatcaattacttacccaaatcacaaaattagtaagtgaaggagtagggatttgaagctaagtcttctacttctaaatgtcatgctttttccattgggtttcactgtaaagagaggagagtcttgttcagaaggctggctttgataattttattatatgtgtactttaaaaatccccatctgctcttaggcttttgggtttgcagaaagtatcctactttagatatgttctgagcttcagaataaaataaacccataaacacttgtataagagtattcaaatattctagtgctttttttttttttttttgagacaatgtctcactcccatcaccaggctgcagtgcagtagcacaattacagctcactgcagcttgaacttcccaggctcaggtaattctcccacctcagcctcccgagtagctgggactagagatggcaccatcatgcctagctaatttttttatttttagtacagatagtgttttgccatgttgcccaggctgagctcaaagggatctgcccacctcagactcccaaagtgttgggattacaggcatgagccaccgcgcccagccctagtgctatgatttgatatacgcttgcaaacattattggctcacccacacctaatgcaaacttccctgacgtctatgtaatgtcacagaaacatgacaggaacatttatgacagacggagttctttaacaatcacatatttcttcttctactagcactaaattaagcctgctaacaactattctatgtaaccagagataaaaatccattttaagatttgttcacttaaattctagcttaagtactagtgctcctctttgaaatacaacaagtaacttcaaacttaggcaaggagttgaatcttccattattgtttcatacacattaagcctttgatataacttaataacacataaggaattaaatttataaaaatattttttaaatgtctaatgaaaagaaactgaaaaaatgccatgtgaaagtgcactataatcccaccaagagataactaccatgaacattttggtggatattcttgcaaaattttttatacatgtattatataactttacattgtataaatatacacacttttctattttacaaagatgggatcatgtaagtgagaaatgttttataacctttttcacttaacactacatagtggacatcttcataagttaatatatagagagtaattccttgtagcctttgctcaaattcacctcctcatagagatcttccctaaccaccctgtgtttcttatacccctttactgattttttttttttctacaacacttaacaccttctaaaataggctagcaaacattttctgtaaagggccagataataaatattttagatttcgtgggctttaagttctctcttgcaattagttaactccgttattaaagtgcaaaagcagccatacacaatatgtaaataagtgggcataggtatattcccatgcaactttatttataaaaatggctgcaagctggatttggcttatgggctatagtttgccaacccctgttctaaatacaatataattaaattaattttctttttgtttgttatgggctgaactgttccccccaaaaaatatgttgaagtcttaaccccagtagcacaaaatgttactctatgggcagatttaattggatgttatagtggagtataataggcctttagtacaatatgactggtgtctttaaagagacagagccaggaagaataccatgtgaatacacaggcagagattggagttatgcagctgtaagctaaggaatctcaacgacgatggctaccaccagaagctaggagaggcaaaggaagattctatccaaagtctcaaaaggacttctagcctccaaaaccttgagagaataaatttgttgttttgagccacccaatttgtggtacaggttgaacatcccaaatctaaaaactgaaatgctctaattccaaaacgttttgagctctggcattttggatttcagattttaggatttgggatgcttaactttaagtatataatgcaaatacaacacaaactgaaaaaaaaaaatccaaaatccaatatacttctgttactaagtatttcaggtaagggatactgtaacaaagggatgctctattacagtagcccctaggaaactaacacatagtgtgtgtccccaaaatagaaggtaagtgaagagtggaatggctaggccctacggcaggtgtgtgcttggctatatcttctttgatgatgtgtctgttcaaacatattgatcaactgggtttcctgttttctcattaagttttgaaagttctaagaagatattctggcctttattagaaaatggatttacgcattattttcttgtatgcttgtcttttcattcttttaacagtatcttttgacgaataggaggtttaattttaataaagttcaattcatcaatttgtgtttttgatgtatctaagaagtctttgcttaatctaaaatcataaagggcccgacgcagtagctcacacttgtaatcccatcactttgggaggccgaagtgggtagatcacctgagttcagaagttcgagaccagcctgggtatatggtgaaaccctgtctctactaaaatattttaaaaattagccgggtgtggtggtgcacatctgtaatcccagctacacaggaagctgaggcaagagaactgcttgaacccgggaggcagaggaggctgcaagtgagcagagatagcaccactgcactccagcctgggtgacaaaatgagactccttctcaaaaaaaaaaaaatataaaaaataaaaataaagtcaaaaaggttttttcctacaagttttatagttttagggtcatttaggtctcagttatttcaagttaatatttatgtgtggtgtcaagctgaaatttgagttcattttgtatatacggataattgtttcaaaactatttgctgaaaaaattatcctttctcaagtgaattgcctttgcgtctttcttaaaaatcagttgttcacaggtgtgggtctatttggctactctcaattccagggtgggcaagcttttcatgtatgaggtaggaggtaaatattctaggtttgtgagccataaggtctctattggagctaccaatctactgttacgacacaaaagcaaccatagaaaatacataaacaaacaggggtggctgtgttctaacagtactttatgaaaacagaaggtaggatgactcctactctatttgttccactgatcaatttgcttatttatatgctaccaccacactgtcgtgatgactttagccttataaatcttgaaatcaatattctgtgtgcacttaaaaagcactgctgctgctggtagagtgttacataaatggtcattacgtgaatttggttgatagtgttcaaatcttccatatccttactgattttctgactactacttctatcattgttcaaaaagggatattgaaatccctgaatataactgtggatttacttctccttgcagtttttaccctgttgtgttttgaaactatgttatttggtagatccttttgataaattgacccttttatcattaggaaatgcccttctttaccactggtaacattctctgaaatctactttgatattactatagccaattctgtcttactttgattagtgttatcatgacatatcctctcccattcttttttgtttaatctgtatgtttcttcatatttaagtggcatctttagggggtaggcagcatgtggttgtatccaatctgataatctctgctttccaattgggtgttcagaccatttacatttaatataatttgtgatatgattaggtttaaagctatcagcttcatatttgttttcttcttgactgttctttgttcctgtttacttttctgcatttatttttcttaattattttttattctcttttccttgttagctaataagctataattctttgttttcttattggttgctttaggtttatagtgtacatctttaacttttcacaatctatcttcaagtaatattatgtcacctcaggcatagtatataatagtatacttccatttctccccccagacctttgtgctattttagcatatattttacttttgcatatattaaaacttcacattggtagctcccacctgaaatcccatcactctgggaggccaaggcaggaggatcacttaagcccagaagtttaagatcaggttgggcaatatagtaagactctcgcctctacaaaaaataaaaagttagacagctgtggtggtgcatgcctgttgtcccagctactcaggaggctgaggtgagaggactgcttgagccttggaggtcgaggctgcagtgagttgtggttgcactactgcattccagcctgggtgacagagtgagactggcacatatttactcgtgtggttaccatttctagagcttttaattcctttgtatagatccgtatttccatctggtatcattttccttgggcctgaaaaactgcctttaacatttttttgtagtatggttagagaaaagtctaaatagatttgaaaacaaaaccaaagtgtgaatgctaacaagtatttagcctaaaataagcacagttcaaaatgagaaaagatactgctaattactatattaacagaccaaaggaaaatgacagggtcattccaacagatgtttgaaaagcatctgataacattcaacaactgttcatctaaaacttaaaaataacaacaaagtgtcagaaaactaagactgaaagagaccatccttaccttggtgaaggataacaaagatgatacagggactctagaaccagattgcttgtgttcaaatttcagtccctatattttaacatcttaggcaagtttttaaatagccttcacttttacttcctttatctgtaaacatggggtaccaccaccacctacccatctaggaatgttatgatgattaaataactcattatacataaagtgcttagaatcatttggctcattgtaactactcaataaaaggttaacagctgttattattagtgcagctcttgctgttgctgccacaggtactactataagaaacctacaaggccaggcatggtggcttacgcctgtaatcccagcactttgggaggccgaggcaggtggatcacaaggtcaggagtttgagaccagcctggccaatatggtgaaacgctgtctctactaaaaatatgaaaattagctggtcgtggtggtgggcacctatagtcccagctacttgggaggctgaggcagaagaattgctcgaacccgggaggcagaggttgcagtgagccgagaatgcaccactgcactccagcctgggcgacagagtgaggctctgcctccaaaaaaaaaaaaaaaaggaagaaagaaacctataataagcatctataggtttaaaggtaaaaattagaagcgttcctattaatgtcaagattcagacaagatgcttgaagtcatcagttattcaccactgctctaaagggcttaagcaaaaatataataaataagatctaaaaatggaaaataaattgtgaatgatatgatcatctatcaagaaagagtgagaatcacatgacaaactattaggactattgagaatttaacacagtagtcaaacaaaacatcatcaaaaaataataggactatttagagtttaacataacagtcaaacaaaacatcatcaaaaaatagctctccagctggcgcggtggctcacgcctataatcccagcactttgggaggccgagataggcagatcacctgaggttgggagttcgagaccagcctgaccaacatagagaaaccctgtctctaataacaatacaaaattagccgggagtggtggcgcacacctgtaatctcagctacttgggaggctgaggcaggagaatcacttgaacccagtaggcggaggttgcagtgagccgggatgtcgccactgcactccagcccaggcaacaagagcaaaactccatctccaaaaaaaaaaaaaaaagctctcctacataccagtaataactaattagaaaatgtaacagaaggctgggtgcagtggctcacggctgtaatcccagcactttgggaggccgaggtaggtagattgcttgagcccaggagttcaagaccagcctaagcaacatggcaaaaccccatctctataaaaaataaaaaaaaaataaaaaaaaaaatcagccgggcatggtggaccatgcctgtaatcccagctactcaggaagctgaggtgggacaaccacttgagcctgggcttatagaggctgcagcaagctaagaagccaagatcttgccattgtactccagcctgggtaacagtgcgaggctctgtctcaaaaaaaaaaaaagtctcgcagaaaaaaaaaaaaagggcagtctaaaggtaaagtaaacatagcactgattggcaaatgaatagacaactaaatcaatggtacaaaacaaaacacactcaagtgtatataagaatttagtatctgattttttaaaaggttgctcatttgctgggaaaataaaggactattcaataaatagtattgggacaactggctccataagcaaaaaagaaaaaaaagaaccccatttcatcagacaaaaagacacacactcatgcacgtgcacatgcatgtataagcatacactctctctccagattaaggacctaaatgcaaaagcaaaattataagcatattgaaaaacacatagaatatgcttatgaccttagggccttttaaaattagactattttagccaaatgaaaaggtttacagagcactttgatgaacatccatgttctcaccattgcttaagaaataaaagctcaagcttttattcaatttttattccgttacaaacataattgaagccatataaatagttcttgcctttaagaagtccaaagtttagagatgcagaatatgcacaaagtgccacaggagcacagaaaatacccaattcagacaggggccaggagcgcccagtcttaaaataagggtaggggttcctagatagagaaaatagcacacatatgaactctacatcatctttgactctaattgtcaagtgaagattaccaatgacaaaatcccagagcatgccagtctaaccagagctatgctatctgaaacatagctctgattaactcactttgcactagggggtggggttgggggtaatacataaaacagaacatccaaacaaaaaaagactgagcagatcaatcaaccttagagcaaagggtgaagctgattgcttaaaagaaaatgaaactttggaggcagaacattccaaatgtaacagggcaacagatttacagtgctgaaaggaatgaatctcctgctctggatatgtatacacacagctttaaaacaatcatctatatactatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatatcctggtttctatgtaaccagataatgtagttgaattctttcctttatcctctttcttgtctcctttactgaattctctgctagcttttatctccaggctatgaaggtacccaaagataaagtactgggcatcgacttttctttttaaataccaacttctttgaagacatgacttcaactactaccttcaaacaaaataatttcaagaattttggcttggatctttcttttaattccagttacatttcatcttcttagatattctgtctctgagtcttatcaatttaagaggtctaaaaacaatacaccataggtacatgctcatgaacacatatacacataaatgcccacccactttttttgtttattatactttaagttctagggtacatgtgcacaacatgcaggttacatatgatacatgtgccatgttggtgtgctgcacccgttaactagtcatttacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggacatttgaattggttccaagtctttgctattgtgaatagtgctgcaataaacatacgtgtgcatgtatgtctttatagcagcatgatttataatcctttgggtatatgcccagtaatgggatgaatgcccacacactttttaaaaagtcacaaggacttaccatttttccctatctacaaacaactcatcctcttcaactgcctaagtcaatggagtccatcgtttctctcatctatgcagtacattttagcttttctcagttacaaatcttatcctgtcttctctcccataatatctttcccacccatctcttctttttactctctaccacaaactaacctaatttggacattgatcacctcaataatttcaactgtgttcctgcttccagtctctttcctccccaccaagcattctgaacattgttggtggatcactctctctacaacacaactttaaacctgtcattcttctcctcaacagctttttaaagggtgaataataatgccaaatattctaactatttaagaacctaaaattttggctttgatgtgcctatccaatctatcttttccaatactcaagtttctctattctaaaaaaaaaaaaaaatcctttcctcagactcctccctcaagctaccttactactatacttctagagagaactgcttgcaattgcaagcaatctggcttttttactccaataatgctgaaattattcttgtagtttccaaactgcaaagcaaatacttaagctcctcattttgcttgaccacaccatgccatttataattcggtcttatctttcatcactccctactaaccatccctgtagactcagcaaaccactagacttcctctaacataccttgttctttcagtctgtgcttctacatatattattccaatgtctttcctgactctgctgtgcactacaaactgcttttgaagtatcatctcttatatggaatttccccccacttcaaacatctttgctgtcagtgtactcttacatcattccctaacaggactcagaacactgcacagtaattgtttcacatatcttgatatcctcagaatctaccatagtttgaggcacctggtggacaattaagggtgggtttttatagactttctggtatgatcttattttctatctactcgctgtcgctcaagcgtactgtatggagacgcaggatgtatcatggttaagaggtcagattctgaagccaggctgtctatgtatgacctttagatctaccacttagctgggcaaattaattaaccttcttgtgcctgggtttccctatgtgtaaaaagaggattttatcctattattattagacctacttcataatattatgaagattaaatgccttaatatgggcaaagtgctcaaaacagcaactggcacaacataagcactaaatatattgcctgttttaattaatagaccttagttactgctgatcctttccacaagctagtcctatattatgttctatattctccattctacattttgtcctccattcgctattattaatgggctgtcttcatttttccctttatccaaatcctacccaggtttcaaggccaacttctggtaaatcctttgctcattccaatccttaaatgctcactccaatccttaaacgatcattccctaattttaatatctacaggattttctgcatcactctgcatttaattaaaactgctttgcatccttgtagtttttttcgtataagtttgtcaatccaattattataaactctttgaaggtcctgattacatctcctgcacctttgtgagttcgtacagcaggtagtaattgcttagtatttgctgtgtaaaataataaagcacaataggaacctcaactctgatcattctgcctttgcaatcaaagaaacggagaagctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagttttcagcgagactcctgtttccttctctataaaggggacattttaacacctacttcacatgtatttaactttcgccctaacactgaactgaagtgcaaagccttggaaacaaatttaaataaattgaaaatactgcaattcacaaataagagtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtcctttttgacactttctccttcctgtaatttttttctttcactcaagattaaaaacaaacgttcaagattatccctaaagagaaatagttggaaagcacaatttaatagcaagttggttctataaatgtaatatttcagttcatagttcaaaaatacttccaaataggaattaacatgaatttaagaaattaacataatggcacacagctaaactgatgatctgagtccgtaatttcaaattaagagttgttccaacttgaagctggcagtcatacacagtttaaagggtttgtttacagcactgtcaaaagcaaataccacaatctttcagaaaattcaccctggcattctaataactagttattttaaggcagtataattgttgaaatacttcacaaactaagccaaaatgcgtttccttctgaaggcaaaaaaaaaaaaaaaaaaaaaaggtgacgtcttatttttaacctgtgattttttttttttttcagtttcggattatgaaataaaatgctgttcatccactgaagaacagacccttgcttcctgcactatcttcaaaagtttaggtcggaggaggtaaaattttaaaaactgatttgttctccttgggatacagtgagatgtggaattcgttaggaatgataattattaatagaaaagatcaaaagaaggaaagaaacgttaatagtgtttataagcattgtgaactttcaacaaagctgaaacgttacgatttcaagatgaaaaaacggctttggggaagggaaatccacctcgagaatgaagacaagtgcggagcgaatagaatttcaggggagatgaaaaggggattgggaaaaacgtgggatctggtaacaaaaaggggggtttgttcttgaagggcgttctgcggggcgggcgttaagaggggtgcgtgcgtgcgcctgggtgaagtttgtactcagggctgcgataatcgaggtgacaaagttgtggaagtagaattcggaggtccgggagcaggaaggggaaggaatgtggggatttccaggctgggctgacaagttccgggcgctgctctcagggggaagggaggtctcctcgagtgccagatagcccgtccgaaaccaccgacactctaactccagctacgcgacccagcacccggcccctcctcacctcaggccgcgccgcctcgaccctccgcgtctccacagcgcacgaaccccttggcgccaggctgggccagacccgtcggcctggcaggcgcggcccccggttcagctgcgccggggcggcccagcgcgactccgcgggccttttggctgctcgccccggctccggaacactgtcagatccttctccgcagaggtagcgcgccaccccagtcccgcggcggggcggggcgctccccaatcccgcccagctgcgcccccggccggccaacgctgcgccccgccccctaccgggacctaggcgctgattggcccctgagagaccctttgcgcccaggcattggtccagtggccgcctgtcgacgagggggcgggactccgaggggtagcgattcccgtaacgcggctcttcgcgtcccggattccggtggctgcgtccgcgtcgcctctcccagactagatcgaagggttccccccacctcccctctgtgggcggaaagagcggaatgttccatttttctgtggaataacggggtcatgaactggagcccgggtgctgcccgccgcccgctgcccccgccctcccttctcgccagggcgcctgcggcctctcttcgcggccttccccgagggactcagagccgcgagggaccgcctagctcccttggggatggggaaggcgtgggagcctcttggggaaagtgaagagctcggtggccgtgactccgcacgagactgcggcagattgtggcggcggcttctctccaagacttacgtaaacgagccttgccacagtacttttttaaattagtaaatgagtttgggtgcgattgatcagtgagccccagaggtggtggcccaccaagcgactagtgtttctttgcggtttgtacctccccgtttatgataaaaaataccgggtaaaaacctattcatcccgcctccgcccccccctttccctcagaaaatggacctcaaggctcatgatgtttgtttctccccaaaggaagatgagaatcttgagttaaaagataaggcatgtgcgtgcgtgcgtgtggggtgtgtgcgtgggtgtctgtaaaagtaaacacccaaaggtagaggtttttgtggaagaatgagaggatataggaaggaaataatggtttaatgaacttaaattatatccataaattaacaattataaagttcttcattatattgaggattcagatagagtaaaacatagatcgaattttaatctcttagttgttgatcagataatttataaaagggcaaagtgggcctgctaacggagtcgcaggcaaagtagatggtgctgcagctgatgtgttcagctcttgctcctccctgtcatcctatatctaacctatagattgtgaccagattctgttctagctttgccatttagaggggtgtttattttaaaacaaatttttataaaaatttgttaaattgaaaattttgtatagatccaggaaacttgatttttttgttgttgttcacagtctcactctgtcacccaggctggagtgcagtggctggatcatgctcaccgcacgttcaaattcctgggctctagcgatcctcccacctcaacctcccaagtatctcagactacaggtgcccctacaatacctggccaatttttaaaatttttggagagacaagattttggtatgctgacccggctggtcttgaactgctggcaacaaacgatcctccggccttagtggcctcccaaagtgctgagataacaggtgtgatgcaaagatgtatttaggggagatgtatagtggttaaatgtaccctctggttctagattgcctaggtttaaatgctgatgcctctatttctcatctctgtgaccttgggcaagtcttttcaaatttcttcatctgcaaaatgagaataacaataccaacctaacaggattgttgcaaggattaaatgagttaaaatacatacagtgtttggcacatagtaggtgctctgtaagtatcagctataatcattattgaatgtctactcggtcaacacttctgaaatattttagtatcacaacatatattaaaaatgatgatattttgctggacggggaagggcaggtacacagaagtggattgatatgtcacaacacaccagcctgccttggcaccattaggaaaacaaatgactgagttagtgcttttatgggtgtctttttattggctcagctcaggtcctgctcccaagaaactcacattttatgggagtagttaaagtctgaggccaaaaggatgaatcaatattggagaagtatttttcagagcaacaggacggaagacctctgctgtgctggaattacatgactttgcagatacctctgtagagtattggccttgaaattacgaatttcagattaaggatttgttactagaaagccttgtcaaaatgcaaaggtaagtaggggaaagtagtatattaatggagaactctccatttgtgtcctgtgaccatttgagattttagatatgtcaagagcaggccgggtgcagtggctcacacctgtaatcccagcattttgggaggctgaggcaggcggatcacttgaggccaggaattcaagaccagcctggtgaaaccccaactctattaaaaatacaaagattagccaggcatggtggtgggtgcctgtaatcccagttacttgggaggctgaggcacgagaatcacttgaacccaggaggcagaggttgcagtgagctgagatcctgccactgcactccagcctgggtgacagagcaaaactccttctcaaaaaaaaaaaaaaaaaaaaaaagagattgaggaaactgtacagtgagaaagtaacatgaaggcaccaaaattacaattacttgggagtaagtgagcaaagcttaggaaattgtgccatggaacaaaggtgataaatgtcaaagacaaactttgcctgcatttctaattccctaaatctggtgctgactaggatatccctttacttccttgtctgtgcccagttatgtttctgaaattctgtgtcagccctggaattatcctcatgttctgtatcaccttaatgatttcagcatccatgttcatgactcattagcactctgacctcacaatttctcatcgttttcttttccaatcatcttcaacttcactctgtatcagcaacccacagatggagccacaccttcaacctagtcatcaatgaaattacttcccctccaaaatgctggattgtgagtttccctctctgtacctacagccacctacccccatctatctctattctgtggtcattcccattgaatctgtaatttgtcctcaatgtgacagcctgacagccagtctttcttctcatagtttatcagctgtttcctatcattttttatcttacttaccagtaagaaccccctttttttttttgagacggagttttgctgttgttgtccaggctggggtgcaatggcacgatcttggctcaccgcaacctccgcctccctggttcaagtgattctcctgcctcagcctcccaagtagctgagattacaggtgctcaccaccatgcctggctaattttttgtacttttagtacagacggggtttcaccaagttggccaggctgatctcaactcctaaaagtgatgggattacaggggtgagccaccgccccccaagaacccttttatcaaccattttaactgcactattctcttcagttcccttgaccttcagctatgtttaccttatcaggctatttcctaactatttcctttttccttgagctatcagccccaccgtaacatttattcttagtacagaaccttgttttactcccttaaaatcaagaccatcatttgtgagcatccttgacttttctccaacttaggaagcaaatagatatttatcctctttctcttttccccactcagaggaagaaaggcccctttacttttaaaaggttaatttctcctcctctgttcttggtactactttaagtctagtcccctagttttatatttttcattattaacactaaatgactttgaaatgtttaaaaattagatattaactcagtggtgagttgaggacagcctctctgcctgtgttaaaacctttgtaacctgatagcacctaattcaccaaaattaaaaataattaaatgtctaaaaatgaagaatgttaagctacattgaaattcacttaacaaaatgaggtgagaatgaaaaatgaacttaaatttccaaactagaagacaagagaaattcatttcatagcaacaaaactcaaaaccattatgactgctatttcaaaaaatgttttgaagaatgtatattcagaaaaatcaacataccataagagtacagcctgaaaatttttgacaaaatgaacacattcatgtttatcatctatatcaagaaacagaaggcctggcacggtggctcacaccagtaatcccagcacttccggaggccaaggcgggcagatcacgaggtcaggagttcgagaccagcctggccaacgtggtgaaacctcatctctactaaaaatacaaaaattagctgggcttggtggtgcattcctgtaatcccagctactggggaggctgaggcaggagaatggcttgaacctaggaggcggaggttgtagtgagccaagattgtagtgagccaaggttgtatagtgagccactacactccagcctgggtgacagagcaagacttggtctcaaaaagaaaaaaaaaagaaagaaatagaaaatagtctgggtgcggtggctcatacctgtaatcccagcactttgggaggccagaggctaaagcgggtaggtcacaaggtcaaaagtttgagactatcctggccaacgtggtgaaacccagtctctactaaaaatacaaaaattagccaggcgtggtggcacacgcctgtagtctcagccactcgggaggttgagatatgagaatcgcttgaacccgggaggcagaggttgcagtgagctgagatcacgccactgcactccagcctggtgacaaagtgagactctgtcttaaaaaaaaaaagaaacagaaaatgaccagtaccccaaaagggccctcctcccatccagttattggaaggtcataactgaccactattctaatgtcatagcgttgtacccaagcgagttagagaaaacgacacactttgagacgaattaagagtcctttattagccagcgaccgagagatagctaacgctcacaattctctctgccccgaagaaggggctagattttcttttatactttggtttagaaaggggaggggggtctagttaaaacaattttacagaaataaagtaggcaaaaagttaaaaggataaatggttacaggaaagtaaacagttccaggtgcaggggctttaagactattacaagatgatagactcagggctttgggtgttatcaatcagacgaattcctgggaattgcggatatagcttgccacagtatcttatcagttaattgcattcttggatgtgctgggagtcagcttgcacaagttaagtccttgaggaaggggctgccagtgaaagagtcaagatggagtctgtctggctctcttagctaagggagagtcaattcaggtggaaacaagcctaaaaacagggttagtaaaaacaaggttgggcattacaatagttttatgctgtctttttaaacttgaaaagtgtacagaaaaattttttcacatcagatgggtaatgtgccaacgtcgtaacaaggtttgcgggaggcacatctcacacatgcacatgaaaacccaatcatcaggcttataaactacaaaagaatctgaaacttcttaggcttaatattaggttggtgcaaaagtaatttctgccattacttttaatggtgaaaaccacaattttacaccaacgtaatatatttacttattttattttaatgaatatactaaaccaagagagtttaaaatgaaataagtactgctctgtggccgggcgtagtggctcacgcctgtaatcccagcactttgggaggccgagacgggcggatcacaaggtcaggagatcgagaccatcctggctaacacggtgaaaccccatctctactaaaaaatacaaaaaattagctgggcgtggtggtgggcgcctgtagtcccagctacttgggaggctgaagcaggagaatggtgtgaacccgggaggtggagcttgcagtgagccgagattgcaccactgcactccagcctgggtgatagagcaagactctgtctcaaaaaaaaaaaagaaagaaataagcactgctctgtaaaggtaaacacagaggaagggatctagctcagagatctccatactgtggacttccagggataaccctggtcaaatagccatgggctggtcaatgattttgagttactctttgagagggaagcttggcttcagagaaggaaaggccagtgcaagacatgtgagcagcagttaggtgcatcctattcctagacacatacataggataaggaagtcaggtattgggactgtagctttggaatggactatacttgcttcagaatattatcagggggagtttgagaagcaagggctttccttcgttgattctcctttcaccagtcttcctggaaagaatattctgcagttacaaaataggttccttggctgccagtctgatacttgtgctaaaaccaaatagatgaaaaagtatcaacatgaattttaaaaaatatattgtgtgagcttgtatagctaagaattcccagccccctacataggatctgaagaaagatctagtactaattgtattaaataatggtttaggcaaatgtgtatctgtctccttaagagaggaaggcagtccctactgtaaagtaaaaatgaaatggatatacttcctgagagggctggaattttctgataattgtcccctctgatttttcacaggatttacggaatggccatcttccataattaacaaataaataaatgaaatttaatgtcagggtcaaatgaaactggaaacaaagcttatctggtgatatatcaaattatgagagtcattatttggatgtaaggatatatgacagatagactcttaggagaaatgctatgacctcctgcttcttggtattccttgtgtgatttcctcctcttgagtgtgaaggcatgtatgtcattgagttatataagatagtgcccatcttgctagtgtctctctctctcttgtggctctgaaaaatcaagctgcctgccatgtttgagctttgatatggaaagacccacatgttaaggaactgagggcagactctgccaacagctagctttgaaactgaatctcccggccaggcacagtggctcatgcctttaatcccagcactttgggaggccaaggtgggtggatcacaaggtcaggagttcaagaccagcctggccaagatggtgaaaccccatctctactaaaaatacaaaaattagctgggtgtggtggcaggcacctgtaatcccagctacccaggaggctgagggagagaatttcttgaacccaggaggcagaggttgcagtgagctgagatcacgccactgcactccagcctgggtggcagagcgagactccatctcaaaaaaaaaaaaaaaagagagaaagaaaccaaatctctcagtcctacaacctcaaggaactgaattttgccaacaaaagcagatccttccccagtcaagcctcagatgagacagcatcctcagctaacaacttgtttgcagcctcatgagaactgaagcagagaacccagctaaactgtgcctagactcctgaccacagaaactgagataataaatgtgtgttgttttaagctgccaagtatgtgataatttgttatgtagtggagaactaatacaacagggaaaagttaaaagctattcacataaatatttataatggatactatttctacacatttaaatcaagcttctcttacgttcataagaagatacgaatctggagaaggaaattatatcaagcagaacgctgctctggtgttgtgaagacgggatcccaccattctaatgtattcaatttatttattcaataagttttgagcatcaactatgttccaggcactgagatattaatctaaggaagacacacgtgttgtcctcattgaggagctcaaaagtctaatacataaaccaacaatcatacaaaaatcatagccatgttacagtgctatgaggaagatgttaagagaatattctggaagtactcatacataaatacttcagaaactgggcattataagaagtcagttgcctctctctactttcagttctacatttttataccttgtagtggatttaaaatggccacaaattcttcaatactcttctatggagagatttgagggctatttcccttcatcttgaatttaggcaggcttgttcagggtctggcttttaagaggagctttcaccttggtctgtggaagtcctgagtcactgtgtacaaagtccatctaccttattacaccatctggagagagctgagactacagggagagggggagtggcccggctgatcccagtcttcctagtgaccctgcccaggaacttggcatgtgagtaaagccatcttggaacctccataccagaccagccacgagatgaataatactaactgatcccagtcaatgccacatagagcagaagaactgcctaactgaattctttccaaactgctgactcaaaaatttgtatggtataataaaatgtttgttttaagtcactgttttgttaggagtaataagcaaccagaataaaattctaatctttatcatgtaccgtgctgaaaatctgaccatctcactctccttaaaactccgtcaatcccttcccattacccaaatccctcttgtatgtcatagaagtccctcattacgtgacctctacctacttctctggtcttgtctcctaacatggcctccaactccaggctctcatattacctatttgctaatggttcctgggccagcatccaacatactgttccctccttccatgccaagaagagacagcttattctgtttccttggccggtcattgccttcttcatttgctttgcctaacttgctcaccgtgtaaaaatattcatctaagtagttacttcctctcagaagtctgctctaggccatgagaaactcacagccaaaaatgcaaatgattccagatgatcattcactgtagaaaaggaattgatgggccgggcgtggtggctcatgcctgtaatcccagcactttgggaggccgaggcattaggatcacaaggtcaggagattgagaccatcctggccaacatggtgaagcccggtctctactaaaaatacaaaaactttgctgggcgtggtggcgcacaccagtagtcccagctactcaggaggctaaggcaggagaattgcttgaacccaggaggcagaggttgcagtaagctgagattgcgccactgcacgccagcctggtgacagaacgagactccatctcaaaaaaagaaagaaagaaaaagaaaagaaagaaaaggaattgaggaagagatttctagaccacagagcaaaaagggaatgggggaacccagataaaatggcagactgaaaaaattctttgctctttaagttagtctctcccaacatatacaatgtcatggatgctgtattagtcatttgaacaaagtgctatgttaattcagaaaagagacaattaattttccctggagagactggagatgctttctagaggaagtgtgacattgaagcaagttcatgaaagatgagtaggaactcactaagggagataatggagggaagcagttcttggcagagggaacagcaagaggaagcagtgggaatgcgaaaggacaaggtattaccaagaggtctggtgagagtagatcagggagtgcggggtgagaaataaattgagacgagaaggtggaggccttccttaaaagccatgctacacaggggatttacactttattttgtagggagatattagaatttttaaagcaggatactgttgagaacagatttgtgattcagaaagcaaattatattaatactgtgaaggatgaattgggggaacaagaaactggaagagagcttgaactagaatagctccttattttggaagagaaggaagagggtgttctgaataatgccagggagatagaatggcaagacttgacagtgggatatggtaagaaatgtatggacagatctgtgatcaaagcctgggttaatcattgcggataagctgtatattcttaagtaatttcttccccctcccctcccctcccctccccttccctcctctgtcctcccctcccctgttctctcctctccttttttttttctttgagacagggtctggctttattgcccaggctggagtgcagtgatgggatcatagctcactgcagcctcaaactcctgggctcaagcgacttttccacctcagcctcctaaggagctgggactataggcacacaccaccatgtgtggctaatttttttgattttttgtagatacagggtctcactttattgcccagactgatctcaaactcctgggctttcactctagttgtgtcctttgtggttcttggatgtcatcacccccacattaggcacctgcaggtatgtccttgtccccacctgagctctggatgtacattccatgctactttccacttttgtgtctcatggtcatgactgtaagtccccttggaccctttgtcagctaaattatgtgtctttcttgggggcccgttagcttttctgtgccactctcggggctgcaaaagattcagagggactgcctcagactttccctacctagggcactatatgtggtcatctttaccttaattctgtgacaacattgtggtctaggaaacatctgctaggctgctgcctcccaggattccagatgttaatagattcccaacattgtcatgagcctccaccatgtctccccaacttggagctaaccccaagtaaggggcatggtggaggaccttttcttagatctttattacctgaagttattttgcttaacactcatttctctacttttgcgctccccaacttggaaagtctttatctagcctaggggtgggggtggggtaggggggttgatattagtgggaggggcaattaagatgggtcagcaagtatctccccaaatctttctgtcttactactaaggcttttgaatttgagagtccaagagtttggcaccttcattctctgctagtcagtgggtttttgttgtttgtctttctaatgcaatcagggagagttgttaagtgaagagtgtagagagaaaaaaattctggaacaaataccttacttaaatatcttgatatgctgaaataaagtttttgtctcttccaaatatatgcatcctcttctcacatctgccaagacagtcataggtaagaaacctcaaattagaataaagagtatccgcttccttaatctgatttctgtgtgcagataatgagaagaggcgaaggatcaaccagattctgaaaacttgctttcaggtaccaggggccagagcataaaactagatattttcccaggattgattgatttaggtactgaccctcaggggtcacatagaaaatttcccagtgacattaaaggaagcccatactctattgtgtaagaaaagagaaaaactaaacaagctgccaggtgttgaacttctccttgtgtccagttctcgttctgccttgtggagctgtaggagagggtcaccaatgcccagacatgccattacaccttcccttcttttgcccaccttcttacctcttaacatcattctcatgaattttttttcatatacttgctacctttttctaactttataaagacagaaaaataaatgaagaatgaatcatctgtcttgtgtgttagatgtcatggcaggaggtagaaaggaaactgaatatgtctttaaacccctggagcatctagctacagatggactaaatggtccaacccaaatgcagaaaatcagtgtaaaccacttagactgtgattctgatttcaataaaaagtgaattttttttccaagtaggaatatgttaagctgttttctctaatcagagacaaattttcaatgcctggataacaagtattatcctaagtgctacccctttttgtgtgccagctatgtgacagaaactcactataccagacactttatatcccaattaatctttgcaacaaacagggcaggaaatagcagttgttcactgtagtcacactcttatgacctagaagtgttaatttatatatatgtaaattgtacatcttccttatatattataattatataattaaattatacaattattatatattatattatatattatatatattatatgatatatgatatatgatatatattatattatatattatttatatatttaatatatatcatatataatatatattatatattatacaatatatacattatatattatatattatacaatatatacattatatattatatactatatattatatatcatatatactatatataatatataatatatgatatactatataatatataatatatgatataatatactatgatatataatatatgatatatgatatatcaaatatataatatacgatatataatatataatatatgatatcatatattatatattatatatattatatattatatattatattttatatatgatatatgatatatcatatatcatatataatatatatgatatatcatatatcatatataatatatatattttatatattatatatgatataatatatataatatatgatacatgatatataatattatatattatataatatattacatataatatataatataatatatataatatatactatataatataatataggatatataatatatataataattatattatatagtatatattatatataatatatactatataatataattatataattatataattaaattatataattaaattatgatttatataattatatattccttatatattataaatgtatatattatatatttattgtatataaatattatatatataaagaaacacagtctctctgtcatgcagtggctctatcatagctcactgcagcctcaaactcttaagctcaagtgatcctccggcctcagcctcctaagtagctgggactacaggtgtgtgccattacgcccagctaattaaaaaaaatttttgtagagatgaggtctccctatgttgcccaagctggtgtcaaactcctggcctcaagcaatcctcttgccttggcctcctaaattgctggaactacaagcatgagccactacacacagctattttggtgtatttctaatatcttttagatgcatataattttttatttgttttgtcaattaccaccatggcctaaacaatttcctatgttgttaaaagcttattttactgactacactcatgacgtttttaatagtgcattgaaattttccaataaatttcacagatatattgggagtagacatagcagagggtatggtagcctcagattagcctgggtgtaatcttggaaggaggcaactgccttgctgctccctctacttttgcctctcctgtagccaagcctcaggagaggcttttctgcatggtttccagggtttggtttgtgagggaagaagatgagggtaaagtcaactcaaacttcatcatagcattgtgcccactttgccctgtcactgccattctccagcagaaacactttggacaccaacacatgctccctcttggagaaactttctagtttgggtaaaaagaccaaaaagtgggaaaaaattaattagaaatatggagatcatgggtggaaggagctaccatggcatgaccctgaaagccctcagcatattctggcatggatctctgaggaaatacaagatgacctctgtgtgaggtgtttttcatgttggttggaattttcactggtaagaacacaagtacctttaagctttggccagaaggtttcagatcttgaataaacccaaactcatttgtgctttttctaagtagaatagtcaggttgaacctgtggatcaacagttgacattatgccaaccaaaatatttctctttttggaagcaactaatgagtttcaataattcttcttgagtctttctcacataaggaaacagggcacatcattaaaactgccctggaggaaattatatgataatctttgtaaaactaacattccagaagggaggggactttaccaatgcaggggattattaatagctattttgtgccttcagatggcatgatgctttatgtgttagtgaatttcacaggatcacatatgtgcaagggggccaggctcggatcaagggggtatgtggctgctggctctgatttttgttctgctgggccttggtggaagcaaccagttaggcaaatagagccaggcacactatccttaatgtattagacaattggtaattctttgttgtttatgatgataggtttgataggaatctctggacatggagatagaaaaccaggtggctctaccatttattagttctataactatagacagattacttgtctcacctgaacctccatttccttatctgtaaaatggaaatacaatctctttcaataagttgttatgaaatctaaataagataatatatgtaaaagtgctagacatggaaaaatattttataatttttaaggtatattattattgttgttatgattatcattactagtaagtttaatcatggaagacttatggactgactagtaaactaggataacttagtggggatctgtggtttggagtctcaaaataataatgaaagcctaaatgtcagaccttttttttttcccctgagacggagtttcactcttgttgctcaggctggagtgcaatggtgcaatcttggctcaccgcaatctctgcctcccgggttcaagcaattctcctgcctcagcctcctgagtagctgggattacaggtgcctgccaccacgactggctaattttgtatttttagtcgggacagggtttctccatgttggtcaggctggtcttgaactcccaacctcaggtaatccgcctgccttggcctcccaaagtgctgggattacaggcgtgagccactgcgcctggcccagacctttattttacacacacacacacacacacacacacacacacacacacacacacactgcagtttgtttcactgaagacattgggacttggtttcaattagtttctggttcaaacaattagttaatggcaggatcaagatgataaaccactgttttggccaggcacggtggctcatgcctgtaatcccagcactttgggaggccgaagcgggtggattacttgaggtcagcctggccagcatggtgaaaccctatctttactaaaaatacaaaaattagctggacatgatagctggtgcctataatcccagctacttgggaggctgaggcaggagaatcacttgcacccagaaggtggaggttgcagtgagccaagatcacaccactgtactccagcctgggagacagagcgagactctgtctcaaaaagaaaaaaacagcaaaaaaatgataaaccactatttcaagtaaatgtgaaataggactgagcgttgaagcagcctgaatctgacattaaatcctatggtgacctatcacatggagacacagaggcttgcgggcaaataactgaagttcttgataactaagcttgatggaggacacagagagattgttcaggctaagaatcaccaatggatttttgtcattttaatgatattattaatctgtaaaggtattgtttagaaaacattgccatcatataattcttgttaattgcttaggataataaataatatctgccatttattattaatcacccattacatgccaggcattctacttaaatcatgtcacttaatcccttcgaccatctggaaagtggcactactgtcccattttacagatgaaatcaaagctcagagacactagggaacttgctcaaggtcacacagtgggtaaatgtcagagccaggattctaattcacatttgtatgacactgaagctcaggccctttctatcacttacagttaatgagtgtggatgacccagagactaagattgtttccttcatggccacatctttaatttctgccaatctgaaaacaaaacttctgcacaagcgttagtgtccttaaccagagctgcttgcccaacacagtccacaccattaagattctctactgcaaacagggctttcgatccttcccttttacagtgaattcacactcagtttgaccccagctctccaaagctttctatctgatcttgttttctgttttcaattttcataagcatgtcagattcctttcttgaatgtgaaggggaggaaaagaatcattatataggccgggcgcggtggctcacgcctgtaataccagcactttgggaggccgaggcggtcggatcacctgaggtcaggagttcgagactggcctagccaacatggtgaaacccagtctctactaaaaatacaaaaaaattagctgggcgtggtggcgggcacctgtagtctcagctacttgggaggctgaggcaggagaatcacttgagccagagaggcataggttgcagtgagccatgatcacactgttgcactccagcctgagcaacaagagcgaaactccatctcaaaaaaaaaatcattatataaagtcaaatatggataccttttgtttgaataaacatgagagattagggcaaacactcaggttaaataggatatgactactgcttagggttaaagcatgacaataaatatttttagacaactaactgaaagacaggtctgtcctctcattttcctgagacccatatacatacttgaacattaagcaacgggtcctggagagggaggtaagaagtatttcacatttctacaattttgctgaaataatcttacatgtagaacatacacatcatgcttttatttggaaaacctcattccacatggagggcatttgggctgtgacggggtgggcagatgactaagtcggagtcagaacatctctatttgagctctgtaacttcctgactatgcagcctttggcaaatcacataatcattctgaatttcactttcctaatcagtaaaatgtgactaacaacagctgtccctgactactgcagaaggatagtatgagggccaaatgggagaagagatgggaaagggctttctaaactgtaaagtgctgggcagatgttaagagttaatgtcaactcttggagaacatcctagctttgtgtattactatgagtgagaaggtggcaggctgcggaggtggtggtggtgtgctaaggaggatactggcagtttttatattcagatgctaaatcacagctgttgggcaggcagaaagccagggcaaagcctgctctctctagctgcacctgaaaccccagtttcctctacactattcactaactgccctgcctatgagcagggaagtgtaaggcccttcacctcccacaatcacaagcaggagggaagaagccagcactgagccacagaaaggctgagtcactaataaaaactaccatttatcaaatgcttactatgtgtcaggcaagatgctaagcattttacatatatgatcttatctatttctcatatcagcaaataaagctggtctgattattatccccattttacagatgaggaaagtgagagtcagagaagtcaaatgacttgcctacgattgtaattagacaggagtctctaccaagagtcaaatccaggagatctgattgtaaaacccacatcctcaaacactaagctatactgcaacttctggttgcaacctcacatgctcagcttcctgccaccaaacacaactccattggtggtatccagttccaaagagagcaaatacagaaaaggactttgggcgctgatgctggccgggcaactccatttcctactcaccacgcagacctcccttagtacaataatgtcctaacttgaggagtgaccaggcatttacctggtaacctgtatcttctcaatggggaaagaaaaggagagcaaaatatgtttgtgcctcgagtgtctggctaatagttgtcataaagttgtttaactctagttaggccacagcagaattagagttataatttatttttttttttgagacagagtcttgctctgtctcccaggctggagtacagtggctcagtctcggctcactgcaagctctgccgcccgggttcacaccattctcctgcctcagcctcccgagtagctgggactacaggcgcccaccgccacgcccagctaattttttgtatttttagtagagacggggtttcaccacgttagccaggatggtcttgatctcctgacctcgtgatccgcccgccttggcctcccaaagtgctgggattacaggagtgagccactgcacctggccagaattagagttataattaaggcaggacgtgccaaggtgatcacagccaaaggtcccactgtgacctgggaatgcggttgttgttagcagcggcaacaactggtacttcacccaatccctcatttccatagatcaacacaatctccatctatagcaaacatttacttagcatctgtggagtgccatgctcaacgtcaggtgccaggaacatacacatgataaggcactttgacatgagaaaaagcagtagaaggaagtatataataataacagattggtgcttcagaaagtacatgaaattgaattctgaagaggaggtgatatggtttggctgtgtctccacccaaaccttatcttgatttgtagctcccataattcccatgtgctgtgggaaggatctggtgggaggtaattgaatcatgggggcaggtctttcccatgctgttctcattatagtgaataagtctcacaccatctaatggttttttttttttttttaatttttattttttttattgatcattcttgggtgtttctcgcagagggggatttggcagggtcataggacaatagtggagggaaggttggcagataaacaagtgaacaaaggtctctggttttcctaggcagaggaccctgcggccttccgcagtgtttgtgtccctgggtacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttatcttagtacagaacaaaatgaaaagtctcccacatctacttctttctacacagacatggcaaccatccgatttctcaatcttttccccacctttcccccctttctattccacaaaaccgccattgtcatcccggcccgttctcaatgagctgttgggtacacctcccagacgaggtggtggctgggcagaggggctcctcacttcctagtaggggtggccgggcagaggcgcccctcacctcccggacggggcggctggccgggcggggggctgacccccccacctccctcccggacggggcggctggccgggcggggggctgaccccccccacctccctcccggacggggcggctggctgggcagaggcgctcctcacttcccagtaggggcggccgggcagaggcgcccctcacctcccggacgggtcggctggccgggcggggggctgagccccccacctccctcccggacggcgtggctggcccggcagaggggctcctcactccccagtaggggcggctgggcagaggcgcccctcacctcccggatggggcggctggccgggcggggggctgacccccccacctccctcccggacatggggctgacacccccacctccctcctggacggggcggctggccgggttgggggctgacccccccacctccctcccggatggggcggctggccgggtggggggctgactcccccacctccctcctggacggggtggctggccaggcagaggggctcctcacttcccagtaggggcggctgggcagaggcgcccctcacctcccggacagggcggctggccgggtggggggctgacccccccacctccctcccggacggggcggctgccgggcagagggactcctcacttctcagacggggcggctgccgggcggaggggctcctcacttctcagatggggcggatgctgggcggagggtctcctcacttctcagacagggcggctgggcagagacgctcctcacctcccagacggggtcgcggccgggcagaggcgctcctcacatcccagacggggcggcggggcagaggcgctccccacatctcagacgatgggcggccgggcagagacgctcctcacttcccagatgggatggctgccgggaagaggcgctcctcacttcctagatgggatggcggccggtcagagacgctcctcactttccagactgggcagccaggcagaggggctcctcacgtcccagacgatgggcggcgaggcagagacgctcctcacttcccagacggggtggtggccgggcagaggctgcaatctcggcactttgggaggccaaggcaggcggctgggagatggaggttgtagcgagctgagatcacgccactgcactccagcctgggcaccattgagcactgagtgaaccagactccgtctgcaatcccggcacctcgggaggccaaggctggcggatcactcgtggttcggagctggacaccagcccggccaacacagcgaaaccccgtctccaccaaaaaagtacgaaaaccagtcaggcgtggtggcgcgtgcctgcaatcgcaggcactcggcaggctgaggcaggagaatcaggcagggaggttgcagtgagccgagatggcagcagtacagtccagcttcggctcggcatcagagggagaccgtggaaagagagggagagggagaccgagagggagaggggagagggagaggcagaggcagaggcagaggcagagccatctaatggttttataaaggggaattcccctacacaagctatcttgcctgctgccatgtaagatgtgactttgctcctcctttatgtgaggcctccccaggcttgtggaactgtgagtgaattaaacctctttcctttataaattacccagtctcaggtatgtttttattagcagtgtgagaacagactaacacagaaggtggtgacaatttgggatggagtagtcagggtaacttttatgaaggagggagtgaataagactttgaaggatgggtgagacttgactaaatgagaagggatgggattgaaagcagaaatgtcagaagagatgatattgtgggagaaggtctagtgcaaagataggttcaaaacaagtgagagtgagcactggtgtgttagtatgctttcagctatttgaagtagaaatggcttaaaccaattatttttttcacatagtccagaggtaaaatgggcttctgaattgcttgattcagcagtcaaagtgtgccatgaaagaaccaagtccttttcatgtctctgctctgcagttcacagagtcatcgcagagtcaggcaatatgctcccttgttcacatccaacgagagagattgatttatctttcccagaaatcgcaaactagcccctctctgtatgtcattggctcaggctggcttgggacctgcttattcctaaaccaatcattgataaaagaaatgaaatattttaattggcttagactggtggactaaaactttagcctccattggagggcttgtaaaaacatattgctgcctgccctactccagagtttctgactcagtgggcctggggttggaattcgcatttatgatgcattaccatgtgatgctggtgctgcaggtctggggccacaagtttactttttttttttttttttttttttttttgagacggagtcttgctgtgtcacccaggctggagtgcagtggcatgatctcggctcactgcaacctctgcctcccaggttcatgctattctcctgcctcagcctcccgagtagctgggactacaggtgcccaccaccatgcctggctaattttttatattcttatatttttatttttatttttatttttatttttttattttttttttgagactgaatctcgctctgtcgcccaggctggagtgcagtggcacgatctcggctcactgcaagctccgcctcccaggttcacgccattctcctgcctcagcctcccgagcagctgggactacaggcgcccgccaccgtgcctggctaacttttttgtatttttagtagagacagggtttcaccgtggtctggatctcctgacctcgtgatccgccctcctcggcctcccaaagtgctgggattacaggcgtgagccactacgcccggcctttttatatttttagtagagacggggtttcaccatgttagccaagatggtctcaatctcttgaccttgtgatccgcccgcttcggccttccaaagtgctggaattacaggtgttagccaccatgcccggcccccttttttttttccttttttttgagatggagtcttgctctgtcacccaggctggagtgcagtggcgtgatctcggctcactgcaacctccgcctccggggttcaaacgattctcctgcctcagactcctgagtagctgggattataggtgtgtgccaccatgcctagctaatttttttttattttcagtagagattgggtttcaccatgttggccaggctggtcttgaactcctgaccctgtgatccgcctgccttggcctcccaaagtgctgtgattacaggcgtgagccattgctcccggaccgcaactttcaagaccactattgcaggataattaattgaggtggaatagatgttggggtatcaatccatggtctcctataaatgtcctggtttgcctggctgagctggtgtaattatgtccccctttactgtcaaaagtgttctggttcttttcttttcttttctttttgagatggaggctcactgttgccaggctggagtgcattggcacgatcttggctcactgcaacctctgcctcctgggttcaagcgattctcctgcctctgccttccgagtagctgggactacaggcatgtgccaccaagcccagctaatttttgtatttttagtagagacggggtttcatcatgttggccaggatggtctcgatctcttgacctcgtgatccgcccgccttggcctcccaaagtgttgggattacaggtgtgagccaccgcgcccggccggttatttcatatataaattatgtgatcaccttaccacacagggctttgagttcaagtcaaggttctttcactacaagtgaacacaggagagtgaaccagtattggtcaataaaatgtgtgattccaattgggagatctcttcttttttccttgtccaaggatctataagagacagagaaaaaagccatcagtatcaatcatatttcacattaagtatcctgactgatgtgttttaagggcattgcttttaatttatatggaaactattcttataaatatagcttttgctatcctttttgcttaacattcttaatagcatgatttgatttataaaaaaataaggcattgattgcaactaattcattttatgtcttaagttcattgacttatagttttacaaaaatgtgaaacgtgtattaagctaaactatcatagttttaaaacattggtcatggctgagcatagtggctcacacctgcaatctcagtactttgggaagccagggtgagaggattgcttgaggccaggagttcaaggccagcctgagcaacatagcaagaccctgtctctaccaaaaaaaaaaaaaaaaaaaaaaaaatagcaggcgcctgtattcccagctatctgggaggctgaggcaggaagatcacttaagcccaggagtttcaggctgcagtgagctttgattgtgctactgcactccagcctgggtgacagagtgagaccttggctgcaaaaaaaaaccaaaaacacactttggttataatgcaggtcacagttaaacagagttcagaaatagtgtttgttgccaagtatttctggttcatccagaactaagagttttttattgaaaactaactatatctggcaatcttagtagaggccatgtaatttctgagagcaaatagtgaatacatatttttgtttttctttcttaatctagtttctttttcttgtttttttctacctaaaggttgccaaagactaagtttgaaattatcttacatattagatacctccaatcttgtcatggaattagatgtaatctctttaaggtctttcttcagaaattgattgcaagcagtttgggatgccacttaagaatttgcttaaaccacttcctcccaaccccacaaaaaatcacaaacccaagcacaatccagatgagaatcataaacgtctcactgctctttgcaacagcatgaattgtgaaattttagttaatccaagaattttttaatgttgttgttttaaaccttttattagattttcttcttatgccaaaataaccacatatggttccaatccttcaggataaggacaatttggggtaagtctaatagaatagcaacatttaaaaagttcaaatatggtagaattgttttgtttatatggtagagataaatttttgagttagagagatctagcggtcttctgttctaaacttacattcattgtaggaacctcctcaacatccctgagagagagggttctttaaactgaattattaattccagtaatagagaagctgcagcctgacggggaggggtggcattggttttattgttgaaccgctttagctagttttcttacagtgagttacacagtgtctcccagtacagtttgtgttagaggactatagactatgctatagactgtactgtaccctcctcaaattgatttgttgaagccctaactcccaacgtgactgtatttggagatgggccttttaggaggtaattaaggttacatgagttcataagaatgggatcttggccaggcacagtggctcacgcttgtaatcccagcactttgggaggccgaggtgggtggatcatgaggtcaggagttcgagaccagcccgaccaacatggtgaaactccgtctctactaaaaatacaaaaattagccagtcgtggtggcacacacctgtaatcccagctaatcaggaggctgaggcaggaggattgcttgaacctgggaactggaggttgcagtgagccgagattgccactgcactccagcctgggtgacagagcgagactctgtctcaaaaaaaaaaaaaaaagaatgggatctctcgacggaaaggccatgggaggacacagtgagaaactgtggctatctgcaaaccaagaagagagccctcgttataaaccaaattggccggaaccttgatgttggacttcccagcctctagaactgtgagaaataaacctctgctgtttaagccaccactgtggtattttgttatggcaatatgagtagactgagataggctatatgtaatgccttttcttatttttttatttatttgttcttgagatggagtctcgctgtgtcacccaggctggagtgtggtggcacgatcttggctcactgcaagctctgcctcccaggttcatgcccttctcctgcctcagcctctggagtagctgagactacaggcacccgccaccaggcctggctaatttttttgtatttttagtacagacagggtttcactgtgttagccaggatggtctccatctcctgacctcgtgatctgcctgccttggcctcccaaagtgctgggattataggcatgagccactgtacccagcctgtactgccttttctataccacatttctcagctatcaagccaatcctaacacatctattctttaaaattaaacttcacaggccaggcacagtggctcatgcctgtggtggatcacctgaggttaggagttcaagaccagcctggccaacatggtgaaaccctgtcgctactaaaaatacaaaaattagcctggcatggtcgtgggcacctgtaatcccagctactcgggaggctgaggcaggagaatcacttgaacccaggaggcagaggatgcagtgagccgagaccacgccattgcactccagcctgggcgacatgagtgaaactctatctcaaaaaaaaaaaaaaattaaacttcatggtgagttccatttttctttatttgatacaatttccagattgttgttccaatttgctgcccactttgagatcacatcagtttgtgtctacctcatcaaaatgatgatgtctagaactgaacataatattttaagtgaattctgattaatgcagaatatattaaaacattactttctatgagctgaattccatatcttcttgtgggccacacataatatagtgttggttttgctttttcagaaaacacattatatgcaggttaaacttgttgtcacataaaatatgcatatttttaagatgagctttttttctgggccttgtaatccagtaggcttttggattaccaagtgtgaaacatacgaaaaagtgcgaatgtttagaggaaccaatatttcaccatgcaggtgtgaactccaaaaaaagaaagaagcaacaacaaaaaccaaaaaaaaaaaaaaaaaaagggagataagatgttaactccaagagctagttggtttaatggtaaaatgaattctgtatttgaaacctgccctagtacacataacttcgtactcaaaaattgacgctgtataaaaaacgttagactgagtgttagaagagatgaatttaaatcccagctttataagtgatgagctaagtggctcttgggaagtcacctactctttctaagcctgagtctccttatctctttacctgtaaggagttgtagcatacctctcctaacatacaggaaaacacatacacacaaacacatgccaccagttaccatctactctcacgagtattttaccaaataaaaacatttaacaccaaaaaaaggaagaacaacagaatttcaggatgacaattggcaaatatacatgcacatttcctttaaggcctggtgaaaactgtcacttactaaaggaccttttggaaactactgaactagatcatctctaaggtcttatctagaccctcaagttgggtgtggggcatctgaacactggatagtagtgagatgatagatttgggggtgtaaagttattcattaatctattcatgtgttaaatcaacaaatatttattgaatacccactatgtgccatatatttaaaagctgggatatatcaatgaacaaaatagacaaaaatgcctgtcctcacggtacttatatactggagggaagagacagaaaacaagtagtaaacataaaacagaaggcaattataggctgggcgtggtggctcacgcctgtaatcccagcacttggggaggctgaggtgggcggatcatgaggttaagagagcgagaccatcctgggcaacgtggtgaaacctcatctccactaaaaatacaaaaattagctcggcgtggtggcgtgcgcctgtagtgccagctacttgggaggctgaggcaggagaattgtttgaacctgggaggtggaggttgcagtgagccaagattgcgccactgcactccagcctggcgacagagcaagactccgtctcaaaaaaaaaagaggcaattatatacagtgtactactttggaagatgctgactgccatggaaaacaagagaaagcagagcaggcagggtaggcagggagtctggggacatttttctggtcacagcacagcaaggagcactggatctcattaacatgataggcacattttttggcttctacttattgcctcaaacctagccatgagtaaattgattaatttagaaatttattacttatttcacatatttaatatctctaatgcagggttgttgtagatcatagtaattaattcagcttgggaaattgtcactgagttatttatttagaataacagcttgtgattttattagcggtgtatctgattttgaaaatgccttaattcaatcaattgattaatcatttatcatttagtcaataaatatttatggattgcttgttatgcagaaggctgaattatatgtgcatgtattaaagttatagctatagaattattaagtctagaattcctgagtgtttataaaggtggaattaggtgctgtgaagtattacagagttaaaaacggcaatatttttaacccagagaatatagcgtatttgtttgctaatttgctttagaattatctaagaacaggttagttgatctcacaatacttctctggtagatagggtagcatattttccttattgcatatgtaggcagacttgagattccaggaagttagatgccttatccttagtcacttagggagtgtagtgtcgatatcgcaacgaggaccttaggtttcaggggtcgttgtttagcaatatctgatcttgagccagttggtataagaggacacatacctttggttcctgatctctctgggagacgggggtcctttaatgtgcccacccagagctccccttccacagcacccacctctttctggattctacatctttgatgccaaaaggcctcagattgcaaaaattatttggtgcttcaggtcttctgtctcagcgaatggggttcaggcctccctctggtctaggtgttggcaagtacagaaggaaggtggaggggtaagaaagggggcagaggaaaaggccaaaagagaaactaccatgttcatttcagctctttcttcttcctgcagctcgcagcttactaattattcttctccttcccaattacagaaaaaagagaaaggatcatcataaagagattctagaaatgtgaccttgaccatttagcttttgggaatgacatgtctagccttaacttttggacatttttagctagcaattttcaacttggttacaaaatgagcagaagaagtattatcctatgaaggatatttttttttttgagtcaaagtctcgctctgtcgcccacgctggtgtgcagtggtgtgatcttggctcactgcaacatctacctcccgggttcaagcaatttgaaggagatgtattaaaaatacctgaagggagccaggcatggtggctcatgcctataatcccagcactttgggaggccaaggtaggcaagtcacttgaggtcaggagttcgagaccagtctcgccaacctagtgaaaccctatctctactaaaaatgcaaaaattagccaggcgaggtggcgcatgcctgtaattccagctacttgggaggctgaggcaggggaatcgcttgaacccagaggcagaggtttgagtgagctgagatcatgccactgcactctggcctgtgtgacagagtgagacaagactccgtctcagaaaaacttaaaaaataaaaacaaaataaaaataactgaagggaggttgtcaaaatatggatctcccccgtctcccaggatctcattctagcaaaagttctcagtcttggctacatattaaaatcacctggagaacattcacaaaatgcccaggtatacagcctacctctaagaggcattctgagttcattgttctgggatataatcctgctgatattgtattaaagctccaggtacttttaaggtgcagccaggatcactgccccggcaatcctgaattactgacaggagtgtgtcctaatcctggtgtgctgcccccaggtgtgttggagtgtggagaaaaaaactcgagaaccattaatccagtgtttctcaaagggtggtctgcagaacagcagcatcggcatcacctgggaacttactagaaatgcaaattcttgggcctaactccagacctactaattcagaaactctcagggtgtgacccagcaatctagggtttcaggagccctcaggtgattctgatgcatgttgaatttcagaaccactgtcctaatctaacctgtagtattctgaaatgataatctgaatataattgagttagataccttcttttctgataaaaagaacattatatctataagcaggtgtagggagctttgtttagctaaagaaattaaagtgctatgataggaatgttagacattaactagaaaggaatctgggaataggggcagaggttgttcatgattttctttttgaggtacaggatccttcccagaaaaatcacaccatgtggtcagccatcttctctccttgagctaaagctctttttgtgttgactatgagtttatattttaacctactccaggcaaactcttccccataatcaaataaagttttcaaagacagtgaagattagcaaacaaagccttgcattagacagaagggctgggaaacactaaaagcaaccttgagccaagatgtctccctggtaatccagcaggtccaccactaggatagtaaataactctgatgacatcatggcatgatgtctggtgactctcggtcaccacagtaggggcagaagagtgaggttttctgatccactgatccatttggtccttcagtgacccctttggcgctgatagaatcttttttttttttttttttttttttttgagagagggtctggctctgtcacccagactggaatgcagtggtgcaatctcggcttactgcagcctctgcctcctgggctcaagtgagcctcttgagtagctgggatgacaagtatgtgccactacgaccagataatttttgtttttttgttttggtagagatggggcttcaccatatattgctcaggctggtcttgaactcctgggctcaagtgatctgctggttttgacctcccaatgtgttaagattacagatatgagccactgtacctggctcatagaattttttttttttttttgagacggcgtctgtctctgttgcccaggctggagtgcagtggcacgatctcgtcccactgcaagctccgcctcccaggctcacgccattctcccgcctcagcctcctgagtagctgggactacaggcgcctgccaccacgcctggctaattttttttttttgtatttttagtagagacggggtttcaccgtgttagccagcatggtctcaatctcctgacctcctgatccgcctgccttggcctcccaaagtgttgggattacaaggcgtgagccaccgcgcccggtcagctcatagaatctttagagaagaatctttgtaggtgggatgatacgtgcttctggacatcatgtgaatcatcatatttccagcttttaagcatattaatgaggatttgaacaatgtcttaaagcaggagtactgttttattatgaaagaagcttcctagttgacaaacttttcatacagagtcaaacttcattctaatggcaataattattatattataagaaactggggggccgggcatggtggctcacgcctgtaatcccagcactttgggaggccgaggtgggtggatcacgaggtcaggagatcgagaccatcctgactaacaccgtgaaaccccatctctactaaaaatacaaaaaattagccaggcatggtggcgggcgcctgtagtcccagctactcgggaggctgaggcaggagaatggtgtgaaccgggaggcggagcttgcagtgagccgagatcgcgccactgtactccagcctgggcgacagagagagactctgtctcaaaaaaattaaaaaattaaaaaattaaaaaaaaaaaagaaactgggatcatgttgaatttgcctgaaacaaatccaaggagttagattgcttcagaggtcacctgatagaaatagctcataaattccctaggagtaaatcactcttactaggcctgaagacatgcttcaagtcagaatgtgatagtaatgattcactctgggatttcatttcaagccacaggaactaaaaatgcaagtacagttcccaatgcgaaacgcaacctgtaatcttaatccatttaacttcctcaaattgctgtattactcaaaacagctgatttcttcattgagcatagatgaatttcctctgtggcaaatgtcaccatctgacccaaggatatgtctaggccctccttaccacctgtgagctctccttcaaggaaaggccgttgagcaagcccaattggtctagttaagagcctgtgctttggaatcacttaagagcctgtgctttggaatcagattacctgtgttggaatctaccaatatggcttggtaggagcgtatttttggatgtatctcttaaccttcctaaactacaattccctcaactggaaaatggagaaacaataatactgacgtcatagtatcagcagttgcacaggatctagtataaaggtggtcaggtataaaagtggtcaataaatattagttcttatttaaggaggtaatattataatggttaagaggaggattttaaggccaaattgtctagttcgaatcccaattctgccacttactttgtaaaagttacctaatcacttggggccaggttgaggacaggtgcctgggaaacaccgggaagtactccagggaataaatgagaggctccaatttttatttttatttatttatttattaaggcggagtttcactcttttgcccaggctggagtgcaatggtgcggtctcagctcactgctatctctgcctcccgggttcaagtgattctcctgcctcagcctcccaagtagctgggattataggcacctgacaccacgcccagctaatttttgtatttttagtagagatgggggtttcaccattggccaggctggtctcgaactcctgacctcaggtggtctacccaccttggcctctcaaagtgctgggattacaggcttgagccaccgcacctggcagaggctccagtttttaaagaaaaaaggacagctccggaaaagggattgaatgcaaaagttgttcatcaggaattctcattagtttacaggaataacactgaatagtgattggctatacattgctgaactgtaggctatgagttatggtgtccaggatatggcattttttggctcctttgtgtcagtctagagctcatatagcaagtggcttcaagaagtgattcctgggccgggcgcagtggctcacgcctgtaatcccagcactttgggaggccgaggtgggcggatcacgaggtgaggagatcgagaccatcctggctaacacggtgaaaccccgtctctactaaaagtacaaaaaattagccgggcatggtggcgggcgcctgtagtcccagctactcgggaggctgaggcaggagaatggcgtgaacccgggaggcggagcttgcagtgagctgagatcatgccactgcactccagcctgggagacagagtgagactccatctcaaaataaaagaggtgattctttagcttgagggaagagtgatagtcctgtcacatttcaaatgcctctctgggcatgataatttaaaggggcttgcatgcctcagatgcaaatttctttttctttcccatagcacactaggagagagtacaaatgaggcccacctatcgtgttttaaatacttagaagttgtacatcaagttaaataactcttaaataaaatgttttctgttctcctatcttgacaaatataccttcatagcaaactaggttcaggttcaaatgtagaatttttagagttccacaccagaggtgggaggaacagagggagccagcccctggacactgggttctggcctccagctacttctcttacccagcttcttcctgcacccagccctagtatccagggctccccagcccccgtcccatacacatacctgtggtaacagtgtgctacctggaaatctccagggaagtgccaggtagatgctctggaagttggtgtgcgctctttcggcaaaagaaattccagagtcagccgggcacagtggctcacgcctataatcccagcactttgggaggcccaggcgggcagatcatgaggtcaagagatcaagacaatcctggccaacatggtgaaaccctgtctctactaaaaatacaaaagttagctgggtgtggtggcacacgcttgtagtgccagctactcgggaggctgaggcaggagaatagcctgaaccaggaggcagaggttgcagtgagctgagattacgccactgcactccagcctggtgacagagtgagactctgtctaaaataaataaataaataaataaataattccagagtccaggaatgcattctgaagtggagtattatggactaaatgtttgtgtcccccaatattcctgtgttgaagccctaacccccagtgtggctgtatttggagatagggcctctaaaaaagtaattaagattaaatgagattataaggatgaggttctgatctcataggcttagtgtccttataggaagtgacatcagagagcagtctatgcacaggcactgaagaaaggcatgtgaggacagtgagaaggggtcacctgcaagccaggaggagggtcctcaccagaaatggactatgctggcaccctgctcttggacttcccagcctccagaactgtgagaaatacacttctgttgtttcagccacccaggctgtggtactttgttatggcagcctgagctgacagtgagtgtggggctggttcctgggggacacacccctgcagactccttggtctgtgaggaagaaaggcaaccagagaaaagctagagtctcctctaaagagcaggccttggtgtagggacccccttgagctgcaaggacagaacagctcttcaaaggtgctcagggagaagtggagaaatgttgaatttcatgtatacttggcctgggcagacagactcaatgtggaaatttaagccaagaactaagtggacctgacagttatggtcacaggctgtttggctagaaattatcttagaggtcatctagccctcatacagttagagaacagaactccagggactttccaaaggttgaacagaaacttgttgagatcatggctctctaaaatctcaggcatatacctttgtatgtgttaggttataaaagtttcccaatttgtggattaactttcagaggcctgctgaatttgctaggaggagaactttgaagaatgcattaagaattcttgcttcactgcaggccagagctacttgtgtttgcctaacctggagctgatgaaacaaagcatctggttaaaaaattatacataaggccgggtgcagtggctcacgcctgtaatcccagcaccttgggaggccaaggcaggtggatcatgaggtcaggtgttcgagaccagcctggccaacatggtgaaactccatctctggccaggcgcagtggctcatgcctgtaatcccagcactttgggagcctgaggcaggcggatcatgagatcaggagatcaagaccatcctggctaacacagtgaaccctgtctctactaaaaatacaaaaaattagccgggaatggtggtgggcgcctgtagtcccagctactcgggaggctgaggcaggagaatggtgtgaacccaggaagcggatgcagtgagccgagatcgcgccactgcactctagcctgagcgacagagcgagactccatctcaaaaaaaaaaaaaaaaagaaaagaaaaaaagaaaaaatgctcaacgccactcactgattatcaggaaaatgcaaatcaaaaccacactgagatattatcttcccccagttagaatgggcattattaaaaagacaaaaacaaaaacaaaacacagatgctggcgaggatggggagaaaagaaaactcatctccactgctggtgagaatgtaaattagtacaaccactatggaaaacaatgcagagatttctcaaagaactaaaagtagaactaccatagcatccagcaatgccactactgggtatttattcaaaggaaaagaaatcagtatattaaaaagatacctgtacttctttatcaaagcactattcataatagcaaagatatggcatcaacctaagtgtccatcagtaaatgaatggataaagaaaatgtagtatatatatatatatatatatatatatatatatatatatatatatatatatatatacacacacacacacacatatatatatatatatacacacacaatggaatactattcggccataaaaagaatgaaataatgtcatttgcagcaacatgggtggaactggaagtcattatgtgaagtgaaataaatcggcacagaaagataaatattgcattttctcactcatatatgggagctaaaaaagttgatctcatggaggtagagtagaatgataggtaccagaggctgggaagagtgtgtgggtgggtggtgaggattaagagaggttggttaatggtgaaaacatacagttagatagaagggataagttctaatgttcaagagccgagtagtgtaactatagttagcaactatgtattgcatatttcaaaatagctagaagagaggacttgaaatgttcccaacacatagaaatgataaagactcaaagtgatgaataccttaaatatcctgacccgatcattacacattttatgcatgtaacaaaatatcacatgtaccccataattacgtatcaaaaaatgatcagaaagtataaacatatcttactcaggctttgcctgtgcttatccaatgaaattatttttaagacagaaagcaggccaggcacggtgcctcacgcctgtaaccctggcactttaggaggcagaggagggtggatcagctgaggtcagaagttcgagatcagcctggccaagacggtgaaacctcatctctactaaaaatacaaaaaattagccgggcatggtggcggatgcctgtaatctcagctacttgggaggctgaggcaggagaactgcttgaacccgggaggtggaggttgctgtgagccaagatcacaccattgcactccagcctgggtgacagagtgagactctgtcttaaacaaaaagacagaaagctgatatattttatcttttcccagtagagctccaagtttgcagatgttttctgcttacagcttgggcagtccaggtagtttccaaacctctctcttctatttccaagacagaactgcggcccttttccttcacagtagctctgccttggacagaaatgatcaagggccactaccactgctcttaggtttgagtagataagatttgggggggtatctctaactggtattccatttatctccccaaaagagtaaaagtggctcaaaataatgttccaaataattttctcaaaacaatataaggttcattggctttttctcattataaaagacatttttgttctgttttgttttgttttttgagatggagtctcgctctgtggccaggctggagtgcagtggtgccatctcagctcactgtaacctctgcctctgaggttcaagtaattctcctgcctcagcctcccgagtagctgagactacaggtgcgtgccaccacacccagttaatttttgtatttttagtagagatggggtttaccatgttggccaggctggtctcgaactcctgatctcaagtgatctgcccaaacttggcctcccaaagtgctgggattacaggcatgagccactgtgcacagccttgttttgtttttgagacagggtcttgttctgtcagccaagctggagcacagtggcactatcatagctcactccagccttgacttcccagggtcaagtaatcctcctgcttcagcctcccaagtagctgggactacaggcatgcaccaccacacctggctaatttttaaatttttagtaaagaggaggtttcgctatgttgtccaggctgatcttgagctactgagctaaagtgatcctcccaccttggcctcccaaagttttgagattacaggcatgaggcaccatggctgtccaataaatattcttaacatgattatctatttctaattctaagatccttagaattgattcttagaagtggagttactatgaaagagccttaatacttcaagtcaaattgcttttcgagaggcattaccattaattccagcaacagcagtgtagaatagtgcctgtttcactacgtcctcctggatagactcttgcctattagtgtagcactgggatctgacttctgaatcagcctgtctagaattgaattccaactcgaccacttcctagctgtgtggattgggaaaagttgcttagctgctctatatcttggtttatctttgttcaaatgggcatagtaatactgcctacttcatagagttattatgaagtttaaaataatatattacaggtactcaataaaggctagtctattacattaataaaattatcttctaatatgacatgtgaaaaactgtacttcattgttgccttaaattgcattctctaattactactgattataaactttaaaaatgtttattggctaatttgtgtgtgtgcatgtctgtgaattgactattcatttccattgacttctcctaattgtggctggtgttttcttgttatagatttgttggagctctttatatattgacattaatctcatgcatgtcatatacacaagtagttttcacagtatttaatttgcttctaatctttatgattttgggggttatataaatgcttaaatttctatgtagtgaaaagtgaaatcaaatatgataatgttttctttgactttttttttttttttgagacagagtcttgctctgttgcccaggctggagtgctgtggtgtgatctcagctaactgcaagccccgcctcccaagttcatgccattcgcctgcctcagcctcccgagtagctgggactacaggcgcccgccaccacgcccggctaacttttgtttgtatctttaggaaagacagggtttcactgtgttagccaggatggtcttgatctcctgacctcgtgatctgcctgcctcgacctcccaaagtgctgggattacaggtgtgagctaccgtgcccggctctttggcttttttaattgcttttttatttagaaatccagctctcttcccaggttagtttttttgtttttgttttgtgtgtatgtgtgtagagactaagtctcgctatattgcccaggctggtcttgaaaccctggtctcaatcctcccacttcagccttgcaaagtgctgggattacaggcatgagccgccatggccagccccatgttagtttataacacataatttattattcataaattgaatttttacatagtctgaagtttgttttgaggttccctaaaagattccatttttaatcaatactactttaattattctaggtttagaataattaaatagttaattaaataataaataattaaataaaattataaatagttaaatattaactgttaattaaattacggtttatatatttacattttcttaataatatatcatttattattaattataattctaaattaaattataaatagctaattacactatagctaattaaataattaatacctgatagcctttttttaaatatttcttaaaaattcttgaatgcttattctttcagtttatttatttatttatttttttgagacggagtctcactctgtcgcccaggctggagtgtgagtgcagtggcaccatctcggctcaccgcaacctctgcctcccgggttgaagcaattctcctgccgcaggctcccaagtagctgggactccaggcgcgccaccacgcctggctaatttcttgtatttttagtagagatggggtttcaccgtgttaaccaggatagtctcagtctcctgaccttgtgatctgcctgccttggcctcccaaagtgctgggtttagaggcgtgagccaccgcgtctggcctctttcagtttattaagcatcgacagatgttaacatcttgacaagatgttaaattttaacatcatgttaagttcccacacgtgaattttttttttttttttttgagacagggccttgctctgtcacccaggctggagtgcagtggcacaatctcggctcactgcagcctctgactccctgacacaagggatcctcccaccctagccttttgagtagctgggaccacaggtgcaagccaccacacttggttaattttaaaattttttgtagagatggggtcttgctgagaggtggcagcgtgctggcagtcctcagagccctcgcttgctttcggcacctcccctgcctgggctcccactttggtggcatttgaggagcccttcagccccccccactgcactgtgggagcccctttctgggctggccaaggctggagcccactccctcagcttgcagggaggtgtggagggagaggcacgcgcgggaaccggggctgcgtgcggtgcttgcgggccagctggagttccgggtgggcatgggcttggtgggccccgcactcggagcagccagccagccctgctggccccgggcaatgagggacttagcacccgggccagtggctgcggaggatgtactgagtcccccagcagtgccggcccaccggcgctgtgctcgatttctcaccgagccttagctgccttcccgcggggcagggcttgggacctgcagcccgccatgcctgagcctcccacccactccatgggctcctgtgcggccggagcctgcccgacgtgcaccaccccctactccacggcgcccagtcccatcgaccacccaagggctgaggaaagcgagcgcacgccgcaggactggcaggcagctccacctgcagccctggtgcgggatccaataggtgaagccagctgggctcctgagtctggtggggacgtggagagtctttatgtctagctcagggattgtaaatacgccaatcagcaccctgtgtttagctcaaggtttgtgagtgcaccaatcaacactctgtatctagctgctctggtggggccttagagaacctgtgtgtcgaaactctgtatctaactaatctgatggggacgttgagaacctttgtatctagctcagggattgtaaacgcaccaatcagcgccctgacaaaacaggcctctgggctctaccaatcagcaggatgtgggtggggccagataagagaataaaagcaggcttccggagccagcattggcaacccgctcgggtccccttccacagcgtggaagctttgttctttcgctctttgcaataaatcttgctactgctcactctttgggtccacgctgcttttatgagctgtaacactcaccgcgaaggtctgcagcttcactcctgagccagcgagaccacgaaccccccagaaggaagaaactccgaacacatctgaacatcagaagggacagactccagacgcgccaccttaagagctgtaacactcaccgcgagggtccgtggcgtcgttcttgaagtcagtgagaccaagaacccaccaattccagacacattgctatgttgcctaggctggtcttgaaatggcctcaagtgatcctcctgcctcagcctcccgcaatgctgggattacaggaatgagccaccacgcctggctgacaaatcttttaaattatatatatacatatatatatatatattttttttttttttttgagacggagtttcgctcttgctgcccaggctggagtgcaatggtgcgatctcggctcactgcaacctccacctccccggttccagctattctcctgccccagcctcccgagtagctgggattacaggcatgcgccacgacgcccggctaattttgtatttttttttttttttttttttttttagtagagatggggtttctccatgctggtcaggctggtctcgaactcctgaccttaggtgatccgcccacctcggcctcccaaagtgctgggattacaggcgtgagccaccgtgcccggacttaaattagatttgacttaaagctacatattaattttgttttaggaacatggaatatttcttcatttattacaattttattttttaaagttttgccagtttgctgttgtttttgtggttgttttcacataggcatactcatttcttgctaggattatttctgtagttttaaatatttttgtattatatttgggcttattactcctattaggttgtttaacttactgatggtatatggaacatttatagattcctggatattttgtatttgatgacactgaagaactttcttaggaattctgaaaggcttgtagttgagccacgctgggttttctgagtacataatccaatcatctggaaaaaacattaatcttttccaaatcattatgtctcttatttctgtttcatgagtatttttagttgctgaaaatgtgtgaaaagtgcactgtctaaagcaatctcttttctgctctcttcactcctacaacaaatacagtgaactgaggatgaggttgggggaggggaagaaggagaggagcagggctggtgcttatctgggaagcgcagaagatgtcttcgggctgcaggcagcagtttctgtagatctaagtgctggccaggggcttcccaaggcagctgtggtctaagctactgatttgctgtatcagcgatctgccaccttccttccccttgttttcttgccctctgcctcagccttgctcctctctccccaacctcccttctcagctctgctcctctctgtctgcttcctcagtagggatatggcagtggccacagcctctgcactgaggagagaacttgtcaacatgttttttgctccagtaggagctcgttcatctgtggccaagatcagaccttggctcagtggcatgggctgcttagtgcacctaccctgatgtaattcctccctctgtccatcttccctgctcccaccttcctttgagccatcatcagctatcaccttgactcctgcaataactttctaaatggctctcctccaatacattcttttcacagggcagtattttaaaaacataaatcagaatacactcccttattaaaaacctttcagtgacttcccatagcacttagaataaacataaactccttaacgtggccctgtgtgattggtctcttccaatctctcgtagcctctttttatttatttatttatttatttatttattttttattgatcattcttgggtgtttctcgcagaggggtatttggcagggtcataggacaatagtggagggaaggtcagcagataaacaagtgaacaaaggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcacaaggcagaagaatttttcttagtacagaacaaaatgaaaagtctcccatgtctacctctttctgcacagacacggcaaccatccgatttctcaatcttttccccatctttcccccctttctattccacaaaaccgccattgtcatcatggcccgttctcaatgagctgttgggtacacctcccagatggggtggtggccgggcagaggggctcctcacttcccagtaggggcggccgggcagaggcgcccctcacctcccggacgaggcggctggccgggcggggggctgacccccccacctccctcccggacggggcggctggccgggcagaggggctcctcacttcccagtaggggcggctgggcagaggcgcccctcacctcctggatggggcggctggccgggcggggggctgacccccccacctccctcccggacggggcggctggccgggcggggggctgacccccacacctccctcccggacgcggtggctgccgggcggagacgctcctcactttccagactgggcagccaggcagaggggctcctcacgtcccagacgatgggcggccaggcagagacgctcctcacttcccagacggggtggcggccgggcagaggctgcaatctcggcactttgggaggccaaggcaggcgggtgggaggtggagattgtagccagccaagatcacgccactgcgctccagcctgggcaccattgagcactgagtgaaccagactccatctgcaatcccggcacctcgggaggccgaggctggcggatcactcgcggttaggagctggagaccagcccggccaacaaagagaaaccccgtctccaccaaaaaaatacgaaaaccagtcaggcgtggcggcggctgaggcaggagaatcaggcagggaggttgcagtgagccaagatggcagcagtacagtccagcttcggctcggcatcagagggagaccgtggaaagagagggagagggagaccgtggggagatgggagagggagagggagaaatagaatcttaattcttttttttttttttgagacaaagtcttgctgtgttgcccaggctggaatgcagtggtgtcgtctcggctcactgcaacctccgcctccagggttcaagcatagaatgtctctcatagcctcttgtaccacctctcctcttgttctctggaacaccgctctgtcttctcttctgtccctggaacataccaagagtgtattcaccctagagcctttggacttgctactcccactgtctggaacatcttctcctagcccttggtgtgtgtgtgcctcctcattattcaggcctcatatgcaatatccatattcccaccctttctgctctcagagtaccctgtttgtgttcttcatggcatttaccataatctgtaatgatcttgtttatttgttcacttatttgtgtctttgccacctggaatgtaaactctatgacagcagataattttgtcttgtttacttctgatttcctggaatcgagaactgtggcacatagaaaacactagaaaaataccgtttttgcctgggttccctcaataaaatagtctgttatcaggggttgcatgcattttgggaagtgaatcatgcaagaggaatgaggttggggaagtaaaacagtgaaggagggaaggccaatacagatatctgttgtaagtggtcactgcagtggactactcaagactggattgtgatgatgggcatcttctgtgaagccatgtgtctaagaactgtgcattctagggagagtggaaggtgtatctacccaccagattctgtttcagctttgagtcaagggcttacgtttccatggatgcatgtaggaccagcgacatgatttgcaaggcccagtgcaaaataaaattacaggtcattgttcaaaaagtattcataatttcaagatagagatagtagagccctaaaccaagaatgaggctcatctgagcacagagtcctgtgccactacacaggcctcgtgcccttgccctcatgcgctaggccaggcaggttcttgcagcatcccactgatgtcagagtgtcagagaagccccagagcatgagagctggagtgaagaagcatggctgaagtcaggtgctgtcacgttacacctgtaggaagcaggttgcacagcagtggttggagcaaaaggtggactgagaggatgtcaggccttgtcacttgagataacaagatatccaaaacaataaatgagtttagagtttctacggcttactgtcatttgccaaaaattccagaagatttaaatggtaattttgagagtaattactcttgtagttttgatgatgctaatggatggaactcttgtgctttcccattgagtatgatcatggtattgatttaaatgactatatttcctatgtgagaagccctattccttattattatttttaattgagacaggatctcactctgtcacccaggctggagtgcagtggcacaatcttgactcactgcagcctgcgcctcctgggcttaagcaatcctcccacctcagccttccaagtagctgggaccacaggtgcacaccactactcctggctaatttttttttttttttttttggtggagacagggtctcaccatgttgcccaggctggtcttgaactcccgagctcaagcgatcagcctgctctggcctcccaaagtgctgggattataggagtgagttattgtgcccggttcacaattttctaagacaccttagatagaaactctgtccaatagaatgttctgtgatgatgaaaaacgtcttgtctacacagtttaatatggtagccaataggcacatatggctattgagcactttacctgtgaggaactgttggttaaattttatttaattttaattcatttaggccaggcacggtggctcacgcctgtaatcccagcactttaggaggccgaggcaggcggatcatgaggtcaggagttcgagaccagcctggccaatgtgctgaaaccctgtctctactaaaaatacaaaaattatctgggcgtggtggctggcacctgtaatcccagctacttgggaggctgaggcaggagaatcccttgaacctgggaggcagaggttgcagtaagccaagattgcgccactgcactccagcctgggtgacagagcaagactccatctcaaaaaaaaaaattaaattaaatttaaaaagattaattcatataaatttaaagcaccatgtggctagtggctactgtattgcagagtgcagctattgatagcaaacgacacttgtacattctaccaatggtaaaattcaagtctttacttctgttcagtctctctgtgagctccactaactcagtaagttatctcaagcctgctttattttaaggcaatggattctagatccaggaaaaaaagttccatttccctatcttgtgtccaaggcagacatagctaattgaccatggcatttttattttctctgagtttagaagtagctttgtcatctttctcacagtgaggatctggaaagccactactcgttgagagggggtaacaataaactcatatttattgagggctaactgcgtgccaagtactttaagttacattagaagtaaatcccagtccctccaaccacacagatctgcattgtcttctttgtgttgggaaccaagatactcttccaactgggttggatgtcaacctgctcagccacctccatgggacagaccaatcaatcattcaaaggacaaaggaatttatttctcccctcacaatatttgacaaaacttaaaacactgatctttccatcttcattccactacaataattatatgttcataatggagactggacatggggaaagcaaagtaaaagaacatttactacgtgtcgatgtcagcgctgtgcaggatgctttagacatttttgtcatttagcagctataggaaccacatggacaggatatataaagcatctttagtttgtccttttctgctgtgcctcacaagaagtgagtaattaattttgtcagagggtgtttaattcagtttacttattaattcatttactaagtcaatgatattaattaagtgtccagtaagtgcaaaaaacaatgctaggttctgggaagccacatagacatcaaggtcctggcctcaagacattcagctttgtggactataaacggagtataatgagccatggcgatacagggaagagagagtttgaggagacaaggaaggctgcaaagagaaggtggcctttgaactaagtgttgatgaataaaaagaattcaccaggtaagaaaggagattctggactgaggtaaaattatgtgtgatagcataagcacaacaaatccatatggaatatttcagaaatggcaagtgttttagtgtaatttaccaacaccagaaattctgctcttggagtgacgtgtatctacttataatggtacattgtaaattactttgccattgcatgatgaactcaaagcgtacgtaagttaagctgtcaagaaaatatcagcatattatattattgaagtaaaatcagagggaaagtgatctactgctaactagctatctgacttcgggcaagtaagcttggttactttaggttttagttgccttatttataaaatgaagaggttgatgtagaatgtattatttatcctctacactattctaagaagcaacaataataccaagggcttattctcagaatgaaggaaagaagaaaatcaacaggtacttactgaatctgcccctagtaagttgacaaaggaaaggagataagtatatattcattgtcaatttgcacaaaacaattaaaaactgctaagaaaatattaaggtgttagtttgaacttctgaattctttattttttttttttttttgagatggagtctcgctctgttgcccaggctagagtgcagtggcgcgatctctgctcactgcaagccccgcctcccgggttcacggcattctcatgcctcagcctcccgagtagctgggactacaggtgcccgccaccacgcccggctaattgaacttctgaattctaatggctgggagagggtgggacatggtagggaaaagtgcagatatgaatctaagaggctcgttttgaggaaggactgccagatttctacaaagcaatcagaaaaaggatactactatgctctttcaatatcttgttcttaaaaaacaaaagtgatcattcctggaactctgataagaaagattccagtaggctgtttatttacttaacattgccattgcctggactgaagagagataatcacttttagtttcaaactcgatctagtctataacacatggaaagggatttcatgtgttttctaggaagaaacagatgttacccataaaaaacaaagcaaaaaaacccaaaaaatctatattgctattgcaaaatctgagtgtgagaactcatgtcatattcatacacgataaatgccatatgttatttgtataaagaaaggtaataatgcattttcaaataattagttaaaataattttggttggtcaaaactgtattagaagatgaattctctgaggccaactggtgactgtctgaggctcccacatttacagattttatgttatttcaacaaatatccatggagtgtgggagaggcactgtgctaggtgccagatatacactggaggatgaaacagacagagcccttgtcctcatggagcttagagtctggtagggacaacatacctacaaaataaacaccataataggtatttcattcatgccttaaaggaaaacaacaaagatcgggggtcgggtggaactaattcagggcggggcagccaggaaagcagagaccctggctactctcttcactgacagttaaacagatccattcagctgttcaccaggaatttctcagtgtaactttcagagtaagagtaaaacaattccttttttaagagaccagggtatcactctgtctcccaggctggagtgtagtggcatgatcatagcttactataacctcaaactcctgggctcaagtgatcctcccacctcagcctcccaagaagctaagacaccaggcacatgccaccacacccggctagtttttaagatttttttgtagagacagggtcttgctggtcttgaactcctggcctcaagtgaccctcccaccttggcctcccaaagtgctgggattacaggagtgagccacctcacctggccataacacaattctttaagcatctaagggatttaagtatcatttcagggttttgtggtcacaagagttttaaaatctccatccctgacaggtgagtcaaaaactactctcattcatggcaccctgaaccacataaaaataacaatgtaaaccatacatcatttggggattgctggttccctcagatttagacgacgtttcttgaaacctcccccatcccatgctcagtagaagtcaaggcccattccaatacttctgcaaattccataggagtggctctgactctgaactctttgcttttgcaaatgggtttagatcatggaacgtgttgctttactataaatgtggtttgtgtttcatgccatgttaacctagatgtgaaacgtagtctccttttgattgccacagagctcttttcttttttttttccttgagatggagtcttgctctgttgccaggctggagtgcagtggcgcgatctcagcacactgcaacctccgcctcccaggttcaagcgattctcctgcctcagcttcccgagtagctgggactacaagcacgtgccaccatgcccagctaatatttttgtgttttaatagagacggggtttcaccatgttggccaggatggtctcgatctcttgaccttgtggtcctcccgccttggcctcccaaagtgctgtgattacaggcgtgagccaccgcacctggccagagctcttgtaggacatttgtatgtatagtagtttttttaaaaaaagatttcagaggggatgaagtgaagaagaggtttgtattagtcaggataagtcaactgctgtaacaaacaagccccattatagtaacttagcaataacaacaaaaggattctttctttctgatatcactgttcagtgggggttggagagggcctgatccatatagtccttcacagactggagctcttctctggcggcttcagaatcttctagggtattagagtccccaacttgattctctgcaatcagcctgcaggagagggaaaggcatgtggaagaactgccagatttgaagagaagtgtttgaggagacaaggaaggctgcaacgagatactttgggagttatattggccacatctggaggtggcacacaccacttctgcccactttccgttaactcgtagtcacatggctatacctaactgccgtggagggtgggaaatatagtttagttttgaggccaggatgaaaacagcttttgtaatctgtctctgccacaggatttattctgtagtggcacaaacaacttcaaatttaacgtttaatctcctagtttttaggaagtccttggccttctcacttctatggatttttttttttttttaagacagagtctcattctgtcaccaggctggagtgcagtggtgcgatctcagctcactgcaacctccacctcctgggttcaagtgatgatccttccttagcctcccgagtagctgagagtacaggcacgtgccaccaggcccagctaatgtttgtatttttagtagaaacagggtttcaccatgttggccaggatggtctcgatctcttgaccttgtgatccacccaccttgcctcccaaagtactgggattacaggtgtgagccaccacgcctggcctacttctacggatttttaatgtaattttcagactcatgccaactcctcttcccctctccacttcattccttccttccttccctttctgtcttcccatacgctaatatttttgtttttttttttctggcagagtgtattcaatgacccctcattgccttgtctccaacaggctactgatgtaactgggcagcttaacttcgacatgcatcttaaaacctgttttcctttctcttgggtttcaagatataaccttgacacaaactgcagaagcctttttcccttagccttaagatatccatgtccctccccttctcaccatatatactcccttcacatttacctaactgtatgctagtatctaattatgtgccttcttagttcccggggctaatcttaagacaggcagaccaagcctgagacccagctgcaaaatttgagagattacttcaaggcaactagtcaacaacccaaccattgttgagatgatgccagcccacgctccaggtagactgggacccaagatatccaacagaacaagacatgcagacattgtactcagcacaattcttgcctgccttccgtatcaagtttcccccccaacttttttttttcttttttttttgagatggagtctcgctctgttgtccaggctggagtgtgatggtgcaatcttggcttactgcaacctctgcttcccgggttcaagtgattctcctgcttcagcctcccgagtcactgggattacaggcacccgccaccatgcccccctaattttttgtatttttagtagagatggggtttcaccatgttggtcaggctggtctcgatctcatgaccttaggtgatccacccgcctcagcctcccaaagtgctgggattacaggcgtgagccaccatgcctggcaaaattttccctttttaagcccttgcctttcccccaaaaatcaaagtgattactttggagggcatcaggctacttccccattgctagatttggttaatgaagtcactttctttctgccatacctcactcatgttaactgtactctgcaaacgacgagcgaccaaacctgcattgagttacactgagactctcaccatccatctaactgtcttatttatataggcaggaggtgggaaatactgggtagaagagggcagggtgcatggtgagggctccaccctcaagcatggacccatggccctaagtgagcacatgcattcctgttttcccatctgaatgttgccttttcccaaccaccctggcctgccatgcccctggccctgtacccataaaaaccccaggctcccctgtcagaggagcagaatggtgcagcagagaaagagaaaagtgtctgaatgtcgagaggaaaagaggcagctggacaccagagactatggttggaggggagtttggccagggatggtcagagaggagctcctctggggacggccaaactctaggggaagatgatcttcccacttcatcccctttccagcatcctatcccactgagagccacttccatcactcagtaaaattctccacatacaccacccttcaatcctgattcttcctggatgctggacaagaatttgggacgcactgggtgcaagaacccaaaaaggctgtcacactgactcttcactgaggtgtttaacccttaagccctctgtggatggcaaaagctaaaagagcattgtttataacacgtgccttctggggctccagaggtcccgggcaacacctagatgctactgtagtctggtacggggcttgttcctaccagtacccaaaggcactcacccaggctcctgcacctgctcacctgcggctccctctctcacaagggagttgagtatggaggtaaacaagccacacccctgttgcaaggcccgagaaggggtcaaaggaactctcccatctcattatcagagaaccaaggcagttcttcactagagaattcatttataggacatcacatttgaaaccctctgaggcctatatgacatatggcatatgtctgtatttctcaaactgatgtaaaatatattcttcggactgtggggctttatgcctggaaattcctgaagccacaagctaaaaacaacctggttttagctcagaacagttccccccagggctgtgtctgtgctcttcccctccttttgggggagttgttcctttgcaccctactgttttaatacacaacttgaatcttctaaatatgatgggtatgtttgcatatgtatattatattaattcttttaattaattaaaactgaaatatgggcccacaaatccactgcttgtgtaaagaaacaaaaaagaagtggagaggaaaagttttcttgtggtcataagcttttctttttttcttttttttttctttttgagacgaagtctagctgtgttgcccaggttggagtgcagtggctcaagcttggcttactgcaacctctgcctctcaggttcaagtgattcgtctgcctcagcctcctgagtagctgggactacaggcgcctatcaccatgcccggctaattttttgtatttttagtacaggcagggtttcaccatgttgaccaggctggtcttgaactcctgacctcgtgatctgcccgcctcagcttcccaaagtgctgggattgtaggcgtgagccactgcacctggcctacaaatatttttatttttattttttttgagacggagtcttgctctttcgcccaggctggagcgcagtggcgcgatctcagctcactgcaagctccacatcctgggttcacaccatcctcctgcctcagcctcccgagtagctgggactataggcactcgcaaccacgcttgactaattttttgtatgtttagtagagacagggtttcactgtgttagccaggatggtcttgatctcctgaccttgtgatccacccgccttggcctcccaaagtgctgggattacaggcatgagccaccgcacccggctgctcgtaggcttttcaatcatcctttcccttgtccttcctgcttatatgaaacaagaggtgcccttttctttctaaggtatttaagatcgtatttaagttcaaaatatggtctgtcacaaccaaaagaattctgattcatacaataaacatagcaactttcctgaagagtcattttttactatcaaatttttgcaaatctcccaatgtcatttttattttaaaccatagatatacagttgttactcaatatccatgatggagattggttccagtaccccctatgcatactaaaatccatgatgctcaagtccctaatataaagtggtgttgtatttgcatgcaatctatgcagatcctcttgtattgatacaatgcaaatgctatgcaaacagttgttatgctatattgtttagaaataataagaagaaaaaaaggtacctacatgttcagtacacagtacagatgcagccattgttttttttttttttttgagacagtcttgctctgttgcccaggctggagtgcagtggcgtgatctcggctcactgcagcctctgcctcctgagttgaagcaattctctgcctcagcctcctgagtagctgggattacaggcacccaccaccatgcctggctaatttttgtatttttagtagagacagggtttcaccatattggccaggctggtctcgaactcctgacctcgtgatccacctgcctcggcctcccaaagtgatggaattacaggcgtgagccaccgcgcctagcagccaaccatttttttcccctggaacattttccattggcagttggttgaattcatggatgcagaacccatggatatggagtgccaattgtatattattaaacagaatgtcgggatatgctctaggtccccagggctgtgcattcctacctagaggcacttaggtgagaaagttggaggactgctgtcactgttttaagcttaagacagggtcaaattacttttttccttcttgtatattccttcatgggggaggaacttttgctgggaacctgtgaaatgatgagctttttgtgcactttctagttggatgcatttttgagatgtggggcaacagaagcaggaggctgcaagagagcagcaacatctgaaaagtctgctgagccatctggcttcaggagaatttacttagtttgcttcctggaagttgtgataaaatttataaataatttataacacaaggacttcaagagaggcatattggaaaactcagtgctatctcaaactgtctggagcaaattataagcctcagctatctcccccactacaaaaaaaaatgcaagttttgagtggaaaggaaacacttgtagctccatttcctctcaggcacaagcagctctaaaaaaagaagcaatgtgaacagagtgtctcagaaagagttgcagctattgtttgcaaagtaaggaggaagcaaagcaataatattaacagaaatagtttgaaaatagagcaagcaaggagaattgcaaagtagaaagtatacctaagggggtagaaacatcagataggatctacctcaaggcatggagagatctttgtttgtttcctttgttccacagttgaaattatctttatcttccaatctaaacattgcctactttttgtttcttttcttcttattttatgtgggagtttctatttgaattttagtcatgttgttttgagtggatgatcagccacagcaggatatgcttttttttttttaagtgagattaaacacgagttagatggtaatcagtgaggctggttatatacataaatatctgcacattattttaatgttttccatagttgtaaattttcacaaagagatccatgattctatgaggagtctattataaaatatgctatctactcactttgaatcttgtctaagttaacctcttttcttttctataaaataggtattgaactttatgaaaagaaccaaaatgatcttcactggagttggttaggatcattagctttatcacataaaagcttctggatttttttgtttatttgttttttatttggggtttatctttgtctgttttctgttgcttataccagaatacatgaagctgggtagttgatttaaaaaaaggaatttattttttacaattataagaaatgaacttatttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccaccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccatgaacttatttcttataaggctggcaagaaggtcaagcctgaggctgacaagtccaaagtcaagaggctgaatctggtgagggccttcttgctgatggggactctctgcagagtcctgaggtggtacaggggctgagcatgctagctcatcttcttcctcttcttgtaaagccaccagtcccctctcatgaaaacttgttgatccattagtccattaatccattaatccctcttgacccaagcacctcttaaaggcctcagctctcaatactgtcacattggggattaaattacaacacgaggccaggtgtggtggctcacacctgtaatcccagcactttgggaggccaagtcgggtggatcatgaggtcaggagattgagaccatcctggctaacctggtgaaaccccatctctactaaaaatacaaaaaattagctgggcgtggtggcacacacctgtagtcccagctatttgggaggctgaggcatgataatcgcttgaacccgggaggcagaggttgtggtgagctgagattgcatgattgcactccagcctgggcaataagagtgaaactccgtctcaaaaaaaaaaaaaaaaaaaaaaaaaaattacaacacaagctttggagaggatagatattcaaactatagcaggactgatcttaaaaatcagttgctaaacattatgttttgttaaacatgtttcagttgttcaacatgttttgtgctaaattcatagattgtattttgatcacatcagtgggaatgactttcatatcaatggatcaagattaatttgatgagataaagtataactcattttaaagaaaattctaaagtcactacatatggtgtggtgatttcagcttggcaaacactagaacaaaaccattatgtagccaatgccctgtggtctgtcatatactcaaatacataccatatgtgttgtgtcagcatgccagattacttttgtacctctactctgtggaaaatattcaaatgctatgataatgaccagataaatagtaatgataagtcaatgagtcccgagtgtccaaagtgtaacttgaatggattaaagaataactaggttgtctaacatcatcctgatatggacaggaggcagggaaatactaggtagaaaaggatggggtccctggaaagggctctactctcaagcctggacccacagccctaaatgagagcatgcattcctgttttcttgcccaaacgttgccttttcaaaaccaccctggcccaccacaccccccaatcctgtacccataaaaaccccaagggtcactggcagaggagcagagcagagtggcagagaaggagagaagagaagaagcagctggacatcggagaaaagcagtttgacttcagagggatggtttgatgggtgggactttggggaagaatttggctgaggatggccgaactccaggggaagattatcttcccactccatcccccttccagctccctttctcactgagagccacttccaccactcaataaaatcctccttgtacactacccttcaatctgtttatgtgacctgattcttcctggatgccagacaagaacttaggtactaagagggcagggtataaaaggctgtcaccttgaccctccactaagctggttaatgcttaagctgttcacagatggcaaagctaaaggaacacactgtaacacacaccctctggggctccaggggtcacgggcaatccctagatgctgccacgggctggtaggggtttccttcccaccagcgcccaaagacactcactgtggctcctgcacccacctacctgtgtggtctgcctccagcaaggagtttgagtgctgcaggctgagtaagtgagccacccctttgcaagtcccgtgaaaaggtcaaaggaatgatcccatctcagtcctatgaactagttccccaaataggctgctcatcagaaaccaacagagaggtctaaaactttgtaaaatttaaatctagtaaaattcacacttttgggggctctatgagttttgacatatgcttgtcactaccaccacaatcaagtgacacaacttggggtagaacagtccatcacccctccagaaatgccctgtgctcaaatacccctttgtgctcaaaacccagcctcagcctttcaatcctggaaaccactaatctgttctccttcactatggttttgcattttccagcatgtcatataaatggaatacagtatggaaaatgggttgtatccctgcgtataatacactggagagtcatccttgctgttgcatgtgtgttctttttaattgctgagtactattccattgtacagatgtatcactgtttctctgtgtgttactcaactgagagacatttgggtttttaccaggtttgggtgattatgaataaaaatattataactattcatgtatatagttcattgtaggaacatgtttccacttatcttaggtaaatacctaaaagtgagatacctgagaagttttgaaaaatattccccttcccatggatttgcaatttcttcagtatggggccttggaatatatactttaaaaatgctcctctagtgtaatttctttgttttttggagaccagagtcttgctctgttgcccaggctggagtgtagtggtgcaatctcggctcactgcaacctctgtccccctggttcaagtgattcttatgcctcagcctcccgagtagctgggattacaggtgtacaccactgcacccagataatttttgtatttttagtagagatggggtttcgccatgttggccaggctggtcttgaactcctggcctcaagggatttgcctgcctcagcctcccaaaatgctgagattacaggcatgagccatagcccaagtgtgattttttaatgggtaaggaatgtccttgcgagtggtgaaacttcttggaaatagttagaggtaatgattgcacaacattgtgtatgtactaaatgccactgaattgtatgctttaaaatggttaatggttaattttatgtcatatacattttatctcaatttttaaaaaacctaaaaaaatgtgctcccaggtcattctgatatttggaagatctgatcttggaaggttgtacctggctggactttatgttaaaagatctttatttatttatttattttgagatgaagttttgctcttgctgcccaggctggagtgcaatggtgcaatctcagctcattgtaacctctgcctcctgggttcaagagattctcctgtctcagcctcccaggtagctgggattataggcacccgccactacacccggctaattttaaaagatctctatactgatctcagcctctgggtcttggtccaatcttctccttgtgaatctgtaacaaactgaattctctttagaaagtttgaggaatcttaaaaaattgttgatagttagcaggtaagcctgtagcttttgtgctatcttggagattgctcctggctcacatggacccagagttctgaggtcatcatctctgctgtggtctaaccagagctctgagggctcagcataggtctggatccaatttctctgagtggagtagcgtgggtgagatccttcttaccagaggattagcaaggctagactagtcctagagtctgttgagacagtctacagaataattttgagtgcttgggattgactggctatcaatttgcatctctctggggtttttactatttaccaatagatatacaactggttattgcagcatcgaaatagatccaatctcattcattggcacaagttacaccatagaagaccttatattaataaccctgaccgtgttagagtatggccaggcttgcagatatgagaaaaactagccagacatccttacgagacagagttgtgatatagaaagagcataggatgatgatagtcaataccttggttctggaagtttctttgtctttaaagactaaagcagaggcacagagtcagagagtaccccctgttctctatgtgtatccattctccattctagtcttccttcagcctctgctgctatagacacccctatgtccttatacttcctgtttttgtcttttctgtgccacttgaactttgagccatctgtcaaaccaggggatccttatacccgaacactttcttcttccgggttttgtgtatgcctagccactttgaggatgagggaataagccaaagggagaaggtggttgggagttggagctcagagttgagccctgtccccgtggaatttcctaagctggcaccacagtggggtgtggggagtgcttctgaaagacaggcatcatcccaagccccgtgcatctcaggtaggactgagtcttagactatgaggaagacatagtttgggctccttattactacctccagaggacctagcatctacggggagtattttctcttcccttttcttgccctctggaatggaagcctcttcagatagattcatctcattgttgcagaattttagacgtttgtcttttccatttgcttggtcatcttgccttttcgcattaggtttcatgacttgaatcatgaaagggcagaaaagcagacagtactctagttaaaataaaacagagatggagggagggtcctggagaagaagggtactgtgtatgatgctggggggaggaaagaagagatgagggaaccgggggtgggaccacagagagcttataattctgacctgaacttgtgaagaagagatcattgatttgaacgttctgccatctgcctagattgcattcgaacgtgagtaagaagagaaagttactgcctaccacatataactttcctttcctaccctccctcgatttctcagactgactcaggtactggaagcatttactgaggacttggccatgggaaatgagagaccaccaggcaaactcgcagggaagatgatttgtttactgtctctttatttctctttctcaacgtctcccccgagaacctggagtctacagatttccacagtagagagctctggctctctactctagtaggactttgtgtactggaccatttctgaccacttctgttttctcaacattactttttctgtctcctatcctccctctagagttggtgtgaaactagacctaaggtgtggtgaatagcagggtcttgacatgtttgccctttctcagtttccaggtgacattttattctctcctcattattgcctgaagaaatgagctcagcaaggtgtgaggaaacatagtagggctgttggcagagatatcttttgatagggggaacatttaaatggatattttgaaggaaattggcttgaatatattgacctgtgtatataactgatcaaaattctggagtattgccaggtgtggtagcctgtgcctataatcccagcactttgggaggccaaagaaggaggatggcttgcggccaggagtttgagaccagcctgggcaacatagtgagaacttgtctctaaaaagctaaaaaataggttgggcgcagtggctcacgcctgtaatcccagcactttgggatgccaaggcgggcggatcacaaggtcaggagatcaagaccatcctggccaacaaggtgaaaccccatctctactaaaatacaaaaaattagccgggcatggtgcgggtgcctgtaatcccagctactccggaggctgagggaggagaatcgcttgaacccaggaggcagaggttgcagggagccgagatcgcgccactgcactccagcctggcgacagaacaagactctgtctcaaataactaactaactaaataaaaattattgcatgtgggttgtgcacctgtagtcccagctacttaggaggctgaagtggtaggatcatttgagcccaggtgtttgaggctgtggtgagccatgattgcaccattctaccccaggctaggccacagagtgagaccctgagtcttaaaaaaaattggccaggcgcggtggctcacgcctataatcccagcactttgggaggccgaggcggacggatcacgaggtcaggagattgagaccatcctggctaacacaatgaaaccccgtctctactaaaaataaaaaaaactagccgggcctggtggtgggtgcctgtaatcctagctacccaggaggctgaggcaggagaatggtgtgaacccgggaggcggagcttgcagtgagcagagagcgtgtcactgcactccagcctgggtgacagagctagactccgtctcaaaaaaaaaaaaaaaaaaattccagagtgttatatccatccagtaaatggttatggagctctcctataaattactgactcaaggcaattattgtctggaatttaacgagagagagagagagagagagagagagagagaatttgacaaacttggctggcatacacattgatgatccttaaggaaaacaataaaactgcctcacaggccgtaagggaaagcacacactgtaatgacatctcagcaactcgtagcacagtgcacatttcccacaaggctgtggttccccgtgtcctcacccgccttggttgtaatagtggctagcaggccgtgttccatcattagtaacatctctctttgtgggaatagtggtgtaattgtggacagaagttcatgttgagttctatttatagcttctggtgactcattaatatgttaccttagcaaagggtagctccagagccagccttttattactgtattagtcaaaaacattctcactggggtattctgatacaatgaaaaacaaactgtaaaacacttctagcaatttgcatgtcagccttttaattggtgtgatattagcacccttgcacgctttattggaagctacagttgtcaaaggtacccatgtctacaagtgcttaccaacatgtaggttctgtgttaagggaaagaaaaaagaatccacttgtagtcttctgaagagttaaactctcagttgatctggaaaatatgttaaccaaccttcaaaagtattttcgctcccggaagtcttcaagccctctgtgactatgccctttgtaacatttttacacatgtgaccttcacactcaccactttgattccaacagcgaagtcgaagtcgtggtcaggagtaagactgagctgggtagagatagtaaggtaagactttgaagctgctgtacttttatcaattcagtctgaaaaacagtctctgtggttaagcccattaaatctcttgtgctttcatagcagcttggctaaaggttattactatgaaggctggagggagagtgggagataacttcgaccagagagctctcactgaaatgggttcaaaggagttactcatcttctattccctttagcggaacctcataatcggatagcacttactctgtgctttgttaaaaatatagcatacaggctgggcacagtggctcacgcttgtaatcccagcactttgggaggccgaggtgggcagatcatctgaggtcaggagttcaagacaagcctgaccaacatggagaaaccccgtctctactaaaaatacaaaattagccaggcgtgacggcacatgcctgtaatctcagctactctggaggctgaggcaggagaatcgcttgaacctgggaggcggaggttgcggtgagccaagatcacaccattgcactccagcctggacaacaagagcaaaactccgtctaaaaaaaaaaatgtagcatacaatgaaactaccaatatcaagtgctagcaaggatttggagcacttgatatttttaagaattttcttacattgctgacgggaatgcaaaatagtacagccactctggaaaacaatttggcagtgtgaaaggaaattaaatcttgggatcccaaactcattaagccaaagggaaaagtcaagctgggaactgggtcacacaaacctgcttccccatttttggttcctaaataagatggctacaagatgaaaagctacaagcttcccccatattttgcccacaaggaaattccttgtgagctgcaagatcttctaaggtgtttctgttaaaatttcaccatggcaatgtaaactgatccttatctttatggatgctgtcacccctggcccaccagacacaaatgcatatcagattgttctcctggcccattttcgtctatgttatcttatggaaaatgcagattcccagccgggcgtgatggctcacacctgtaatcccatcactttggaaggcggaggctggcggatcacgaggtcaggagtttgagaccagcttggccaacatagtgaaatcgcgcctttactaaaaatacaaaaagttagctgggcgtggtggcaggcgcctctaatcccagctatttgggaggttgaggcaggagaactgcttgaacctgggaggcagaggttgcagtgagccgagatcgtgccattgcactccagcctgagcgacagtgcgagactctgtctaaaaaaaaaaaaaaagcagattccctgcattttttcctctgccccatttgtctatgtcatcttatgtaaaaaccgcagattcactgagccagacaaaggcatgaatggctatttttccttaccctgctcttacatgaaaattgtatacatctcaatatcctgccctttcccctttaaatttggagccctcaaaatcatcttcagagaaaggcatagacctgtctcccaggtgtgcagccttaactttggcaaaataaacctcctaaaatgattgagacttgtctcgtcatttttcttgattgacagcagtttcttacaaagttaagcatacacaaagcatgtaacataacaatctcactcctaggtatttactcaagagaagtgagcagggaacggtatgaggtaggtacagagcattcaggcagagaggaccacctgcaggagagtgacaactctgaggaggtgaggagacaaggcattgtcgtagatggaagcttatggggaggcaacgagatgaggctgcaggctgggctttgtgggctgtggtagggattttggtttctattctgagaatgatgagaaaccattaaaatgatttaggcaagagggtgacataatcagatgtacctttttaaatgatcaacctggttgcagtgtggagagtggactggagggaggcaagtatgcccagggaggtcattgagttgtctgggagaattcctgatggggcttgggatagggctgtaaccttagagatgctctcttttaatgccccaaatacccctaggaaggtttgcactgatggcttttttttttttgagatggagtatctctctgtcgcccaggctggagtgcagtggcgccatctcggctcactgcaagctccacctcctgggttcatgccattctcctgcctcagcctcccgagtagctgggactacaggcgcccaccaccacgcctggctaattttttgtatttttagtagagacggggtttcaccgtgttagccaggatggtctcgatctcctgaccttgtgatctgcccacctcagcctcccaaagtgctgggattacaggagtgagccaccatgcccggcctcactgatgtcttttatataataatatttctagtagaatcaagaataatgaatcacttcttttcaaatacagattataaaatactccatatataaaaaagaatttatgtgatattaaaggaaattaaataccataaaaaaaatcaggactttctttcctttcttcctttctcccctcccctccccttccattcccttggggtcttgctctgttgcccagactaaagtgcagtggcacaatctcggctcactgcaacatgcgcctcccaggttcaagtgattctcctgcctcagccccccgagtagctgggattacagacaaaaggcatgccaccacacctggctgatttttttatttttcctagagatggggtttcaccatgttggccaaactggtcttgaactcctgacgtcaagtgaccaaccagccttggcctcccaaagtgctgggattacaggtgtgagccaccacacacgtcccggtatcaggactttctaatagttacagcttgtaagcattggaagaggctggcttgggaggtgacgggaggccatgctgttgacaatttgtgtaagggtgtggaagaaggattcccaggagaggagagaggttgggtagttgactgcaaaggtgctgatcctaaaatcctctgccacaatgcaacaaaaagcaaaaatatttgttacaagcaaagctcttaaggggcatttgaaaacctggggtgttggtttcttaaaatcaaatgtggaattgtagctcctgtttttggtgagtcctttgatttttggaacatgtaagatggaaccatgtgcatacatatactcacttatatagcaataaatgtggtggaggtattttaatttcttgagtcccagaggtattgggttaagagcagagtgagagattggataaggagatggttgcaacgattcctttttctattccacagaagcagctcacagactatgacttgtgggccaaatggcacttgttttgtatgacccatgaactaagaatgttgcttacattttgtttgattaaacttttaaatttgaggccaggcgtggtggctcacacctgtaatcccagcactttgggaggctgaggtgggtggatcacctgaggtcgggagttcgagaccagcctgaccaacatggagaaaccccatctctactaaaaatacaaaaaaattagccaggcatggtggcccatgcttgtaatcccagctactcgggaggctgaggcaggagaatcgcttgaacccaggaggcggaggttgcagtgagccaagattgagccattgcactccagcctgggcaacaaaagcgaaactctgtctcaaaaaaaaaaaaaaaaaaaaaaaaccttttaaatttgaggtaattctaaattcacttgaacttatagaagatacattacagaaaaaaaacagataaaatatacttcatcaaaattaaaaatttttgtgcatcaaaggacactatcaacagagtgaaaaggcaattcacagaatgggagaaaatatttgcaaatggtaatccaataaggagttaatatccagaatatatgaagaatacttataaatcaaaaacgaaagtcaaacaaccctattaaaatatggttaaaggacttgaatagacagttctccaaagaagatacattaatggccaataaacaaatgaagagatgataaagacaaataatcattagagaaatgcaaatcaaaaccacttcacatccattagggtggctgtcaccaaaaataacaaatgttgatgaggatgtgaagaagtgggaacgcttgtgccctgctggagtatgtaaaatggtgcagctgctctggaaaacagtatcacatttcctccaaaaattaaacacagaattgccatatgatccagcaattccacttctatccaaaagaattgaaagtagggacttgagccgggcgtggtggctcacacctgtaatcccagcactttgggaggtcgaggcgggcagatcacctgaggtcaggagttcgagaccagcctggccgacatgatgaaaccccaatctctactaaaaatacaaaaattagctgggcgtggtggcaggcacctgtaatcccagctactcgggagcaggagaatcccttgattctgggaggaggaggttgtagtgagttaagatcgcgccactgcactccagtctgggtgacaaagcaagactccatctcaaaaaaaaaaaggaaagcagggacttgaacagatatttatacagcaatgtttatgacagcattattcacaatagccaaaaagtggaaacagtttaaatgtccatcaatggataaatggaaaaacaaaatgtggtatatacatacaatgggatattattcagccttaaagagaatgaaattctgatacatattacagcatggatgaatcttgaatacattaagctaagtgaaataaacctgatacaaaaggacaaatattgtgtgattctacttataggacgtgcctagagtagtcaaattcacagagactgaaaaggggctgtgggagggaaaattgaggagatattatttaatggatacagagttttattttgaggtgatgtaaaagttctgaaaatggatggtggtgatggttgcataataatgtgaatgtatttactgccagtggattataaatttaaaaaaatgttaaaatgataaattttatgttacgtatattttaccacaataaaaaagaagtaatacagagagatcccatgtgctctttactcagttttccccaacggtaacatcttataaaattatacaatataatacacaacctgccaggcgcagtggctcacacctgtaatcccagcactttgggaggccgaggtgggcagatcacctgaagtcaggagtttgagaccagcctgcctaacatggggaaaccccgtctctactaaaaatacaaaaattagacaggcgttgtggcacctgcctgtaatccaggaaattgacagttatataaacccaaatcttattcagacagcctcaattttacaggtactcatttgtgtttattttaaaattattgaaaatgataaaaagtaatattttgtgacacataaaattgatatgaaattcaaatttcagtatttataaataaaatttgattggagcataaccacattccttcatttatgtattttttctttttttttttttttttttttgagacagaatctcactctgtcacccaggctggagtgcagtggcacaatctctgcacctctgcctcctggattcaagtgattctcctgcctcagtctcctgagtagctgggattataaacacatgccaccacacccggctaattttcatatttttagtagagacggggtttcgtcatgttgaccaggctggtctcgaactcctaacctcaggtgatccacctgcctcagcctcccaaagtgctgggactacaggcatgagccaccgtgcccagcccatttatgtattttctatggttacttttgtgttgtagtgacagagttaagtagttgggacagaaacctataaagcttgaaatatttattatctgtcctttatagaaacagtttgttgacctctgttctagagtacaatcagctgccaaaaagaaaaaaaaaaggttgtgagtataaaattacttaagggaaatgactggataacgtgtttaaatttgggcaaatgaatcataatgaaaatggtaaattgtcaagagtggtatttatgaaacttaggttggtgctacttggccttgctgggaactttgattgttcccaagatgcatttgcttagctcttctcaccagggcgagtattgagtattgtgctttttggttcccatgcctttgtaccaatggatatgctttgatgcaagtaaaagaaaacatgactaaatgtagtttaaatttaaaaatttataatacccctcattacaattttagaagagaggggattctggagctgcttaattcaacagctcaaagatgagatcaaggacacaggttctctccactcttccgctctgccatttgcagcttgttcttaggttcacatcccatgtcctcagtgtggctgtggtagttcatcatgacctaagagtggaagaggggaagaggcctgtccttttcttcgtgttccattgtaacgtgatgtgatgaaaattattccagaagttccctacagacctcctttctgagttagttcccatacctcttctagccttagtaaggggactagaataccatgataaggcctagactaatcagaattcatccctagatagaaaagggggccaggcccagtggctcacgcctgtaatcccagcactttgggaggccaaggcaggtagatcacctgagatcaggagttcaagaccagcctggccaacatggtgaaaccccgtgtctactaaaaatacaaaaattagctgggcatggaggcacgtgcctgtaatcccagctacttggtaggctgaggcaggagaattgcttgagcctgggaggtgggggttgcagtgagccaacatcgtggcattgcactccagcctggacaacagagtgagattccatttcaaaaaaaaaaaaaaaaaggtaaagggcccaatatttcagaaacacacagagttatctaattcttgaacgaaactgggattttgctagcaaagaaaaatgtggggggatggatgtggtggctcacacttgtaatgcactttgggaggctgaggcaggtggatcacctgaggtcaggagtttgagaccagcctggccaatatggtgaaaccctgtctctatgaaaaatacaaaaattagctgggtgtgcagcatgttcctgtagtcccagctactcaggaggctgaggcaggagaaccgcttcaacccgggaggcggaggttggagtgagctgagctcctgcactgcactccagcctgggcaacagagcaagactccatctcaaaaaaaaaaaaaaatgtgggagaatgaatgaatgtgggaggtaaaaaatggtgtctgccatagccataacttgatgtctgcaacctcagttgtggcgttcaccattttcactaagcacaggtgtgtaaaaatgatgtgcatatattattattttattttatttttgagatggagtctcgctctgttgcccaggctggagtgtagtagtgccatctcggctcactgcaacctccgcctcctgggttcaagcaattctcctgcctcagcctcccgagtagctgggactacaggcacccgccaccacacctggctaattttttgtatttttagtagagatggggtttcactgtgttagccaggatggtctcagtctcctgacctcgtgatccacccacctcggcctcccaaagtgctgggattacaggcgtgagccacctcccccggcctgtgatgtgcatatataaatgaggaaatctaaatgactagacttcctttcttttttcctcctccttctcttcctctaaaaactgcaagccaacatgatgtgtcttctaggggcatgagagatggagaaagaaagcctcagctaccatgagactttgttcagtgctatgatctgaatgtgtttctgccaaattcctatgctgaaatcctaactcccaagaagatggtactacaagatgattggaaggtgattaggtcatgaaggctctgcccttatgggattagtgccctcataaaaggggcaccagagagctaactgccttaccctttctccatgtgaggacggaatgagagggcgccctcatccaaacactgaatctgctggtgccttgattttggactctacagccttcagaactgtgataaataaatttctgttttttataaatgactccatctatagtattttgttatagcagcttgaaaggacaaagacgttcagtttaaatcatgaatacagacccatttgtaccaaaaattaacacagcaacaaacctttactgaacacctatgatgggccagcttttggggacatagcagttaataaaatagaaaaccccccaacccctatggagcttacattctaccaggcagattcagtgtattaatctctaatgtgccagttcactatctccttccatctgagtcttaaaagtattttttttttctttgagactgagtctccctctattgcccaggctagagtgcagtggtgcaatctcagctcactgcaacctctccgcctctcaggttcaagcaattctcatgcctcagcctcccgagtagctgggattacaagcacccgccaccatgcccagctaatttttgtatttttagcacagacggggtttcaccatgttggccaggctggtttcaaactcctgacctccagtgatccgcttacctcagcctcccaaagtgctgagattacaggcatgagccactgtgcccagccttaaagtacttttttggatgttgacttttctttcttaggtgatataatgtagtagtagtaatctcaatttgtgggtggaaataaaacacttagatcattctggtttatgcagaatctcaaatttacccacagccaacctgcctcctcttttggaaaacaggagaaaaaaatccgagaaagggaacgctgattgaaataaacaaagagggccgggcgcggtggctcacgcctgtaatcccagcactttgggaggctgaggcgggtggatcacgaggtcaggagatccagaccatcctggctaacacggtgaaaccccatctctactaaaaatacaaaaaattagccaggcatggtggcggacgcctgtcgtcccagctactcgggaggctgaggcaggagaatggcgtgaacctgggaggtgaagcttgcagtgagccgagatcgcgccactgcactccaacctgggcgacagagccagactccgtctcaaaataaataaataaataaaagaaataaacaaagtggatcagcggtatcaatgagaaggcttctaggagagtgcagctggagtgagtacaggatgctctgaaaggcgtttgggggctgaacacttatgtgataggggcacagggcaaaaggacattagaacgagaaattcaggggtcatggtgagactgttctcactctgacttgaatctgaaatcttgactaagggagaagtttgagatgggggctagtgaggttggaccctccagaggaagactggcttgacccaggttaacccagtgactcattcctctgctaggccactgctttccccaccctaacgtctgtccttgcctgcttcttccaggaggtcttctgtgcccacaaacatagctcaagtcttgaagcacatccagggggtttgagcctccccctcccacggtcagaatctctttcctgtctgaattacttgagatgccacttgtagggccagagtgccttcacactcttccagacttgagaaccttccctgaaacttcatttgtatccacttgaacctgggtacacgggattgatatcctacgtgcaactgggatcctgcaggtgcccttagagcatcagggctttattagaaatgagggtggggagagatacagggagcgtagattctgagtgtggcaaagatgggttagaagcagttgtcatcattaatattctctgaggttagtgacaaaatgctggcacacttgacactcccagtgagcaggcagaagtatgagtgtgaacaaggcaagtgggaaggaacaggcagataacatcaggtcacagtcaccttctttctttctttattttttttttctgagacgaagtcttactttgtcacccaggctggagtgcagtggcacaatcttagctcactgcaacctctgcctcccaggttcaagtgattctcctgctttcaggctcctgagtagctgggtttacaggcacctgccacgacgcctggctaatgtttgtatttttggtagagatgggatttcaccatgttggccaagctggtctcgaactcctgacctcaggcagtcaccttctttcaaaatcttttttttttttttggtgtggtatgcaaagattttttgctacaaatccagatacccatgataaaactataaccagaaagcctttatgaatggtttattaaatcatatccctactctctcaggaaaggatatataaaatgtaacaacatatcaagaataataattagaaataaaggaataaaatggagtcaggaatgtgactacaaaaacacaccataattactaggcatgacctggctgcagatttaactttgggcttactaacaaacaattcaaagtgagaactgtggctggttatacaattcacatagttgataagattaaaaggccagtggcccaaaagaagtacaatcattcctggaacgaagactagaaaaattctttggagagcccctgggaaaaagacagggtgaaatgttgagtaacgtgctcaactatatccttagaggagattcagtgacaagctctttctaacagcatctcttggtctggcaaattcctgggacagggtgggtagaggtggtggtttctttgaagtatcggtctgtgtccataactttgaagaaccacaaacatactgccagtttaggacatgtcaatgttttagtaaggaaaaaatataacagtctattttctagtagaaagagaaagccctcccttcaaagccctaatatcactgattccctgccaacacacacacacacatacacacacacacacacctctaaatgttcaatccatagcttggctgaatgaaggaaatgttttaatgtaatatgggagccaccaattaaggaaatgaggacctgagagtaggcaataaattgaaattaaaattattcattcttaaataatggtggagccagattttatgtgaggcctgaagcttatacaattttaggcgctctctttaaggaaaagaacatacagttctgaacataaaagatggtatgaaaataaatatatggaaagaggaaataaatcacaacaaatgactggagccacagagatctacatccttttcttctgagattaagtactttaccagaaatgcttacagagaaacagttcctgattgtaacctgctatccctttcctaccagcaactaacccccagcactagcgggggcctgtgcaagtgaggccccccacctaagcttaagtttcattaattcacggctatgtagaaaatcgtctcaattcccataccgagtccatcatcatttcctagaagactaagcctcttccttctccttgatactgcacactttgaactgctgttgataagatcccaaataaatcaatgcctttatttctttgaaaatgacttcatatccatctggaagaaataatagctcccagtctcattctttttaaagtgatcatgtgtccccattcagcatgcagggctctaaatttgggtatccttggctgtcatgtgacagaatttccctagaagtgttttgggactaaacgggaggaatgtgagatttgctctgttttgtaaagcaaacagcaggaagttgggaaagtctgataaatctgaatgcattttctgtactatcttgtcctctattcaactcaattttattttttcttcttggatgaggagccataatcaggtttccattgacaacctgtgaaaatgttgactacagttttgtaactgagttgaaagcagaaaagccagatggaaaaacaatctccaacctgaaaagtaaaaagcaaaatgtacttctagaaaaatattgcacgtgacttggagaaaaattagaataggatctgcctattttaaaatgaaacctcaagcatgtggtttaggcttagggtgtttcctctttttttcttgtaattttactctgagattgaagcagtgttggcatatttgccacacaataggtttcctgtagtaggaggaaagagtcataggttgagtttatatgaaaaaaggcaaggcccgctgatgatcatttaacacagaatgtaaaatgatcagattttttaaaagtaaaatatcagttgaacgtaggaagattccccaatatgctatggtgccttgtagtaactgagtccttgcagctgcttcctggcagtgattccctcccagacctccaaaaggttgtatgtgctggggaaccaggtaagtgtgaatacccagtagggacagggctctgatccagggctggaaggcagcgcctgggatcctcagggctgatttaacaaccttctgatccatgggtctctggggaaacattttagaattgacatctttgcttggagaccacagagctgccgataagaacatagcaagcttatccacaaatgtgtttttataggaaattttgtgtgggaaagaaatggggaggaatatacaagaagaaaagaaagaaggaagggaaagcaaactaagctcaggtccaacgtagggagaagaaacacttgttaattgttttgaggcatacaactacaatgaactctcagtaagtcagaatagtctcaaagagatctgatctgaattaaaatgtaaactagacaataattttaaaggtaaatataaatttattattttaaagcatactccttaatacttaaatagctgagaaaacaagtagaaatcctcctgggattgctcaaatgccttaaggaaaaaaattgtaatgaggacaattaattgttcttatctaaataggtgctgctaaaactactttaagtatttgaaaacttcgtttccttaagaagctaaacatgatttcagcatttgctttgcaaatcttatttttcaaaatattgctttggcagattttggctttctactgaaattataaattattctgtactcttttagcagggtgagaaagaatgtggtcttattccatgtgggatagattagtatactgtagccatatatgtactaggctctgtactgatgtctctctttttttttttttttttttttgagatggagtctccctcagtctctcaggctggagtgcagtggcgccatctcggctcactgcaacctctgcctccctgtttcaagcaattcttctgcctcagcctctcaagtagctgggattacagcgcccccaccaccatgcctggctaatttttttgtatttttagtagagacagggtttcaccatgttggccaggctggtctcaaactcctgaccttgagcgatccacccgcctcagcctcccaaagtgctgggattacaggcatgagccaccgcgtccagcttggatttctatttgtgtttttttttttggcatatgttttttgagattaaaaattttttttgaattggtaaaacatttgaaagaaattgaagaaacccagtaaaacatttaaaagaaattaaagggcatgaagtgagatgtacataaaataagtctcctttccattcttgttccctaacctttttccccagagtcccccatggctcaccagtttcttatgtgtgcgttttaagatattgtgctgaacatttaagatataatatctcatttaatcccatgtggtaattgactacatattgtcatcttcatttaatagatgaggtaactgaagcacagagcatacttgccccagatcacaaggaaataagagaaccaggatcagaacccgtgccagtgcatcactgctttacatcctccgcattatcttcactccagatggccacaaagcctggtctctactttcttgtccccacccctctgcttgtttaaatttgactcatgctttaaggccttgtttagaataatgacagcatttactgagtgctcactatgtgccaggcacttacatacactatcttatttaaccttcataatagccttaggaggtaagtaagtattattatctccatttaagagaagtgaagctgagacttagaaagccacatagctagtaagtggcagcgtaacactgccatgctggtctgatctgaggccctaacctcccacctcccgcccattcactcacaaggttctccccagtttgcagtgatttcacttctaggaatagccttagcacttcttatcacaaaccacgatggtatttgcttgcaaatttttctgtattgttctttggcagtttaacctcctagattcttctctttcaaccttgctgtccactcctagaaagcagactctatttgtaatgctcaatcataatgcaattgtacaaatcctactgagaccttacaaaatagaacaagaaaatggactaatgaaaatggaactctttaaacttcagtctggaattacatcattggcatatttagcttttgaaaaaccaaatatatgtgcactagaataagtgagagaggaaaaaggcaacttggtgaggtggtactgtctgccattgctctccaaggctcatgccccagggtatgcaccaggaggctggcacctgcctttgctggatgggctctccattccatgggttcagagtacctaagtacctgtctctgagtgtgactctattgcttcaagatgaatttctctctctctctctctttctctcccttccttccttcctttcttttttttttttttttttttttgagacagagttttgctcgttacccaggctggagtgcaatggcacaatctcggctccacaatcttgcaacctccacctcctaggttcaagcgattctcctgcctcagcctcccgagtagctaggattacaggcgtccaccaccacacccggctaattttgtgtttttagtagagacagggtttctccatgttggtcaggctggtctcgaactcctgacctcaggtgatctgcctgcctcggcctcccaaagtggtgggattacagggggtaagccaccgcacccagcctctctctttctttcttgtctcactctcttgcccagtctggagtgcaaggtacaatcatggcttactgcagcctcaacctcctgggctcaagtgatccttccacctcagcctcctgagctgctgggaccacaggggcatgccaccatgcctggttattttttatgttttgtagagatggaggtcttgctatgttgctcaggctggtctggaattcctggtttcatgcgatcttcctgactcagcctcccaaagtgccaagattacaggtgtgagccaccacgccctgcttctttttaaaaaatacaacattggctgcaaggtggctcatgcctgtaattccaacactttgggaagccgaggtgggaggatcacttgagcctaggagtgctagaccagcctgggcaatatagtgagacccagtttctacaaaaaattttttaaaaaattagctgggcatggtagtgcatgctggttgtcccagcttacttaggaggctgagggaggagggttgcttgagtccaggagtttgaggctgtagtgagttatgatcatgccactgcactccagcctgggagacagagtgagactctgtctctaaaacaacaacaacaacaacaacaacaacaacaacaacaacaacacagggcaagcaggacatggaactaggttcaaatactggaagaaactctgactctatatcttacttttagggaaattaaagggatcttaaaattgagcatacacattttttacctttaggacctaacccaatctaaggtggctgcattttacctaaagttgaaggattgtccctagccagaaaagcttcagatccctttagttcacattccaacattgggaaaataaacttgaaaagtattttccttagcaaagaaagatctgggtgtgaaacaaagttcattttgttttgttttgcttttttcttgatcatcagtctccagtgccaatgtctcagtttgcagactaactgtaatcacatgtgtggcctctccttaggagaaacagtaacacactctctgatggatcaatttggcataaactgtgaagtaaaagggattccatgctgggtggaaggttggaccagaagttctccaagtttcctttcaaacctctctgtggcagtattccaactgttctaaggccattgtgaaaggtcttctgagtaatttatggcctcttttttcctttaaccaagcgcattagatgatctccagatgtctctgttattccttttggaagcagtagggtcctggatcatgagctgggctgtggggaacgctgcctgggaactgtgaggacatatttaacctgctgatcttgaatgtctctagttcctcactggtcttgcctgcctcttgttaggtcaaggcactcataggaagtggattagttgcatttaaggagaattaagtgttgtttgaaaaaatatctggaccctggggccccaagcaggggtagagatttactgtggagctctttcctgaaagcagaacagggatctggaactcaaggccagggcctttgggttaggaaagtggggcaccaggatgggtgaagagattggctggggagggctaccagcccctgccttaaactttgggcctgcccagcagtctctctgtcactgttaaggccatcttcaccttgtggtgacccagttttgtcttttctgagaaaaggctttgttgaggccaggcgcggtggctcacgcctgtaatcccagcactttgggaggccgaggcgggtggatccatgaagtcaggagatcgagactgtcctggctaacactgtgaaaccccgtctctactaaaaatacaaaaaattagtcgggcgaggtggtgggtgcctgtagtcccagctacttgggaggctgaggcaggagaatggcgtgaacccgggaggcacagcttgcagtgagctgagattgcaccactgcactccagcctgggcaacagagggagactccatctcaaaaaaaaaagaaaagaaaagaaaaggttttgttggccagtgacccctatacagagaccctcagaaaacttgttctccccctctcagattttacgccactccaggggtgtattaagctaggttgccacctcctctgatgactctctttcccgtatccccttttccacgtgttctgcttgcccttcacaataaactgttatctcctgaagaaaaaaaaactggattttgccaggggaggtggctcatgcctgtaataccagcactttgggatgctgaaggaggattgcttgaggcgaggaattcaaaaccagcctgggcaataaagtgagaccttatctctacaaaaaaaaagttaaaaaatcagtggggcatgctggtgtgcacctttagtcccagctacttgggaggctgaggtaggaggattgcttgagcccaggaggttgaggctgcagtgagccatgatcatgccactgcaatccaatgggtgacagtgagaccatgtctccaaaaaacaaaacaaaacaacttggattttattcatccctccattcttggctctgagcctggcccatagtcctgtaaattggtgttggggatctgcccggggacctgtatgggaactttccccatcttcctatattgtccttgacttttttgtttatttgtaacttttaagattgcacattttcaaataaacagaaagtatacagaatagtataatgaatacccctttatccagatttcccttgattgcaacacttgccatatttacttcatctgttctttttgcccaaatatttaaaagtagatttcagatataatgatgttttacccctaaatactcatgtatgcatctctaaaataaggatgtctccccacagaaccataatactgtattctatattattatcacacattattacacctaataaaataaataatagttcctagcctgggcaacatgacgaaaccctgtctctacaaaaaataaaaaattagctgggtgtggtggtgagcgcctatagtcccagctacctgtggggctgaagcaggaggatcacttgaacctgggagttcactgcaaggctgcagtgacccatgatcacaccactgcactccagcctgggggacagagcgagacctcgttcccataaaggaaaataagtaagtaaattaattaatgtaatagttcctggctgggtgcagtggctcatgcctgtaatcccagcactttgggaggccaatgcaggcggatcacttgagctcaggagttcgagactaacctggacaacagtgaaaccctgtctttaaaaatacaaaaattagcctggcattgtggcgcgtgcctgtagtcccagctactctggtggctgaggcaggagaatcacttgaacctgggaggcagaagttgcagtgagccatgatcgtgccactgcactccagcttgagcgacagagcgagaccctgtctcaaaaaaaaaaaaaaaaaaaaaagttcctaaatatcaactgccctcagaaagtcttttataactggtttattcaaaccagaatcttctcaggggcaacacattgcatttaattgttttgactctagtttttcttccccttttcctccatgctatgttattgactcattgaagaaatcaggccagtacttttgaaagtcccattttcatggtgctatttaaacttcaccagactcctaaggtagagctgacttaaggaaacatcatagccaccaccgtgggagtctcctccactctaggaaccctccatttctttctttctttctttttcttttttgagatggagtttcgctcttgttgcccaggctggagtgcaatggtgcgatctcggctcaccacaaccttcgcctcctgagttcaagcaattctcctgcctcagtctcccgagtgcttaagaaccctccatttctatcctcctctttgctcccatcatccaggagcaaatccccagggcattgaaacccaaggctaaaggctcctctatcccatgctctctcatcttttgcttggaggtccatttcctggctttgcagtcagctggtgtgagctttccaataaagcagggcctggacagctctccctacagctgccagcaacaacctcaggaagccccagggtccttcacttaagttgctgtcaaagcctttgaacttggggctccggggcttcattatgggtagcagcaaacaggagccaccatttttcaaaatgaagttaaaatcctccccttctaactcaatacatctcttaaattcatcccagaaaaataacctgttttccaagtgacgttagattcagcagcaccacccctaccctattgcccctgggactgatgatctccaggcagatgcttcgcaccagtggctgctcctgccagtaaaaaaaaaaaaaaaaagaagtttccattgatttgcttgagaaatgtaagtttggggctgtagtccctgccgcaaggtcaatagagaattgtcttgcctgaggtgccccaggaaatcagccaggaaaagcagggatctacttttcatttcataggttagggagggggtgggaggctggggcagggagagaatggagaaggggaaggttcagatagctgtgtgtttagatcagaggacttgggctaaagtcagcaagaaaacatgaatattccaacacaaagaggagtggagttacgccatcaggggtgtgggctggaaaccctaaaaggacagttgcctccagcttgacatgagtgtctagctgtttactttggctcactggatttcactttttttgagacagagtcttgctctgtctcccaggctaaagtgtagtggctcaatcttggctcactgcaacctccacctcccaggttcaagcgattcccttacctcagcctccctagtagctgggatcacaggtgtgcaccaccacgtgcagctaatttttgtatttttagtggagatgggatttcaccatgttggccaggctggtctcgatctcctggcctcaagtgatccgcccacctcacccttccaagtgctgggattacaggcatgcaccactgcgcttggcctggatttctatttgtgtgtatttatttttacaaggaaaaactctccaacagctatgtttctataggtggagtagatcacattttattcttcctgaacgtggtaaaatgtttcacaggcaattaagagtggagaagagagaactttatacttttaactaaattctcaatttatggatcagttaaaccttttcattttctggctcttcctcttaattctgtttcttgtttttcctttctctccctgcaaggctcccctttttgtcccccacactccactttattttcctacttttatttcagtggctggcaaaatcagagcgttatatttgattttgaaagagtcactatgga

(The sequence listing continues in the following parts.)

We claim:

1. An AML biomarker consisting of between 3 and 65 different probe sets, wherein at least 20% of the different probe sets consist of one or more isolated polynucleotides of 20 or more contiguous nucleotides of one of SEQ ID NOS: 1-13 or 20 or more contiguous nucleotides fully complementary to one of SEQ ID NOS:1-13; wherein a first probe set consists of one or more isolated polynucleotides of 1000 or more contiguous nucleotides of SEQ ID NO:6 or 1000 or more contiguous nucleotides fully complementary to SEQ ID NO:6; wherein a second probe set consists of one or more isolated polynucleotides of 1000 or more contiguous nucleotides of SEQ ID NO:12 or 1000 or more contiguous nucleotides fully complementary to SEQ ID NO:12; and wherein a third probe set consists of one or more isolated polynucleotides of 1000 or more contiguous nucleotides of SEQ ID NO:13 or 1000 or more contiguous nucleotides fully complementary to SEQ ID NO:13.

2. The AML biomarker of claim 1 wherein at least 50% of the different probe sets consist of 20 or more contiguous nucleotides of one of SEQ ID NOS:1-13 or 20 or more contiguous nucleotides fully complementary to one of SEQ ID NOS:1-13.

3. The AML biomarker of claim 1 wherein at least 70% of the different probe sets consist of 20 or more contiguous nucleotides of one of SEQ ID NOS:1-13 or 20 or more contiguous nucleotides fully complementary to one of SEQ ID NOS:1-13.

4. The AML biomarker of claim 1 wherein at least 80% of the different probe sets consist of 20 or more contiguous nucleotides of one of SEQ ID NOS:1-13 or 20 or more contiguous nucleotides fully complementary to one of SEQ ID NOS:1-13.

5. The AML biomarker of claim 1 wherein at least 90% of the different probe sets consist of 20 or more contiguous nucleotides of one of SEQ ID NOS:1-13 or 20 or more contiguous nucleotides fully complementary to one of SEQ ID NOS:1-13.

6. The AML biomarker of claim 1 wherein the one or more isolated polynucleotides of 20 or more contiguous nucleotides of one of SEQ ID NOS:1-13 or 20 or more contiguous nucleotides fully complementary to one of SEQ ID NOS:1-13 are detectably labeled.

7. The AML biomarker of claim 6 wherein the detectable label is a fluorescent dye.

8. The AML biomarker of claim 1, wherein the one or more isolated polynucleotides of 20 or more contiguous nucleotides of one of SEQ ID NOS:1-13 or 20 or more contiguous nucleotides fully complementary to one of SEQ ID NOS:1-13 comprise DNA.

9. The AML biomarker of claim 8, wherein the DNA is single stranded DNA.

10. The AML biomarker of claim 8, wherein the DNA is double stranded DNA.

* * * * *